United States Patent 7,868,149 (PLANT GENOME SEQUENCE AND USES THEREOF) - sequence listing, part 92

SEQ ID NO: 48065 - DNA, 15184 bp, Oryza sativa
acaatcccccaccaaatctcaaaatcccactgagatttgccttttccaatgtactgtttatataccagcgattcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcatgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcatgaagggatctgccaggtttctcgctgtttggatgtaatccaacgttataactccggagtttcttaatttcctgacagacttcaatcgtcttttcacatgtctagacgatttcatattatccttagaactattcactttgacaattactgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggattgcaagagtgtaatcccattctcacctctaattagcttaatgtttaagataacatcagctactcccaaatctttcatatcaaaattctgagacaagaatgatttaacctcatttatcacctcaaggtttgtcccaaatatcagtatgtcgtcaacatacaagcacaaaataactccctcacccccaccatggcgatagtacacacatttatctgcctattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtctggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaattcatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagttaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatactggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcgctggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcatgtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcaacaaaacaaaactgcaaaaggaggctgcatctgcgcaagggtgaggagccaatttttcggaccattcgacgcgtacgtcgtgcacgcgcgctgcctgccctgccaggcgaggcgaggctaggcgagcgcgcgcgtgtgtttcccctcttctctccaccacacatgcttcaagcgactaggagggcatcatcccttttaaggaggtccccctctcctagaataagcaaggtggtactaaactccacatgcatgacatcccatgaggtgggcttttgtgattttccaaagaattaatcttcgagtgggctaaggcccattcattaattccaacactcacacctgtacagcacacagtaagctttcacaagaaagcctttttccccctttgtgttagatatagtacagccatggaaggtgttgggtgcggctttgcatgacaagtgaacagtttttcaaggccatcaatggaagtgagggtaatcacagttgaaggctcacagtaatttcgtagcaacttcacatggcttagatgttgtatttcatcaatttgatctcaagtatttcatacaaaagataacagtatcatgtaacaatcgtaccacatccatgacgtgattagctggatacatcttgatgtagaggtcgattgatttccgttaaaaagaacatctttgccatgatgcttgtgtcatctagagaaagctaaagctaaattaagagaggtaatcatggcagtgaacaggtgctactactccgatccctttgtttcaaaatatagcaatctagtataaacatgacagccctcgaaggaatccatctgtctggaaacaaccttacaggtgaaaaaccatcaattttaaagaacctgtgcaacatgaaggtaataatagacgtatcatgtctgtctggattcgtatcgtctgccattagcaacaacttctacggaagcctcccagactggttggaacttctgacaaacttgacctagattttcaagataataatctcacaagacattcagttcagactgggttcctccattcagactggcaatggctgacctccgatcatccagcctagggacaagaatcccaactttggcttcgatcacaagttggcatacagattcttgccatttcaaatgaaagtattactgattcaggccaagtttagttccaaaatttttcttcaaacttcccaacttttccatcacatcaaaactttcctacacacacaaacttccaacttttccgtcacatcgttccgatttcaaccaaacttccaattttagcgtgaactaaacacaccctcagtccctgattgtttctggagctactgttttggatctttcaaacaatcaactaaccggcatgctaccagaaagactggaacttatgcacgcacacccgatagacctttgcaaaaacagattatcaggcccagtacaaaacaattccatttacgttgactcttccaggaactctttatcagggaaactaccaacttaacagattttgcaacagaggtattatatgtgcttgctcttcagaacaattctatggagtatctagcagactggcaccattccaacatcaatatgtaaaatgcaacacatccgaaaccgaaagctagacttatcaaacaacatgcttacaggagaggttccatctggcggtcagcagggagattttgaacaacttcaaattgagacaggattgtggattttggcccaaaacaatacgcaccaaagttttagtacttccgcaacccagaacctaacaactagtactaaattagcatccagagttcaccgttaatttctgaagaatttagtatgtcagtgctacatccatagatttgtgaacccatctatgtcggatgacaaaaacaccataaacgcacagacccatcagctctccacggcgtagaagaagggatcgtcgagagacagatcaatggcgctctggaagctccagcgatcttggacgaggttcttgggaaacatcagctcgatctccaccgcctcgtcgtccttggcggcgaagcacactttatcctcgcagaagaaggccacggtctcgagcacctccccctccaagatgaggtacttgaggcacaacacctcatagcgctcggtgtggaacccttggatgctgactgtcttgagatgcgacttgaggcattcgcaggaacccagggattcccaaacatccgcgcaattcgcgatttcaggtgatgcgcatggaggaatggactgcaatttagcaaagcaacaatcagaactttgcttagcttatcaatcaggaaagctatcatatcaaccagaagtaatgaacattgcaaatcaactacacgatgcaaattaacagaataacatggtactactatctaattatattctcgatctaatctagaattggtatttgactagtagaagaatgcagtggaagtaagcttgcaggtgctaaccgcgtgtactaaaacaactaccttgatgtgaagagtctcgaggtgagggaagcatttgagcagcgtcatcagcagcttgatctcccgttcgatcgccaaacacaccttgacagcaagtatcttcaagctcgggagcttggcgctagacttcacaaacatccacatcccaggctgccatttcattcccaatacaacaaatcaaacaacagagaggaaattgtttggttgcagaatcacgaactgaattgcaaagtgcagagcacaacagtttggagttataccctgatggtggtgccgccaatctggagctcgtggagctggaggtccaggatgccgagcacctccagccttggcgcgcttacgatcttgatgggcgtacgctcggcgacggggatggcgtggtggaggagcagccgctccaggcatggcgcgccgtcgacgacaatctcgtcgaggctggacatccactccaccgcggcccggaggcttggggacttgatgcggagccgcgacgggcagttgtacgacatggcgagggagagcacctccagcttactgcagagcgagagcagggcgtcgaagtctcggtcggggatgatgcagtggaagaggccgagctcgcggaggtttactaaggcggcagcggcgacttcggggaacatccatgcgccgaggtacagccgccggaggtaggcgcagcggaagatgtcgtcggggagcggcatgttgagcggccacgggcggttgaagaggatgaggtcctcgacgtttttgtcggccaggctcgccacgaggcgccggagcgcgtactcgtggtggtagaaggcgacgtgggtgatgcgcgcggagcggacggggcccgggtgcgcgtccacgcagcgggagatggcgcggacgagggagacctcgttgtcggcgtccctgaggtgcgcgtcgtcgacgaggagggaggtcttcgtccacacgcggcgccagcgcgtggacagcgccatggtgcgcgcggcttccttggtggagaggcgggagatgatctccgagaggaggtcgtccgcgaggcggctgatgtggtcctcctcgccatcccccggcggcggcgacgggaaggagcgggcgtcttcggcggcggagtagtcgtcggacgaggtgaaggagaagtggtcgtcctcggagtcgtcggcggaggcggcgtcgggcggcgcggggacgaagggcgcggggaggagggagatgaggtaggggatgatgcagtcgatgcgctcctgcgccggcgggtcctgcaaggagttgaagtagtccaccacttccccgtaggtcatgcccccttcctcgccggcggcatccatggcgacggcggcggcgggcgggaaggcgaggcgaggcgagtttgggagaggaggaaacggaagcgagggtctttttcttttctttttttttttttttttgcgttttgaattccgctgctctcacgagtcacgactcacgacgccatagctgtacaggtaaccccagcaggtgacacgatctggtttgctaagagcaagtattatgataggctataagcaggctaaatcctacgcggaggagagagagaggaagagagagaaaaaagcgggtattttacacaccgccggctgccatcggtgtttgcctctctgttcgtgggccaggctgcatcaaaacgccagcttaccgcccgcagccggcgcagcggtgggcgaagagcgacgcatgcagccggctggccggctgcgttgttaaacttgctctaagagcaggtacaatagcatgctattagctagttataaatatattttaataagataaaagatactccctttgtcctaaaaaaaagtccaattctagagatgaatctagacacaccagattcatctctagaattggatttttttttgggacggggggagtaagagagaagagcagcaggctacatatctgtagccagctgcagcacgggctccaaaacgcagtgtgtgcatgataggtgggaccatatattaatagtatagtaagaaactattgtatgaattggctattagattagctatatatgaattggagctagtagtagactatagtattgaacttgctctaaggaacatggaaggccttgtataggaaggaaaagttttaggagtacgaagcttgtcctgctctcggggctttcacagtgcaatacgtggcattcaacttgaggaggctaggtcggagattttcctccatgtcggagtatttcggtgctccatgaagaatgcggagataaatgttgccacagatacctcgttagaaattgcattgggcccacacttttgtgtactgcacgcgccacaggagagagtggatcggaagagaggcggtgaggaggggaacagaaagggagcggccagatctgaccggaggaggccgcatcaaccactgccgaggagctcaacgcggcggcaacccaccgctccgtgccgccatcggggagctcatcgaccctccctccaatttgggccaccgagctccatctccggtgctccgaagcttgtcagcggcgtaggcccgagccctcgccaggaagtgctccatgtcctcgcgttcgagcacatgtcacacgactgcggcgaccacggtgtccttgcgaagctcacactacgggaggtcgccaactcgggagcaccttcagcaccaggggagttgccgctggacaggtagtcaataaggagagcgagggcctcctcgttagcctcgccatgctggagtacatccacatgtgcaaagacgacatgaccccttgaggacacagccgtttccggcaccattgtcggttgggcacagaggccgagttggacagcgtccgacggtatgcgcgctgcattgggcttctcttctaggtggtggacaacatgctcaatatgatgagcacgttggagtagctcgggaagtggagggtgccctatcgttggtgtcgctacggaaagtggaggtcgcccacattgctgacatacgcccacggcctctggtggtagatctggagctggatgggttcgtgatacacgccatggtggaggccttggagaggattagggagagagctgaagagaggggagaggggagagagagaagagaggatgaaagacaatgctagtcactgacatgtgggtcccacataggtcccgcaccgactcagctttgccatgttacctaaaagccgaacatagtactgcttaggacatcgggtgattccttttgtaaattgagtgacccgttatatttggtatttcagtttacgaataaatttcagactcggcgacaaattgagggacctaaagtgaacttattccagcccaaaatgattgtcgcgggccatcaaaatctcataatatggcccatatagaactccttggtccaacggaattctccaccgaggccttgttccccgcaggcctggtttacacaatttcagcgaaacatccatagaacgtgtaacatatggtatcacgtgccacaggaaacatcatccacggtgtagggtgtatttggattgtagagaacgtgtagcatcagctgtaggatgtatttggagtttcaactagttccaagatttttcagaaaattggacagtttcaaaagaagcgaaagcggaaaggtggtcgatcggaagctgcctccctgctccggtttttattcgcacagccaatcgatgcccccagaccggcacacgcgattcgtcacactgtcgccgcaggccgcggcaggagcgcaagctggcactgtggcacaggggtatcacacgctggcggtgctgagctgaggcgcgccgctgcgacgacgacgcgagcacgggaacgtgtccgcaccgcaccaccgggttcaccggctcgtgggccggctgcgaacgaatcagacaaaaccgcactagtcactagtagctcacctccaacatttattccgctccctcccgtccaccgccgctgccgctgccccaccggaacatgcgccgcagaaagccagaaaccctgcttaattaattcagtaatcacctccgcctaatctaatctcctggaataatggtttctactcgcgcacaactccgcttcttttataatagccgtccatacccgcccagcccacttcacacctcttgctgctgctgctgctgctcatggcgcctcctccgtctttgctcgccaccgcgcttctcctcctgctcctcgccatcgccggcgggccaaatgccgccgccgtcgccgaggccgtcaggtaccagaccctcgtcgccaccccgctctcgccgcacccgtacaccgccaccgccgtggaggatgacggtctgttccaggggagcctcgccgcggacgagggcggcgccgccgcgtcgacggtggggctacgcgtggtccaccgcgacgacttcgcggtgaacgccaccgcggccgagctgctcgcgcaccggttgcggcgggacaagaggagggcgtcgcggatctccgcggccgcggggggtgctgcggcggctaacgggacgcgtgtcggcggcggcggcggcgggagtgggttcgtggcgccggtggtgtccgggctggcgcaggggagcggggagtacttcaccaagatcggggtggggacgcccgtgacgccggcgctcatggtgctggacaccggcagcgacgtcgtgtggctccagtgcgcgccctgccgccggtgctacgaccagtccggccagatgttcgacccgcgcgcctcgcactcgtacggcgccgtcgactgcgccgcgccgctctgccgcaggctcgactccggcggctgcgacctgcgccgcaaggcctgcctctaccaggtcgcctacggcgacggctccgtcaccgccggggacttcgccacggagaccctcaccttcgccagcggggcccgcgtgccgcgcgtcgccctcggctgcggccacgacaacgagggtctcttcgtcgcggcggcggggctcctcgggctcggccgcggcagcctctccttcccctcccagatctcccgccgcttcgggcggagcttctcgtactgcctcgtggaccgcacctcctcgtcggccagcgccacctcccggtcctccaccgtcacgttcggctccggcgccgtggggccctcggccgccgcgtccttcaccccgatggtgaagaaccccaggatggagacgttctactacgtgcagctcatgggcatcagcgtcgccggcgcgcgcgtcccgggcgtgcccgtgtccgacctccgcctggacccgtccacaggccgcggcggcgtcatcgtggactccggcacgtccgtcacccgcctggcccggccggcgtacgccgccctgcgcgacgcgttccgcgcggcggccgcgggcctccgcctctccccgggcgggttctccctgttcgacacgtgctacgacctgagcgggctcaaggtggtgaaggtgcccaccgtgtcgatgcacttcgccggcggcgccgaggccgcgctgccgccggagaactacctgatcccggtggactcgaggggcaccttctgcttcgcgttcgccggcaccgacggcggcgtctccatcatcgggaacatccagcagcagggcttccgcgtggtgttcgacggcgacggccagcgcctcggcttcgtgcccaagggatgctagctaattgcgccttaagcctgctgcttaatctaattaacgggggagtgagccttgtttagtcataattaagtacttaattaagggtttggtttgattaaggtggcgagtgagtgagggagggagagagctttggatgctgtaaagcgctgtgtgctttgaggataaggcggttgaaggctgtaaaacagttaaagtgatgggttataaaaatctccttgaccatgtcagtatgattctatgactgtctctgactggctcgtttgctatagttgtatatatgttgtcccttttcttttcctggtcttttacgacagtataattaacttggccttttctaaaggactttttttcttgctattttacctctgtaaaactttgctgatgggctttactagtatgaaagttgttataagtatagtaatctgccgtttaattaaactgcattggacatgcgaggctgtgacattggcatgccacttgacacagcgcaactgagcgaactgaacacacagccgtcacttggaagttttctaacggtcccaaggagtaagagcagggtaaatagtacagccaactactagctctaaaatatctatagccaatctaatagcttattttatacaatagttaactataaaatatactacattattaatacccggtcccaccacttatacacacgtaacattttggagtctgtgttgtagccggctacaaatctgtagcccgactttttttctcttatattttcttgtcgatatatggttataaccggtgtacatgctctaaaggtaagttttcaagtggcgagggcccacacgtgtggggtctcacgctctctcccatctcgtaccacggacacggagacgagagagagagagtcagagagacgtacgaaggctcgacacaaactgtgagaaacgttgggagggcttgctttttttccttgctctccgggctccgtccgtccaccgctttggctgcctcggacactgtgccttttttgcgggcgtgtttgtcgctgtccaaggcctcctgctacctaaccccatgctactttatggacttggaatagtacgggtagggatagcttgtgcttgtgcacacagcacgtcgtccacagaccagtgtggaaatttctccactgcacgcctccatgtgccgcctcgacccgtcgaccgtgcccggtgcaacggacggcacatgccgtatgcacacccagaccacggccgttgtctcttctccccggaaaaaaccacgggaggaggtttacgtttttctcacggatcagttcactagccagccccctatagctcctgctcgcggccgcggcacgcgcgcggcgtggtgccaaccagattaccggagcaaggcgtggcgtgcgcggctcccccctcttccggcaacgaatcccgcgccccgatctgggacggtgacgctctcgatcggtcggtttcgcaaccgcttccgatccgctgcccccgcgcccccgcggcacaggcactgcacccacattgatttcgcgacggcgatgcgcctatcttctttctcagcttgatctcaggagaaagagcccccccgcggccagcatcgtcacgaggggagcgagcgagacgcatcacattgcacatggcgcgccgcgtcacgctcgcatctcacaattcacatcacgtaagtacgtgccatgaattagagctaagtgtaaattagtagtactccgctaatgacatgccaacgcgtaataactggggcgtcgcgcgcgcatgatttgagtcgttgacggatgtcgagcgctcggtcaactaattaggccatgatactactcccaccgtcccacggcacacgaaggtcccatttttttctccaataaaaattagatgaagataaagatttttaggtgcgttatttaaattccgtacgaaaattttttatatgaaa

SEQ ID NO: 48066 - DNA, 20429 bp, Oryza sativa
ctgcagcccgacatgaaaagcagcagcgcacagattaaatcatactccctccgtcccataatataagggatttgagtttttcttataatgtttaaccactcgtcttatttaaaattttttgaaattattatttattttaattgtgacttactttattatctacagtactataagcacaacttttcgttttttatatttgtaaaaaaaaattgaataagacgagtgatcaaatgttacaagcaaaaactcaaaatcccttatattgtgggacggagggagtagaagttagcagttgaggataaccatatgaagaatctcaaggacataatagattcacattttactgatagtatcttacccatcgcaattatcaagcagcgaggtacactgttaaactgaagctattgtcctaggcataacaatgtaaatatgagagaggaaaaaaggcacgcgatgaatttgaagtcatcattcttgaaggatatctcagggaatgtgctaggatcagaagaaaacaatcatgaacacatccactgcatagttgtttagcagagaaggtgcatacatcgttggataaaaatgcttcctgaattgagagaaaaatttcatgaccaaatcaacgtaatacatagcataacttggcttcaatgtgatatgagtatactgcaagcaacaaagagataacaccaacaaactttgtgctggcctataatacctgcaatagccatctttaagtgctctagaactgaaccatttgggacaaaatattatacagttaatagctgccatatcctttaaggcctgactcttatgtaactgaacgtgatgagaaatctaaaattaagtgacagcagtgtgtagttttgagtacttaactaataatgcataccgacgggctaagtccatcaagcatttcatcaagtatatgacatacacaaacatatatagtagacgagtgtatggttaatttaccttctatttcaaagagttgtaggcaatcaatttgaaacaatgattgagatcaaccatcttacctataagactgtaaagaaaatcaaatgaagctactgaagaattctgaaaatctgcaaatataattaaacaaaaggagaagagcacaacgtaccttggttctattaaactgagctgctcacaaagtcactgcaccatatatatcaaaacacagctgcaatggagtagaaggtgcatctaagcttatggcatggctataagaaaaatagctttcaagttatacaacgcagcagcaggccagtgaatctgacatactttggtcaagataagacaccacccaacattaaatttacattgtaaaccgtccatgaattttcctgtggatgaaacaatggccatggaaatcatctgttgtagagtaaacgatggcgaaaccaaccaattgacaacaaaatgaatagagtcagaccagataaagcgctgttgcggatgaaaatgcagatctgcaaggaaaagaatcaaatattagatattaatgcctaaaattaatgatgcttcagcagcagagaagtggcaaaactttatcctggacagggagcagttggaatagtgcaggcacgcatcggaatcaacatttatggcctaatccagagagaagataacagaggcatagaagcttacctatatccgcttgctggagctgactgtcccgtggaaggcaatgacggcagtggccggaacacacttactctactccgtactgaaaccctaaagaggagctcatgctccatggaacacgcgtggtggcggatgagcggaggcccgggaattcagacaactcgatgagaggcctaccggagcaccgctcccctgtactgaccacggcgaatcgatggatttgggggtcaatgtactgtggtggtattccatctagaagagaaaaaaatcccctaacaaacaaccaataacggctaacctaaaatacatttacagttcaacgtggagatgtacaggaaaaggtggtgcaaattcaatacctgagtggtcttgctgcttccggtttctccgacgaggatgagggtctggttgtcacggaggacggcgaggaaatcgtccttctgctgccacacggggagcgtgcggtgcttctagaggatctcgaggtaccttgccgagtagggcctccccgtccaccaattgatggacgggttggccgcggcggtggcggtgctgttggtggtgccggcgtggccgagcttggtagagacggagctctcatcgaccacgtcgaagaggctcaccatgcgcttccgctccgtccccatcacggctgcggcagcggcgaagcgggggtcgggtcggttcgcgcggtaaggaggaggaggcgggcgggggaggtgaaaccctagctcggttcccctctcgccccaatgcagcgatgcgtgggggaattgcgcagccgtgcgggatgggatccatcgatctgtttggtgggatgtggggccagcgaagcgacgcatacgatagaggaaggaagcatcgcggcttcgcccgccacaaggagacgacggacggatggatccaatcgagaggagcagatcgagcggcgcagaagcaaacaggaactgttgccctgtagcaacccaagacgcgctgagattcatcggcggactggttaaaaaactaaggatttgatatgatgtacgtgcacgcatgtgtgagtagctcaagagtttatcaaagcccgagtacgtgacttcaatttgaacagaattcatttgaagagctgttcgcctgttctggtatgtagatttgggtatttactactagaaaaaagatttttcatagcgttattctatcattttcgctgacggtcatacgagaaaactgctagcaaaaacgtaacaagaggtggagggctacggaccgccagtgaaaacagatttttgctggcggccgagttaagcgggccactagcgaagatgttgctattttccctgatgccgccaccgaaaatcagattaaagagcaccacggcgaaaaatccaccgcccacctattaaaatccgcgcccaccaatatattccacgtgcttctccgcctctctccctcctctctccgcctccacccaccgttctccctcctttctatgactctccatccggccgctggccaggccttgggagctgcgacgacgaagctcatggcgcacagtggcttggtcgacgggcggagcaccggcgacggcgactcgcggggcggcagatgcggcggcggtgactcgcggggcggcgaacaggggcggaggtaccttggttcctgggtattcccgggaatacctaaaatttttttatcaaaaaataagtatacttttaatatatacacatgtacacatattagtgcacctaaatcctcaactcttcgatccaaacacggcccaactggcctcttgcattgcctcctaccaacctgatccactccgtcatgacccatcagacatcagttgacctacttagccaccactcttccagacgacgccctctcgctctccctccgtgacctatccctccctggctcggctccctcgcgccgctccccatttgcaaaccctaggcggcggcgcggcgaggctaggtggcaaccggcggcgggagctagaccgtgctaccatggagggggagaccattgccgccgccgctggaggccagcacccgacactctgccaagctcaggcggtcaggctggttgggtggccggcggccacgaggggcagggatggccagcggtttagcacttagacagaaatacccaactttaaaatcttggctccgccactggcggcgaatgccacttttaagctctgtttttatttgtactatgtttttttttaaagctgatgatacatctattttatttgctgatagctaatgtcactttttgacccagttaactctcttgcccgtggcaacgcgcgggccgccaatagtatatagagatattatgcatatgcttgcgtgcataagctagctgactcgatcgtgcgcgttaactattgatcgatccatcaaccggtcgatatcaagctgtacctacgtacatgcaaattaactaattaatcacctagctagctatatatatagattccatgaataatgcttgtgcgtgtgcgcatgtgtgtgtctatatatatatatatatatatatatatatatatatatatatatatatatatgcatctaattaataataatctctcgctctgtctctctctttctttcggagatagcatgcatccgttgttaactggtactttatcctcctcatgcatccacatgcatgcatgtgaccaataaaagaattgcacagcaagtaagagaattaatcaatatatgtgaatatgtctgtgtagctgcgctgtacgtacctacatgcaaattaatcacttcacttagcttccatgaatatacatgtgcacgcatatgcatctaaataatgtcatctatatatatacggatctttaaaggagttttcttcacatgatcagtgttaactttcagtttccaccactactaaaataaacatatctacagtttggcactatcggtgttggaaatactaaaccggtacctataatgcttttcccgctccaaacgcgcatccatgggacaccatcggcctgaactggcaccttgctgaagacacatgtgccggttcgacaagtatcagttttttaaaagaatcgacacctataatatattataggtcctagtttattatcatccgagatgtgccaggaagatctagcatcaagttttggaatgacggacaatggtgaagtcagatctaagtatgaggggaccaacttaatttacaagtaattacactaagaaaaaatattataaaatgttacgaaaatagatgcacaacggaaacacaaattttacgtggaaaacccttgcggaaaaaaactacggacgccgaccggcaacgatcaatgtagaggagtttgatacaacgtgggggatacattgggctgttacactctcgccgtgtggcttacaagggacacaagggtggatctgaatgggggccttggccctacaccgaaggggggcaaaagaccccttacatttctttttcactttcatagtgtacctgtgcagtagacaccccttactccacctctcattctactcgttgtttctgctcgtttgtatatataagtaactactagttgatacctcgcactttgttgcaagatatgtgaatgaatgcatgttatacaatatagaaatggtagatgtatatattttaataatgtgaaaataatatggagataatgatttgacactttttgcatattgatttcttaaaatacaacaaaattataaatgatatggcatatttgcataatatttaaaaatactctagataatagttgttagtgagtgatgatgtgacacacttgtatgtgatttaaaatactctagataataatttctagggagtgatgatgcaacacacttatatattgagttttaagagttagtggatgtcaactttacactaagatatgataagtagaagtaattatatatcaattcactgttagaagccaatgttatccagcacttatgtgaggaagcacaaggcagttggtaagggccggagaaagaccagcacgctaccttaaagcaggtcatgactgcttcaaccaggcaatctagcttggtgatcaggaccagaaacaggaccgtccatgtgtgagctctgcgacttatgaaaaataaggaagaagaagaagttaggagcctagaaattgctccctctatcctagaaaaaaccaaactcgcactaggacgtgtcactactacaataaatttaaacatagagacatcttagtacgaggttggcttttatcgagacatgatatctagatcagatccccccttccccaaaaaaaaaatttactatttctgcttcacttaatcgggttgaacaaattattttttctcaactccgacaagtgttcgatggcaattataactacatccaagatctgtattacgttataacgaagcgagtatgcaatctaggtggtatgattctattttttttatttggttagaagaaaatgaattgttgcaatgattcttattctacttattcacaatgtcactacatatgttggtgagcttatttaatagtatagctctaagttgtcgttagttgcgaacgggtttttacttgttagataacataacataactaaagaaagaagtattagattgttgcgtacttccattgcatagttggaaggcaaaaaagattaagaaaaatgtagtggtattagagacccgtcctaatgcaatataaattatatataaccctgatctgtcatattgtcagtattttcaaaaagataggattttattttatatttcggaaatggacttaaattgttagggatggcccaaagatgatggatcaagtaacgccaattctttctgcagcaacaggctgccgtatttttacctcctgtcgctgccgatgccactggtgcgcactgcgcagctgatggccagcatcatcttgatctactagtgcgaagacgacgagactgcagctgaacgagccatgtctatcgtgtgttatacaacttattacaatgcaaggactgaactgtgtgcttttcagtccttgttagctagcttgtgctcttcggtagggcacccacaatggattcttaagccctctaagatacatatacattatgaatgaagatggtccttaattaattatatatgtcttttggatgagctactatatatcaacaataaagaccaaccacacaagcaacaaaacatgcagtgttcatctctattcccatagacgactctccttaatttctctctccaacgtagttgcttgccgccatggatgcatggatagggaatgagggcacctgcattgagcgtcgctaattctggccgcgagatgatgccgccactgtcgccggggcctcctcctctcgcgagcaccgctgctgtcgtgcggcctcctactacgagtggcgccgatgccaccatggcctcccgcgagccaccaccactgtcagagtctcctagatatcatatattcccgttcccataatcacatgctatcctttcctttccaaattccaactcactacaataaaagtgtaaaagtgtcttgtaaagacactttggtttaggtatcatgtactatgcctcgaaaaaccacttgagtggagtctaacggcattcattagaggtatttaataaactatcaaataaatagaatcttaagacatttattatctacatgtctagagacatgttactagttcattataaaacgcctctacacctatagatacatattgtaattgcatcaaaatagtgcccctacatttctttagacaaattgcagtgcctctatggaaatataataccacatatcttgtagagacattttacatattgccattataatcattgaggcaatttagatagtgtctctatagctaactagcgcaagaaaaaaaaagtgcctctacaaaccaattatgtcgcagtgactgcagcccaagccccatatgttactttttctgaacctatttttaccgttccaatcatctcctatttgatcgcaaccaagtagtgctccacctctggccctctgctaccatcctgcagtgagtgaggagagagctagaggcgagccaactgtgattggttgctcgctttgctttttttagcccaggatggctggataatgcagcagccagctagctgcacaccagcaaccatactcgatctctctcaaatatatacttccttcgtttcacgtaagatgttttaatttttggtcaaagtcaaactgcttcaaatttaactaagtttatagacaaatataataatatttatattaccaaattagtttaattaaattaataattaaatatatttttattataaatttatcttaggtcgaaaatattactattttacttgatcaaacttgaagtaaacatcagtacatctctttatatacgtcctttattactccctctcttccataatataaggattttgagttttgtttacattgtttgatcactcgtcttattcaaaaaatttgtacatatataaaaaacgaaaagttgtgcttaaagtattttggataataaagtaagtcaaaataaataaataataattctattttttttaataagacgagtggtcaaacagtgtaagtaaaaaactcaaaatcttatattatgagacggagggagtatctctctatttttcatggaaaaaagggcgacaactttcttttccacggaaagaaacacgccactctgaacgggatttttccaatacgagaggaccatatatatcgaaaaatgagggccgtgagggaatgcgttaagcccagtaccacaaggcccacctagaaacccaggcagttaattgcgctttgagtttttttttcttcccttttgcaaaagagagaagtgatccaaatttaaaggtatactaccaaaatgcatgtgccttgcattgagtgaagccaaaaagagtagtagtgagtgtgtggggagtataaagccaccaagtttaattgagttccttataagcaaatagaatcttcccggtgtaagaaagacgctcacatgatgtaattattttttctctaaatccattggcatgggtgattataagaaaactattaataccaccttaaaatgaaattatgtattacagactaaagtttgaaaccataatatgtacttttgtcatgtattattagagtcgattgcaatgcatggttattttttgagtaaattccctatgtacccctaaaaactcactcaactctttcatacccccgaaatttacccgattccttctatactcctgaaatttcaacatgattcattccatgcccctaccgttatattttctttcatttcactattacatttggttgcaaatgtctttttgcctttgatgctttaagtttgaatataagcttgaaaaataattgaaaattttgtttgagtgcacagtatgtgcattttatgaaactaataagactaaataattagtgcagaaaattttgacataaattttgaaaataaaacaaatgtaataaattaaaaaaatttatttgaaattttaataggacaatggattttttttatcgggagcattcaaaaaaaattattttcagcattggtagtcatatctttgtatggatgctcctaattttttatgaatttttttaaaaaataaatacatttttttatttcattatctaaagataaattttgtggtagataatgcatcacataacaaactcataactataatagtctcatgcaataaacttttatatttttaataatgtagttcataaatttatatgttcatccaaggagtaaaatggtcatttttatagaaattagatggtcaactgacgagagagataaggaagggatccgaatcatatttagggggtatacaaggaagtaagtaaaattcagggacatataagggattagctaaaattttaggggtatataagggattttctcttatttttttagtacttgatgttgataaaaaaattatatttttcatattgtaaagagtagccttagtagaataaatgttttgggctatatatcggatcaagctcactgcactccaatctagaattgatttcactctaaaaaaatcagaaagaaatcatacagtgaatggaaagaaagaaaaggaagtgatgtggtgtcctgttgagaaattgagagaaccgattgcgaaggaaaaaaatgagaactttttggtacaatatactgtaagtatatactagcagtataaatcatcgaacgatatagattgtagctgcaatggcttcaacggcgagcttcttagcctcatggctatgcgctcagctcgctgccagcagcagcacgtgctatgccgcccacctgttggccaacacgcccaccaccgcagccgcgcctcctgttgtacctggcctccctactatgccgtcgttgcctacacaccgtcaccgatgtttatcgttcagtcaatgccatgggtcgtctctccgctccggattgatagggatgacgttatctttgtcgggcctaagtgaaaacccgccaccaacaacattcatcggtgacgggcctaatagttatctcaatcaggtctcaagttggagctcgtcacggatgatggacatcggtgacaggtttctgttagggctcggtcaagatatcatcggttatctttgttgggcctgaagttagggcccgttactgataggtgtcattcgtgatgagctcgatttttatgcacatctaatatgtctgtgcgagtatatttttatcagcctctttttagatccgtttgagatgactttgttgtgacggactgtaaaacccaggcatgtgaggggccgtcatagatgagaggatctgtactagtgatgcatgcatgtacattttacgttggttatgttctgtccctagaaattcggagaccatgtgcgagccttaaatttatgtgacaaaatgttcaattgaaaattaattcagtagatattggactgcaaaacaaaattggtagacaagaataattattgaaaagatgggcttggtagaatgcttgatgggcaatggcgtgtatggtgtgccatgctttgatctgtgctggattgcgacacaacttataagtcgaaaagtctaattctaaacaaccaaacaactttttcttttcttttttaagtcatatataagtcactataacaataataagccgaaaactagatcaaagaagctttttttgtcttatgtaaagaagatatatgacttcatcactaaacttaaaatattaaatccaccgacttataaatcatacaagctaataaattgacttaaaagtctaaaccaataaccctcggggggcaaagtccgagagggattagagcgcattggcacacgcgatgattatttagcaagcagtggacatgaatgtagaatgtgttagcattatagggggcaattaataaagcggcaactggatcgatcgagacgacaaaccaaacactatccacgaaatctatcagggtgatatcgatgaagctcacctagctaattgaacatgttggcatggcgtgtatatacctaactgtacacggggccccatagaatttaggaaaatgtatactttgactcctcaactattgatcaaatctaattcgtacactttaacgtaaaactggatatgttgactcccacaacaatcaaaaccggtgcaaactatacgcctcggtaatttagaaagcggtttggcttatatgataacttggctagtatttatccaacatgggacccacatgtaaatctcatagaaaaaatagaaggcctcgctagcacctaagcgacgagggtgagctagcggtggtagtgtcttgggctgaggtggttggtagcggtgacacaccgtgtggctggcaactgccaagataggcccgagctgagcaggcagcgctgaggcatcaccggcgagcttctacggcagaacttcaagtaactcgaccacacctttaatttgggacagcgcctgggcttagagcatcttgaccactactagcactgctgttggcgagtgctagggctcttgatgagcttctctcggcatctgctctcttgctgccatgaaccacccccacttcccccttctcctctccaattcgctccccctgcagaagcccctctctcgcgtgctccaagccaccgcatggcgcgcattgtcatcgtcgtaggtggatctccagttggactctaagaaaacgccggtgctatccatcgagctctacaggctcgcggtgccgtgcgccatagggaaggaggagagggaactacaacaaatgagcttgctccgtccaaggccatagggcggcgcaccacccagctcctcactggacggcgccaaaagaataacagtgttgctactcccaacgttgactgagacatgtgaatgggataaattagaagaaaaattatgtttggcagcaggtatacagaaatagctaacttttatggtttataagaaaaaaaaaggaaacttatgatagcagataatgacttctaatgtaaacaagatatacatcgaacattagatgatgatggatggcttggatgtctactcgctgattgcgaagttgtacatttggagtcttacatgtttcaaaagactcacgtggctatgaaattaacagtattataacttactcgatcattctctttttaatatcctgttttggttgccaaaacatacatattgtccttattgtttaatatcattactaaatactactgtaacgttagtacggataaattactagtcatacactagtacaataacttggctagtacgtgcgaacttttgtcaaaaccttccatgcaggaaaaaattatctaacatggcatggcacacactgatgtataattattattaaccatcaaatttttcagtgacaaaatatgtaattattacttttagtatgtttctgagatatagacaaaagaaaaagcaatacagtttaaaatatcttattataaaaatagctttttttaaaaaaaaatctcaacgaatgatcccttgtcccttttcttcttactataacctcgtgtatactttaataccaatttgatcctaatactctactaatatcgttgtcaggtataatcttcgataacattatagattggttttgcttgcacgggtagtttttttttttctgcttgcatggatagtttgggcccaggtacggaataagcaacttgcatccactcttagttcatgtataccatgagcttaatttaaattaattaaacattactatatattttcttccacaccgaactgtttattatttcacattttaagagatttttttattacacggtaagcacatacgtgggcacacttctacacatgcacaccacactcactcacccgtgagtacgtacgctaacacatgcttacaattccgattgaaaacccatttacgtgtgtatatagtgtttttgagtaaatactgatgggtaaagtaatgcacccatccacgacttcaccatttgctccaactgtggctattttgccattcaaatattaagttagtatgtatgtaattcatgtacttacagaagcgctatacaatttattgatagttgaatgctacttaaaaactaatattatgggacgaaggtaataattaaactgtcctcgaaggcaccaataaaactacagcaacacaagtactatggttagcatccatgtaagattgctaacaatccatatagataaatacagttgtgaacatttggaacacgatttcatcaaactttaaaaaaaaaaacagtagatgaacaaccttactaggaacattacatcatttgattttatttagtttgaggtagataaatacaatgaacacaactttgggtaacacacaccaaaccactacaaccagaagctcaatacccaccatataattagcacaaaacaaagtaattaattagggcagcatgagatccacgggcttatcaaagatccagctaaatggaatggccgtgggccttttcctcatctgggccgctctgtcatgggccttctcctccatcctccggatcttctgcggcagcgcgcacacgtagtcccgcgcgcgccgcccctcgccggagagccccgcctccagctccgccacgcgccaccgccgtatcaggtgctcgaggattccccggtagtccgacgcggtgtacgtcccggcctgctgcgccgccgcggcgtagtgggcgaacaggtcggcgtcgcggccgtcgtccatgagcgcggcgggcatggtgatccggcggcgcatcatgtacgccagcgcgcgcacggtggtgtccgggtcggcctcgaggagcctctcgacgacgcgggtgtaggcggcctcatgacgcttctcgtcggaggcgatggcgccgcagatgcgggcgagcgcgtcgtcgccgtgggcgcggacgttgcgcgccgtgttgccgtgggagatggcggtggcgcgctcctggaacgcgacgtagatgaagccgtggtaggggctcgccggcgcgtgcatcgccatgccggagccgatcagccggtgcaccgtgcgctccacctggcgcatgtcgaggcggccggagaggtacatgtagcggttgagcacgtcgccgtggcggttctcctcggcggaccacccgcggatccaccgcgcccacgccgtcgcgtcggcgccggtgacgtcgcgcgccgactcgaaccggttcgccatgctctggtacgtggggagcgcctcctccgtcaccatgttccccaccaggcacaccaggtgcgcgtcgggcacgccggcggcgcgcccccggagctcgacgcacgccgcgtggaacccgtcggcgccgagcgccgccgcgtcgggcaccaggtccgccggctgccacgcctcctccgccggcttcagcagcggcagcacgtgcgcctccacccacggctccatctgctccagcacctcaagcctcgccggcgccaggcacctcctcacctcgtccgcctcctccgcctccgcctcccgccgtgacgtcgccaccgccgccgccgccgcgctccgcctgcaccgacactgccacgtcagcacacgtacagagagctcagcgaccagtggcggttaaaagcttaccagaatcggagagtggcagttgccggcggcttgaggtgacagttgcggtttggatacccaaacatggttactgctaaggtggaggtcgttgccgatgccgccatgatcgagcagtacgtggatctgatcggaggagggaggaagacgacggcgatggcgacggcggcggcggcggcggcggcggcgagaaggcttggaatatgagtggatgcgactacttagcgagctacccttgcagatgtacgtgtgggtatatatatgctacgatcgatgtgtgtagagcttgtgttaatttgattaattaattaattatatatactgttgcttaattaaaatgttttaattggttggtggctgctagctagctgactgcatgcctggctcgcggtatcgtgcgatgaccgtttttgcatgcagaatctgtaccttaaataagtatagtattaactaaatcaaatttagattacaaatatgttaaaagaatattatgcccttccttaaggaacagaagaaagtatttattcaattaccaaaaatgaggaaaaaatacaataatattggaaaagtatacgtaccgtcgactactctaaaactacactattttagcaatgaaattttaaagtaaagctgcaattttttaggtagggaattctagtgttgaaagttcaggttatatttttcttccgtttcgggagctaggatgctcggctaacatttggaaacgtggggttaaggttaccatccaaattaaggttttccaagaaggttaactattagtagcatcgacgtcaaattaatcaaccgggtcaaatccttggcgtacgtcttattcgagctttttttttatttagtgtgtactataagccaaattaaagagacatgtgcatgactcaattaattaagcaaccaaaaataacttttagctagggaaaaaaaaccatgccacgttgaaccaaccaggtgcaaaacggtatagattatcacccagcttaaaattgaaaagctgtattaatcaagcaccatatagaaacataatgttgatactcgtgattcgcccatgatactcaatgatactcctacatttttatatgatatcgatgatggatagaaatagcttacatgcatgatatcttgaggtctaattgtagtaccttagagatactcgaattaaatttaaaaatatactgttcattcaattttttttgaaatattcgggatgtaaattttttttaagaaatatattgtcaatctcgcgtaaccgttgcgcaaaaaaaacatgatgtcatgggcgatatcgcgcgaagaaagtgcgagaccgcgcggcaacggcatgagaccacgcgatctcgtggaatggaagagggagaccgaacggtaaccaatcagcgacaccgtcccaacggcttcatttgattagtgattaattacctaattaactattaactaataataaatagtgattaattatcttgattagcgattattaattaatcaataattaataactaattaaccattttgaaatccagtatcgctctctggctcaatgagaccattcggtttcgctcttccgttccacgagatagcgcacggtcttgcactttcccagtgcgataccgcccacgatgtcacgcccacatcatttttgtgcaacggttatgcgagatcgacgatatatttgtgcaaaaaaaatttgcatcctaaatattactgaaaaaaaattgaatgtacggtagatttttagatttaattaagagatactctttgatgtacgttgttactcgtgattcatccctgatacccaacaatactttttttataatggatactgagaagacttttaagtgaaactagctaaatgcttgtgctttgttgtggctaaaaaaatcatattattatctaaaataaataaaatcatatcttttcctaaaatatgtttcctacctttttattatagagaatactcacttttgtttaattttatatgtagttgtccatttggatttaattattattcaatatatcctaaaatataaggcacaaacatcattaacataaggattaagaaataattattaccacttacttgtttcaatcactcaatagatacaatgtatgcatccaatggaattggagatgttgagggtggaggatatttaaaaaccgaatttaagaaagaggaaagtactaattaattccatgcatgtatacacgccttatattataaaactattaagaaactacgggtgatctcatccacccaaggaaataggaccaacggttgctaatctaaccgatagagaagaggagatcgcccctctctctccctttggcgtccctctcgacaaccgatgcgatgttcccaaacatcgcatcccctgcggttggcaccgcttcacattgtataaatgtactgttgatcaatgagaaaatcatccattcgctctattgtgttcaattctctctctcgctcaatctctctcgctccaatcaattcatccactttcaacacgttagtcgtgccttatattttagcatgaagagagtatgtcatattaataagtttaagagataatatttaaaaactgtaatagtaacatgtgggctggcagattcactgccaacatcattagagtccttttaaggaagtataaatcaatgatacattaaagaatcatatactacctcagtctcaaaatggattttgacaatatatcgataaaatcctttaaagtcagagatatcattgtagtatccttgactttcggaatgcaattctaaagatagcataaataagtgatagagaattttttttttgtttgcaagggacaaaagagttcattgatcagaagataaatccttccccataggatgtgagatgaggttataagagttaccacatcaaaattctgagcttgcttcacaatgagcataatttgcaggctcgtagagagttgcaaacatgacaaactttttttttccttagaaagcgtggcacgccatatatatttttcgtggccgaaatttagcgttaatttacatgaattgttgagttgtattttccatatctgaatgatcgtatagctgctaaacgtaataaatcttcctttttttcccgaataattgacactgttccaactgaatcttggtccttcagagatattggttccccggcctatctctgtttagccatgtgttactaccaaaaaatcagtcataaatgctacatgtgcagtcaaaagtgacgatatttagaccagttgctcgagacgtgccctaacattaccacaaaattaaccaaacacatcgtaagtttactacagacacatctgacgagtttgtttcgcaatgaattctctgacagcaatacagcatgtagcagtcattcaggcccggccagctactgcaaggcaatgaatttgcaatcaaccggtggatgtagcttcagtagaacatgtcgcatagacgtactccaaaataaataaatctaaaacaaacataggatataacctaatacaacgaatctaaataaatcaaaataaacaaatctaaaatataatgttatataatcattacaataaatttgaacactcgttgtactagattatctctcatctcatcctgggtttgtttatttcgggatataatgcatggagtatagttgctgactcccactgtccataaatataaatgaataaatggactctagtactatattttcaattcattcaatcattatatatatttagtatttactagtagccatgggcggatccaacgtgggtgcagggagactcaagtcccctctacacccacaagacctatggatacccccgaaacacccctttcaattttttcaccatgaatgataaactaaaggtccctaaatggctagatattgaagaaactgtgtaaatgagccccctcaattttttttattcctggatccgctactgttggtagcagcattgttagacgtgatttttctcaatttaggaaccaagggagtacattgatacgcaggcgcagggctgcagaaacacagcagcagcagtaggcaggcaggcaggggcaataaaatcacagcttaattttagggaaacagttgtgtgagcagctatgcatgccacctgaatgctcgtgaaaatatcggcgactgcatgttcaatgctatctcatgaaaaatatcggccaatgcatgttcagtttaatgttgttctgagtcatttctgtgtacattgggagagagagaaagagagatacatgttcattggtctgctgaagaagaaatggcagagaggtggatagggtgtcatagaggagtaactgcatgctgaaacagaattttgtgtgggtcctaaaagaaatgctatgatcatttacatggcatctcaaaaatatctgtgttcctttaaaaaaatttatccatgttactgctcttccctgaggagtaatgggatgcagggatgggatggagagcctgaggagaaatttatccatatttttcaatttgacaaatttgggttaaattttactatttcaaatttgaactattgaaaactattcgaaaatttcagttagaatctaatttcgtcccgcatcgatcgaaatatcaaaatttcattgtttttttattggttttcataaaaaatgtaagccctagattttatcgaatggtggctctcttaccagatttttattcaggacacaatgggtcttatgaaaatctttctatatttggagaaattaaaaataaatgttcttattttctggaattcaatgcctaagtgtacgtaagggtatggtttcattcttttagatatgaatagtaatatgtttatatgttttaataggtcagaaccatataattagaagagatgtacgtgatcgaggataaaatattggatccagtggttacttgtgcgaaacgtacgaaagtgctacgcacggtgggaggagcagatggaaggagcacaactctgaatttaaagatggtagagatattctcatgtatacatgtaggatgaatgagaataatgcaaaccattattatggtttgatatgtaaaaatgatatatgagtagatttttcattaaaaatgcttcatatagttacattttcaacgatttctataaatatattattagaaaaaataacgaaaaagaacaaagttagtagtttgccttttatgttgtttactcataaaattatttactttctaaagaaatagtatatataatttacaagtctgtatcttttttaaagaggagctaaatctttcgtgacagatgtttaataatgttttcacggtataatcacgtgagtagaatctctagaggttgacttgagaacgtaaaacatgcatgccatcttttttaaaaaaaactaattattattcagtccccatgacttatctacctgtgacaaacaaatcttggcacagagatgacaaacaggaagatctagtcgcataaaattattgctacagaaaccgtgcccacattatggaggcgaaggtgatattattttgatgctgatcctcattgatcagatattctagctgggggggtccttgagtatggccgtggcagtacagatcaaagaccacaatatgtggcattaaagatgtggaaccccgtgatttgagagagaga

SEQ ID NO: 48067 - DNA, 2842 bp, Oryza sativa
atcccataaaaaacgaatctagtaccggatgtaacatattctaatatatgtttagattcgtagtattaggatatgtcacatcggatactatgttgattttttatgggacggagggagtacgttggagcaacactaacttaaacactgctttgtgtgaaaaggtgtattatttgagtagttgcagactgatatgcatatggagttgtttatgaataaactattggtcaagaaggctccaacaaggatgtctagttgtctagcaaattaagtattgttagttactgttccaaatttccagtagagatggcaatacaaacgatttgggcgcattaatcactaatatttttgtactttgtcaaatgtagccatcaccggtggagaaaccatctttggtcggtcggctaaaatccacaatagtcccggttgcaataaaaaccaggactaaagattcaaaagattagagctacttttttatctttagtccagatctatttctagtcccggttggtaacaccaaccggaataaaagatcggcatgcgcggcggagagtacgaggcgtgcacgagatcgaggaggaggagacgggatcagttaataaattctatctccttctccctgaccttatctcttcctcttcctcctcctcctctcctttaactcctctcctccttcctccctcccccatcatccccacttatgatctgcagcgcgaaggcccgggcggccggcggcctcgcggcctcgcagcggcgcggcggcacggcagcgtgatggcgggcagcgcggcggcgggcggagggcggagggccgggcggccacgtggcgggtggcgcggcagcggtagccacagcgagctttttttcctttttttttgagaatttgtgattcggatctgtatatttgatttgtgtgtgatgtgaatatgtgataaattttgtagaagttgtgatgcaattttttttaagattttgtgatgtatttggatatgatcgatttggggatttgaggatttggggataatttatttgggattttgggatggggactgagtgaaatcaatatattaaaaacaatgaagaaaaaaaataatggagcaaccggatctagctagactagctctatctttaatcccggtttgtgttaccaaccgggaataaaaattctctatctttagtcccggttggtaacagcaactaggactaaaaatctatttttactcccggttaattcaccgggactaaagatagcgatctttaatcttggattcgtagtcccggttggaaaaccgggaatacaaagggttacgaaccaggactaaaaaacacttctccaccggtgcatgtataactgtgttaatcaaagttaacggctagtttgaaaaaaaaaagtgatgtacttcatgtgggtacttaattaacgatgtaatttgacactgctccttattttttatgtgagatttgctaaaataatactagatagtacttttcgtacatccaaaatgcaaaggattccttttatttacggaggtaataaattaatatgaaatggagggagagttagaagtaatatattatgcagtctaaaacgtgggatcgtgattattgtgaataaaaaaataaataaataaagtggttacaagttgtgaagctagctcgtgtgtgtgaataagatttttaattaatacttgtacagccactagttgagttgtttgacctgtacattcatcaattctgcagcctaatcttcgatcccaatgtacaagcatgggtagtacgccagctgcaatgggcacgttgtcacattgatgccagctgatgtcttcatgggcatgaagaattaatttcgagatcctgattggaccttgaatgatttcaatgaaaaatagtactccactacgatactcctccatccaaaaatactactccacgcgttgtcgtagaaatttagcagtactaagtaaaaataatgagtaatatatatatatatatatatatatatatatatatatatatatgtatatatgtgtatgtatgtatgtatgtatgtatgtatgtatgtatgtatgtatgtatgtatgtatggtaaatttgtttggtgtttcatggtgctcgggctccatgatttaaattgagtatatactcaattcaaatgagtatgaaatttttttaaatgtttaggtataacatttactaactagttcaaaacaagtttgaactgaatttaaacatgtttttgtcagattttaattctaggtatatagcatccaaacatataattagttaggtatgtaatattggattgtgaaataaagttaaatttgagttgttttgttgctaggtataggtatgaatcgaatacttataactaggtatatgctcacaatttaaaaattttaaaatatttgggcgaatttgtgtatttcattccatggtgcccgggcaccggcaccatggtgcctcatatgagtgtcctgtatgtatgtgtatacacacacacactcacgtaagttgatgtggtttatgataatttaaatttaaatagtatataaaatgattattgaaatgtaaaagtaagttgacgtgactttatgagaaaagaaaataagagagatagtttggatcatagattaatcatctaagggataaaaaatggaggtgatatgacttaataagaaaaaggagggagataatttggatcatagataattatctaataacaaaacaattgatgtgatttggcttaatgagagaagagagatcacattttaactaaattaggagttagaatgaacaatatagatacataagatattataaaaaatgataaagagacatattgaaa

SEQ ID NO: 48068 - DNA, 6585 bp, Oryza sativa
  unsure (1)..(6585): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtctacttaaggttcctgttatagttttcaatatagctggacacttcaatctgttcctttcaacttctcgtgccatcccataatttccttgggtccaggaaagagcatcaaatacccgtccacacaagtttcgatgaatctcatgcttatccaagtgtgttcccagggtgaacctagcattctatgttccttaggttctcaaccttgacctatttgtgttgccttgtccatcttatttggcatgttcaaatatacccggttaatctcaaatgattctcaaatggttagttcaatctcatcgtggtttaacttatgattgtgtcctttcagcagtgatagctgattcattcagttgttaccacaggggaagaactcttctttctaactactctgctgcagagccaaagcttcctttcttttcaaatgcagtatgtccctatggtggatttttcttaccattgatcatgtgtatatgctctttgccaaattcttcaatcacaagaatttggtcgccttgtttggcatgctcaaatattcccagtcgattagttctatattgtgtcctttcaggagtgatgactgattccttctcatgattatgtcctttctgcagtgatggctgtttccttccattgttagtgtggggggatagttcctttttctaactgttctgtttcagaaccaaagcttcattttcttttcaaataccccatgtcctatgatgggtttttcatagctataatcgtttgtgtataatctttgccaacctcttcaatcacaatatgcagacagaatttctggtgttctgcatattgcttgcgattgtttccgctggatataaggactacgctaatatttaactttagaagttaattattttagtaaaactcacttagctgtcatctcctttgaacttccacttcaattcagattttagagccatggcctaccaaacaggccctacattttccagataggttccattgctcaatgtttttttggctcaaatttcttaatctcatcgttggcaggagcctttggcatgttctcagatttggtttgttatcaactgtgtattgtaggcaattttggtcatagcaacactgggtacaaacttgtactcaagcaagagttacaattgacaacatgagtacattgactagggcgtgcagtttttttagatggttagggcatgcagttgccactggtgcaacgtaatagttggagtctcctttgtaaatagaggatacgagattctgaatttttgtagcaaatagtcaatgattttttcacccttgtgtagatgagtggcattcgcatgttctgtattcttgaggataaatttcaacggttttcttctgaaatgcagaatatgtggtcttgttggtaaactgttgtcttggactagtccatgctatgcaattttgagcaattcgcatctggttgtaaaccgatatattctatgggttgtgtttacgaacgtgactattgttgagataatatgatgtcattatctttgtttatcttctgtggttcgaaccaaacattactaacagaactactccgtgatatgttatttgtgaaagcaatattcatagttgcaaacataagctagtgagatgcacagtaactagttatcaaaacgaaaaagaggctagctgactctgctcgtcatgcatgatatgtatgaatttttgtaggttactactgatatcagttcatcgatgctgcatcatgcatgaactgcaggttactactgatattgttttgggcattagcaggtttcagaattgaactttcgactgttgctgcgcgcacacaaaataaccttcactgcaaaaatttagtatgacgtatttgcaactactggtaaactcatattgtcacgttagcattatccgagacaaatctatgcttttcaggttaataagctaaatatttcagaaaacgtataataataacagttactccggtgattttggaaatttgactacggtgacgacttgttatcttgatcgaaatgagcgccgtatgaatcccttcttcggacttttgagtttacagagcagctgctgatggaagcaaacctgaggtaaatactgaggagctttgctctattggggatttgggggtggggtacatatccaaggaggtccagacaactggatttgatctatttctcctaaaatatactctctccggttccatattaattgatgttttggacaaggttgaggtcaaatttttataacttagactatcaataactttagaaatatttagtttaaagaaactataacaacatatatagatttgtcttttaaaatattataataaaagtaaacatagatttatttattatatatattataatagaaaaataaggtcaaagatgtatcttgtagaccgtgtcattgtccaaaacgtcaattaaaatgaaaccggagggagtaagttgtttgtgcttttattattattatttttaagaaaaagaagaaaatttatgctagccatggatttcagtctccttgctggataggataattgccagtggctgaaattacccagtcagaaagaaaataacttaccttatcttgtattgtcacaggctcagaatttatctatttccccccttgatagtaataataataccatctttggcagagaaacccagattcttaccttctgaagtcccctcattcctgatttggagtaaatatttgagtagcatctgaatgtgatgccctagctagtgaccatatattaacattcagttcttttagataatggattaaaacctggcctctatatccaaactcggatgtacatggccaaattaacatccagttcttcatccaccttcatatcagaacattccagaatacagattgcaatggcatccattggcaccacatgttttgactgattctttcactgtttcttgatatatttgttgatttttaatggtaaatagctcatctgtccaatcctggcaccacataatttcccctgttaaaacagtgccaacacaaatttactcatgtccactgaaaatccccagaggataacgttctggcactgccatatcaggaccggaccatacgcggcgcgccacgtggcgcgccggcggtcacacctgtgctggtgcaccctggcattatccccatccaccatcctgtgggtgactggccaccaaaggtttttggcgccacaattatattgagctgccattgcttctcacctctgctttgcatccatccatccatcagagatcaggtagaacagtgagagtgaggtgcagaaaaatttgagctgaagctgaggatggcaacatccatgatcacctcgccgctggtggcgccggcccgggccaagggccttccgtccatctcccgccggggatcctccttcgccatcgtctgcagcggtgggaagaagatcaagaccgacaagccctacggtctgaaactgaaactttcttcagaattcagacttcggaatgttttgctgattattgttgagtgggtttcagtggctgaatttgtgtggtttatcatttttctttttttttttttatctttgcagggattggaggtggcatgtcagtcgatattgatgcatctggcaggaagagcacggtcaggacttgtccccagctcctaaatttctcaatgtcagtcgaagtttttgctagttattcttcatggtggtggctagattttaaaaagaaagcaccataggtttcaaactttaaaacttgcaagaataattgccccatatttgtccaagtttcagtgacaatttcgcaggttttgttcattcaaagattccatctgtcagactatgcactgaataaactgacagatttttgtgatggatgcaggggaagggtgtgtaccaattcgttgacaagtacggcgcaaacgtcgacggctacaggtaaccaagatgagatataaaattaatattaaaagagtacttttacggtggtatctacttgttttagcaaaaattgtttggctcaatctgacaaactcctcgacgatttgcagcccaatctactcgccggaggaatggtctcccaccggtgacacctacgttggtggtaagtaaaccattcttttacagtccatttactatatatatgaaatactactatcataccagcaaagaagtcttggaataatttttagaaaaaggagagaaacaataagaggtatgctgtaagttagaataaccaaatctaatagatatatatatatatatatatatatatatatatatatatatatatatatatatatgcatatgttgagttagtccatcgtagttaactacttcatctattctaaaatataacgatttctagcatccagaatttgtctcaaaataaaacaactcttcactaacattatctttccatccaatcacaatcctccaccattcaccacaacttgcaccatttaattatatatactttcttaataattgtgtcttaactctaaaacttcttatattctgggacggaaatagtagtaggtacaaaatctgatagggtcttgtcagcaacctgtgatgtgatggagagttcttacaccctagaaatcataaaggcaaaatcttatcttgatcaatattattaagaaacttataattcttttgtatggtcaatcttatctgcctatatgcttgtacggttaattaattatatatctctgtattgtggtaattaatctgcaggaaccaccgggcttctgatctgggccgtgaccctcgccgggctcctcggcggcggcgccctcctcgtctacaacaccagcgccctcgccggctaaatttcacccaaatccagtctatgtatgtaacaccaagctgggtgtctgcatattcatctgtaatctaagatagccttcctctgaatgcgatgtgatgatgcccactgcttaatcaaactgcattgtgattaatctatgtaacactgtacttgcatgatgatgatatactacacttgatacttgaatttggagattaattgttgatactaaatacatagattacataaggttatcttgcattattgggccttctctctagtgcatatagttagctcaatgaacatgcaaattaaagtgagaagagtaaaatatccaatagctagttgactctcttacttattacggatcccaatttaaagctaaggactgaatttatttggattggtttatgtatggtccagtcaagtactcctacttcactccagatatgccaagggacaatacaggcatacagtgtgtggttcagtctatgtctagctatcttaggtgaaaacgatactactaccacatgaaattctaccagcagaggccgtagtacagagctgacgaaaatatgtggaccttcttgtcccgtgaatagttggatatttacgtggacggacaacccctgtcaaaacagttttcacaggcaaagtgagataaaagattgcctccaagtctacatgtcggtgagagatgaatatttttgagacaacatatagttgaaatcatgggctatattacataaaagttaaccatagattttcagcacaaaagataacaaccaaaagtaataattaactagttgggcctactacaacaaaaattagcaattagctacctataaaaaactacttccgatgaatctaagtgttttcatggggtcttaagatgcccgactaggtaaatattcatccccaggcgctgttcttaattgcctgcgtgtgacttgtttattgtctgctcattccactacttccactacatgtagttctatcatgatcatgcgggctcctctaaagtccaaccgctggactctagtcacgttctccattaccacgccgtgcctcatcatatctcactctccatctattttccagtaaaaagagggcaatgtgggttttcttagcactcttcctctctctgcattctcctttatctctgaccatgttgggctcgccacgccaaccgcagtacatgaccattggcgaagaggaaaaggtcatgttgaacaccgacgaggagcaaatctcctcaacgccgccaccgtcacttagtaatgtgtaggatagagatgatgagtggtggtagaacgggtcgtcgctaaaggtggattctccttagctatcatgctggtagctggcaaagctacagagaacacgctagtggtgcctcttctagatctctgtctttgcctctagctccgatggtgcctcctctgtgttgtccgccagctcaacctccgccaagtcacttgcctctcgtttatccatgctaggggccaggtaccttctccgtgttagccatcggctcgccctctgctacaaccgcgctagccacccccacgactacaccgactactattgctgccacgccgaccggggctgcaggaat

SEQ ID NO: 48069 - DNA, 1270 bp, Oryza sativa
cgccgaccgcctttgattcccccattgtcgtccttgtcttcagcctcatcaccactattctccccctccttctcggacgacgggtcctcatcaaaatccaccttcaatgatgacccgttctaccaccactcattatctctacccaactcgttgcctggtgatgatggcggtgttaaggagagttgcttcttgtcggtgttcaatggccttctcctcctcttcgacagtggtcatgtactatggttggcgcggcgagcccaacatggccaaagataaagcagaacgcaaagagaggaagagtgcagtgataaaacccacattacctactttttactggaaaatagatggagagtgagaggtgatgaggcgcagtgtggccagaggatgtaaccggagtccggcgcttagacttcagaggagcccgcatgatcaccaaaggaactacaggtagtggaagtagtgacacaatgaagatgaagagataagtcataggcaagcaattaagagctctacctcggagatgcacatttacccagacgggcttaacgccaccgaatgtgaaaatacttcaattttcttagatgttaccttatgtggtccgcctatattgttagacattaatgcgggcaattgcctaagacgagtgcttgtgtaaatcattgtatttatgtaggcggccatcatatcccgccgcctatgataattggtttacacaaacccgtgaccctctctccccttggtagatataatgcatagagagagagatagagagtgagagagagagagagagatctacaatactaagcttcaatcttctcctatatccttacttcaaacttcctctatccttgtgcagcaacaacctttaaatcgctagtctaagtagaatcttttgatgttaattttttttaccaggaaatggttatatgctgctttgaccttatttattctccagaatgctagcaagtctaatagtctccatttgttcttcttaatttaagaatgatgaccaccatacttcttattcaataaccctttgtttgaggagggcatacatccctgaggaggggagtgtggccgagcggtcaaaagcgacatgccgtaaatctggtgaagattttatacgcaggttcaaatcatgcctatcccacttgttgtagacttaagagttaagagaagagaaataggaagaagcccaggagggccaatcaagcgaggttttttctcccttttttttccgtgccatgaagtgtaattttattatatgcgt

SEQ ID NO: 48070 - DNA, 10233 bp, Oryza sativa
tgggggttagttttaacatgtttggtaacaaatatgttcttatgcaaaaaaagaactacgataacaaggaggcagtaaatattggtgtcaaactaaaggaaagatcatttgcctgcaaaaatcttgaagtggtgaatattagatgctctaaagatgatggaagagtccatatgttagcagaactctttggtgctaatgggttacctcttgagaagatttttgttcgccgaacaggcagcacctgtgagtaattctttctgatgtccttatgttcctttttacccatgtatttgcagtctttatgttactcgattacagtcttctagatctaagatattatgttccttacaagctaaaaagaaaatggccttgtttcgatgttgtaattatgcttaaattggtagatacaagcaagaacttaaatctcaaaattttctttgctctaataaatgtgctatgtgtgttgaaaaaagaaataaataaatgtgctatgttattccatctctatatatctgttccttgttgtgacaatctaaaacataagccgttggcttttacatgtttcttgcagaccttcgtaacatgaaaaaaatgagaaaaattgccagggatgagctgcgaaaagctaggtggttccagctgttaaatctataaacactacgtaagcaacaaaattacttgtcttttactttttgttaaaatgctttctgatgactgcaaaacatttttcttaatagattctaaggacctgatggccaacaaagttagacttcaagcacactgattactcgtccaaagttgtgatcgagcttacctcggcccaagaaatgttacaaaataactatgcgattatttaggtaaattttagtttctttcctcgatctgcacatttcttccacttgggcatcaacctttgatgggcatgtgttgtgctgtgtgctgatgcttgaacaaagtttgttttagtcagaagtttctcatgctcctctgggcatgatgaaaccgtgactgccaattgtaagcagctagcttcaggcagtgctacagaatggttggttttacttgtgtgtcatgcttgagcttgcattgtttgcgtaacatccctagattggtttcacctgaaatgagcttcatcatgtactgtatggcatctgctgatgagcaggtccgaaacacggatgttacagtgttagttggtaggctattattaaagttttctttgtttctagtttcactctgtcaacaagtatagattggaaaagtctgttcttctttgctctgattgtttttcttgtgtatatttgttaatgaaactgggcagtatattatagctgaggggagggggaaagagattaggtttataactgaggttattattattagattgtttgtacggagtgcctaactagggagttctttatgcaactttcagtttttacttataccaaatggataatgttcgagatagcgatttcatcaattaattgagctcgtcatcttttccaactaaaaattataggaacggtaagcaatcacaatattcattcaatctccctgatgaacattcttaaatatatctaaatagtagcacaatataaacttcagctctcaatcaagctagcctatcccgaagaaagctttctgagaacattgctgaagagatggccctcttgaatgttgatagcacatactccgctaattcatcacctcctgttcttcttgatcacaaccacttagtttttttttcccaatatcctgtttctatcaagttctctttctaaataaatagatgtggggaccttttattatgtattcccctgaactatgcagaaccatcaaattatatagcatttacaatgaatgaagtgtcaagctggtgatcatagccatggagtaaatattagatggctcttgctaagattgtgttgggagtttggccaccagagctgaacaaagatcacaaagctagttcatgcactatcggtccaccaccaagcatctgctgcaacagaatcacatgtcctactttgttatctccagttgaacggtaaaagaaaacctgctctattttggccagcctaaattgaacatgaattcccattgcctgtcattcctactgatttttttttactgcctagttagatcatggttccttacactgtctttcatttgcttccatgatcctgcattctatatatcatgggtgagcgatggccgatgggtacgtgcaatgtatggtatgtcgtcaaaaatgtgaagtagcacaccaaccatctgaaagggtttggaggtagagtaaagtcacttgtaaaatgtaattcaatacttactataacaacattgtatttatagccataaataaccagatggttcatgatatttctgacagatccaagtaaaggtagttcagagtgatttctggacaaactaagagaaactagttagtggttggtggtaaaatccagactctaaacagaaaattgtgatacaaacttccagttatttttcttcctttcttcactttgttgttccaatcctaataagagataattgcaaaatttatttttttttgttggtagcagttgcctaaccaccagctaagcaggagcacaccacacacttgtacatccaaatatgtgatctaagtcaatgatgaatactcctggttaactgtttcagctctatttcgtcatcttcgcatatagtcatatactcctgtgtcatgagtctgtcatgtttgatttaatcttgcacaaattatatggttacacctgaatcacgattctttgcggtgtatgcacccaactataattgtttgaatccccgcaaaaacaaaaagccacaattgtttgaagacattaatctttcaaataaaattccagcttcagatgagcatcatgcatgttggattgttgggtgcaccttttttgcatcctggaaagagtgaataccggatagtaagaaaacaaaatagaaagtgaaattaatatatgaacctaattaccttgcgtttaatcaagttttcacattgcgggctactggatttttcacaatttggtcattttgaaaaacttattttgcaaatagacctctgaaaaaacttatccgagaaatggtcctttttggggcgccagagtagctggcgtcgtcccgtggcggccagatactgacgtggtaagaggagcgcgccagagagggtggtgcccccctccccctggtcccgagttctccctcccctctcctcaaattcactcgagattatatcggtaagagacttcatgttcttcgttgttttttttcctatattgttttttttcctatagtccaaaaaaaccaaaaaaaaatagtacattgctttttttttttacatcctataaaaaaataagggtttgttgagtttttttcttttacattcgagtgtccttaaaacaggtataactttctcatacggactcggaatcaggcaaattatatatccacggatatgtacagaaaaagttacatccgatccccccccccccccccccccgcttcgtcgggttcggagaaattagaacctctaaattccgcttgcaagattgtacctctaaattccgcttgcaagattgtattttcaagagctttggaaaattttacaggtcacatatttcatccatttgagtttaacttttctatggttggtccttatgggctcctaagtatgaaaaaatatcaaaaaaaaaataaaaatataaaaaaggttgtacatctctcctctacactagagaggagaggaaaaaaaatggcttctgattttgggagaagctggagcagctagaagcttccctaaaccagcccatagtctaggcccaaagccccatccaccccaaggaggtaaacacatcttagaataatggaataagttcatccgaggtccctgaacttgtcaacgaatccgattttcatccttgaaccccaaaaccagatacaataggtccctcaactatcaaaaccagtgtagataaggtcccttagcggtttatatggcggttttggctgacgtggcgcctacgtggctattttgactcagtctttatcagacgtggcgcttacgtggcaattcgatctagaaaaataataaatccgtgggacccacgtgtcagttacaaaaaaataattaaaaaatggtgaggcccacgtgggccccatgtcatcctcaccctacccttcttcctcccctctctctcttcatctctctcccctctcctctctctccaggcgccatgggacgggaaggtttggcggccggcggcacagcggcggcggcggcggcggcgcaagagaaggggagggcgcaagagaaggggcggccggccgggttcctcaagggcggcgacgacctggacgacgacgacaacgactgcggcagcaaggaggcggcggcgggagcgctgggtgaaggggtcgctcgtccatcccctcgggcgagggcgcggggagacgccgcgggattagggttctgtggtgttgtttttggttttttgctttcggattggatttcggggcggcgggggctcctccggccagccttccctcgcatctaaccgcaggtaacgattgattgattgatggattggatgtcccccatgatttgatctggggacaagcggcctccgccggtgcatgtcctcgtccccgcaccacggcctcagcaccatggtgatttatcgacctgttctcttatgttggattacaaattagaacaatgtgaaaaaagcgtcttttgatgtattggttttggtgattgcatgcatttcttgaatgagcagatccgtccgccgctgccgccgtcaccgccgcgtcgccagccgccgtcgccggccgccgaacttccccgtcccgtggcgcctggagagagaggagaagggatgaagaagggtagggagaggatgacatgtggggcccacgtgggcccaccattttctaattattattttgtgtaactgacatgtgggtcccacgggttttattatttttcttggatgaattgccacgtaagcgccacgtcagtgccacatccgatgaagaccgagtaaaaatagccacgtaggcgccacgtcagttaaaaccgccatctaaaccgccgagggaccttatgtgcaccggttttaatagttgagagacccattatatctggttttggggttaaaggatgaaaattggattcgttgacaagttcagggacctcggatgaacttattcctagaataatatatctatatggagaacattggataagatataatgataatctcccatgactaatcatgatcctcatcaacatgcaaagacgaagaagagaatttacctaaaaggacatttccatgataattttacggtagaaagggttatagacaaattatgaatctttgatgaccaactgtgatcttcaaaatctttgtcaaatagagctgattgacggatttttacctaattacaagggacggtctattacccatctataagataagacccccaaaatcatacaaatactggaccgttgaatcactttgagattcgtgcgccaccccatcttcctccgttccctttccttgtctagtccaatgcatgtcccccgcgctgccccccagccacatcagggaggtccactagacatcccccttccccctccccacctctccttctcctcaagctagcagcggtgaggtgctcctgcccccacggtcttgcccccctctccggtagctcctcgccatcagatccgccagcatcggccattgcatcctatcctctcactttgctttgccccgttgtcgaccatgcggctccaacgctgccgccttgccacccattcattcctccgcccaccagaagtgaataaagatccatcacaaagctagtaagttgaaggactaccactctaggaaaaacatccgcaccgatgcaattatttggatctccggtaaaaaaaataacatttctaccttgctgggctacgttaggtgtttggtatcgtcaaaataaactagcctggtgagctagaaaatcgtcgtccagggaggagagatgaattggctcgccttcaatggaaagatcgctgcgcgcgtgaagccatgaactgggtggacatgagttcatgaaaaaacaggattgtgtgccaaactaaaatattgcctcgccaaagtaaattagccaaacagctagcgtgctaaagaaagcatggcaatgcccctgtgggctgggctagttgggctagcttagcaccttagcaactagcctagctcaggagaggaaccaaatgaggtggtgtttggatgcagggacttaactttagtccctgtatttagacactaatttagagtattaaatatagactacttacaaaactaattacataaatgaaagctaattcgcgtgataatttttttaagcctaattaatctataattagagaatgtttactgtagcatcacataggctaatcatggattaattagactcaatagattcgtctcgtgaattagtccaagattatagatgggttttattaatagtctacgtttaatatttataattaattttcaaacatccgatgtgatagggacttaaaagttttagtcccatctaaacagggtctgaatctgtcatatcgtgctattgctagctgaatgatgaaagaaagcctgctatattttggccggtctaaactgaacatgaattcccattgcccgtcattcctactgatcgacctttttactgtctagtgagagcacccttgcttccattgtctttcatttgcttccatcttcttggcttacaagtatgatgccatgatcctgccgatctatttatcatgggtgagcgctcaacacgtgcaattgtatgtaaaagtagcataccgcaaccatctggaagctatggagttagagtcaagtcattctagcatttctcacatttatattgatgttaatgaatctggataaatatttgtctagattcattaacatcaatataaatgtaggaaataaatgacttacattgtgaaacggaggaagtaattcagtattgactatacaacaacactgtttttatagccataaataaccagccttgtgatgtttcaacacatccaagtagcatgtaggtgctgaaagaaatttctacggacaaagtaagagaagctagtgaggttgggggtaaaatccatagacactcttagacagaaaattgtcatacaaacttccatttatttttcatcctttctttcttcacttcattgttccagtcctaatcaccgcgatggggatagttgcaacatatcattttttgttagggcctgtttagttggtgaaataaaaatttttaggtgttacatcggacgtttgaccagatgtcggaaggggttttcgggcacgaatgaaaaaactaatttcataactcacttggaaaccgcgagacgaatcttttgagcctaattaagccatcattagcacatgtgggttactttagcacttatggctaatcatggcctaattaggctcaaaagattcgtctcgcgatttacatgcaaactgtgtaattagtttttctttttatatatatttaatgctccatatatgtgtctaaagattcgatatgatgtttttgggaaaaagtttttgggaactaaacaaggccttaggagcaggtgcctaacagcgaataagtagcataattatacatgcaaatatgtgatcaagtaaatggtgagcattcctggttaattaattatttcaagctctattgcatcaactttgcatagtcctattatttagttactcgctaacagaagacaatcagtcggaaaacaatggatgtagatctcagctgaatcaaatgatcctgaacaactgaatgaatctaactaaaaaaaccacccctttctaaatgggcagtttgtctttgtggaatgcggctaagtttttttttagcgattttgtccacaatgttctcctcaaagattgatggttctatgcttgatggttctgtgcaatgctctagctagcatgaaaccgttggccatgaagcttcaagaactagttgatcttcatcctctgaccaaaacatttgagaaaatccagattgttatgcatcatccatatccttccctgatgcctccctttccctgttggctctggtggctcagaacgtctctcatgctcctttgggtacgatgaaaccgtgaatacctttcggaatattatgatattgccgctagactgcatataattacaagcagctttcagttagtgctacagaatgattgatcttgcagttgatatagaggattcatctttccttttcctttcccgttttatcgaccaagtgttgatactcttcttcgattttctttctgtcctcctttggtcgcagcctccttttttttttgtttctagttttggtcttgtctggataactggatccctgtttctatgaagttttctttctcaataaaaagatgcatttacgtagtcctataataaaaaaaatctttgtcaccaactattttatagtgggtatggtgtgtcatgcgctttatgtcaaaaaagaaaaaaaaagcaaaggagtgccatgcgatcatagccataaatggctttggctgagattgcatctgaagctttcccaccatatcgagaagaacaaggatacattactgtaaaatcaaagtgcgtttgattcttattctgtgatgaacaattggcatatgagattattggttttgatatttggagattattggcgaagtgtttttagagatgattggatttgtaggtgatgaacaggaactgctgttttgtcgggtccggttagactgggcaggtgttgccggttagaccggtgtgtatcgtgcggtcagactggccagcccgcggtctgaccagacgacattgtgttggtttcgggttgtttcggccgacacttctagatggatatactatgcgtatgtaatactgttgtttgctaacaatgagtcaaattggagatagcttgatctcggaatatggtttctttgtttgattcatgtgtaggtgtcttgatgcctcgggagagtattgctgatgatggatcgagagtcaacttggagataaggtggcgttcggacggtcagatatcatgcgggatacttaggctaaagatcaatgcacgtggttggtgaagattccatatggcatacgatggagatattgtgtgtgtatgggatgcggagtcgaatttggagggagtccaaatttagtacaattggagtttgtaaagttggtttcttatacgggaaggtttactaggtgtattaggacttcttgtatgagtttggttcgtggctttaggctgcatacctcatgtatagatagagagggagggtgaggcctcccggtatcgtttaagagagcattgagttgagagaatagtaagagtttcgagtttagtcgagattttcatgaggagtgctgttgttgcactttgtaaacacaaaaagaaataaaaagttgtcatctactttgagagtttttcgatcatgtttgttcgggttcggcggtctaaccggtgagacaccaacgatcagatcggcagcaacgcagcggtcagactggcgggacaatggcggtcagaccggcgacggcttcaggtgactacagcttcttcgggcagttagaccggatgatctactccggttagaccgacgacttccaggcggtcggaccggccgatcatcttcggttagaccgtagatcatcgatttgagggtaacttttaattccgctaaaagttttggtttttggatactacaaccattcaccctccccctaccctctggttgcgttggcttatttgttattgttcgaccctacaagcacaaagctagctcttcagcttcatcggaaagcatctggtgtaatgcgattgaaccgtagtgttgtcttgggtgctatttcatgttctctgcaggagaacgatgagggaaaccttgctctattttgtgctatctatcttgaacttgaattcccattgcctgtcattcctactgatcttttactgtcttgatgagggtataaataaaaacttgccattctctatcatgtctttcgttcgcttccattgtccggccttacaagatagatgctatgaccctgtctcctttttatcatggttgcagacattgcaggtgatgcatacttgcaatgtatggcatgtaaa

SEQ ID NO: 48071 - DNA, 2554 bp, Oryza sativa
catatgccatctataattgtttgaagatactaatcttttaactaaagttcttaggttgagaagagaatcatgcatgttaggtgttcctttttcgcctcccggaaagagtgaaaaattcctgctaagatgtcaccatagagcttaaatacatgaattcttattcctcccttcctcctgtacgtgcccaacccttgtcatttcgtgtatggcatcgtttcaaggtcttcattgtcatcgatgatggggatgttgggcctggtgtcaactgcaccaaggatgcccccaccgcatcgccttcgatgtccgctgtggttatatgaaatgggtgagatgcttcaatcactattcgatgatatattctacttaaattttacgttagttgccgatggtaatgtgtgcaagatctgatcggcacaatggtcggccgctcacatagaagatttgtttgccaggtttgaggagagcgactatgtacaactcataggccacagctcaagaacaatggttatgccgattttcaccaatcatgtattgatggtgttattgctgtctttaagctagtgttcaattagttttcttgctatccatgaagctatgatttgtaattcatggttgttcggcctgcacactttgtagtaatcggctttaacttctttgaagaaaagactatgatgatttccataatctaaaaaagacttcaatttggcacctattgaaaattttaacaagatttattactacctccgttccaaaatataacaacttttagctatgaatctgaacacacaattgtctagattcgtagctagaaatagttatattttggatggagggagtacctaccatatcctacccatgtacattggatacacataagctaggagtagtaacatatgtatcctcctacttgtgatttacttatgtgttagaaaaggctgttctctggcccaatttggaacaaataattagtcggaatattctagtaaattatttacatgattattgatataaattactccctacgatacatcccaagctatgaatctggttgaaatgattatattttgggacatatgtagtaagatattttcataaataaacttaaaaaataatttggaacaaaggaactaagcaatgcggtagaactcaccaattttttttggaaaaacatatttttagagttgtagagcagataatccacaacaacaacataataaagtagctgaaaagaacatggccttagcttgtttctagataatgggtaatgaacataaccgattagcatgaaaacaatactagaaaatgaacgcgccaataacaaaattttatacagtgaatcatgttaaatgctgttattttagacatatgctgtgggttctttagaaattagtttaattattttagacatatgttaagtgtcaagcatgagccgaaaacctccaatgttctgttataaaaatctagcagtgtcatagttaactcttatcgctaaaagaaataacttatgagttatatttttatatatgattctatgatgctgccttctatttatcatgggtgagcgatgccatataaccgaggcttctcgcaccattacccatggggcaggaccgcaggagcttttcgagaagcctcggctttatttcggactgtttttttttttcaaatagtttttttttcttctctgcattttttttctcgtagatatttcagttttatcttcaaagattaaggtgatacgtgaaccaataggctggtcaggaatcagccagcccgagaataattgatatgcggagagaaagcgaaatagatagtttagattaaccgaatgaatctaacaagtagatcatcaaagaccactcattcctagatgatagttctgagctcgatgagaaagcttcgggattcgggaatgatcatatcaaggctgctgcaaggaaagttgaagaactggcatgtattcatcctctaaccataaagtttgaggaaatccaaattcctcaatgttttcatctgtcctaattctcgatgcctccctttccgattggaactaatacctagattcattgtagaactcctagttctcaatcctcctggataatttctcaatgaattccgaagaaatggttagtttgttggtctaaaacatggacacatagtctaagaagttataatctaggaaggtgcattcctatttgctatgagtagtgcttgctgtatttagctagcctagaaggactttatatattactccatccgtttcaaaatatttgacaccgttgactttttagtacgtgtttgaccattcatcttattcaaaaaaatttaagtaattatttattcttttcatatcatttgattcattattaaatatattttcatgtacacatatagttttacatatttcacaaatttttttaataagacgaacggtcaaacatgctaaaaagttaacggtgttaaacattttgaaacggagggggtacaattactaagggaaatgaatcataaaacaaaacaattttaccctatccttgatagtaaaaaggacttg

SEQ ID NO: 48072 - DNA, 1673 bp, Oryza sativa
gagcataattatataattatatgattatcaatttagaatctttacttttttatatagtgatcaaagtggaataaagcagagaaacttagacttcttcaccaaaatatctataatacttaaaatgttagtatttttgtattcattcccacaccacctctgtcactaacagccggatctcacaatatatactaggggcatttgcaaatttgccaccggttttttcaatattgcaaggatgccactcgaatgacagttctaatggcatttttgcaattttctagtggcagttttgcaataacgattcaaagtagtggtaaatttgcaattgcccctatatactattatatcacctttcaataagtcataccctattgcactattggctcccctaaatttcaaaatcacctaactgtgttcaataagaaaaatcatttttcatagtactacttatactaacacagaaaatcatagtattacttatgcttaataagcgcttattatttgatttaataaactagtccctccgtttcgtattataagtcgtttgacttttttcctattcaaacttttgtaagttcaaccaaatttatgaaaaaaaaatataataatatttttagcaaaaaaatatatattatcatttaatgttagatttaatgaaactaatttcatattttagatgttgttaaattttttcaacaaacatgaccaaacttagccaaatttaactaaaaaagatcaaacgacttagggggtgtttagatctaggggtatcaagttttggcgtgtcatatcaggtattatatatggtgtcgcatggggtgttcgggcactaataaaaaaactaattacagtaactgtcagtaaaccacgacacaaatttattaagcctaattaatccgtcattagcacatgtttactgtagcaccgcattgtcaaatcatgaagcaatcaggcttaaaagattcgtctcgcaaagtagtcgtaatctatgcaattagtttttttagcctatatataatatttcatatagatgttcaaacgttcgatgcaacggggtgtaaaattttaaggtgtgatctaaacatgcccttataatatggaacatgggagtacaaactaaatttattttccattgcaaaacaccggctctaggctagtacttcctccatcctaaactaaacgcatctataagtttccgtgtccaattttgatcgtccgtcttatatgaatttttttaataattaatattttattattattagattataaatatgaataatactttatgcgtgatttatgttctataattttttttttaaaaataaaacagatgattaaagctggacataagattttttttaacacggagggagtccaactcaacctgataaactccccgcggcctatacgcatcgtccccttcttcttccctcacccccttttcccaccaaaaaccctagcctccccctcctcttccagattcatcgccgccgcgccgccccgagcccagagtagccggcgacgatgccgcccaaggcgtccaagaaggacgccgcccccgccgagcgccccatcctcggccgcttctcctcccacctcaagatcgggatcgtacgcgccccttaattccccaccgctatatctctactctcctttgcttcgccgtcgacgcg

SEQ ID NO: 48073 - DNA, 22857 bp, Oryza sativa
aatatttggatcagcaaatgatttgatcattagttattctgtgcagagatgcttttccaactttacagcgaagcatataattaccaataatcccatttttacccttttgatttatcctagttttctcatcagttataaagacttatgaatttctttgtatttattttctctgcaggttgggttaccaaatgttggcaaatccactttctttaacatagtaacaaagctgtctatcccagctgagaacttccctttctgtaccatcgacccaaatgaggcacgggtatatgttccagatgagagatttgattggctttgtcaactttacaagccaaagagtgaggtttgtttctttcctacactataatgtgcaacttcttttcttatgtttcaagacatatcatgtcttctgaatttctttgcaggtgtctgcatatctagaaatcaatgacatagccgggcttgttagaggagcccatgctggggagggtttgggcaatgccttcctatcccatatacgcgctgttgatggaatttttcatgtattgagtatgttcctgttacttatcattttgattggatcttgcatattgagtgtgtagtcatggacttgtgctattgtttcagtgtgaagcaaagtaaacgttgtgattgttctagtgaaagcattggtgctcagattcgaatcaattttctttgcttttttgtttaaccagtaatcacaaggtcatgcacttcatgaatgctgcttatgtttatcaggagcatttgaagacaaagaagttactcatattgatgattcagtggatcctgttagagatttggaaactattggtgaagagctgagactcaaggtttttatagggatgcttgatttgcacgtcagtaaatgctttggttaaaccttcttttaaatcctatcgcactttcttttgcaggacattgagtttgtgcagaacaaaattgatgaccttgagaaatcaatgaagagaagcaatgataagcagctgaaactcgagcatgaattatgtgagaaggtggggcacctgttacagccaacctctgtgttgctaaatttgtctgttagcagccttgcataatttcaaattgttattttcttgagtgagtggaagcttacttttggcttctcttcctaacaggtcaaagcccatcttgaagatggaaaggatgtccgctttggagattggaaaagtgctgacattgagatcttgaataccttccagctacttacagctaagccagttgtctatttggtacgtatttttgtcatctgtatgccagtttatttgagatgttataaagtagttttcatgatgaggtgttcagttgttctttgtgagatttcagttttgttattttcgtgcttctgcatttagagactcagtaataatgtcagtacgttgattcatggctatacatgcttttgaatttatacaatagtgcccatgaatagcgcatattgttttctattagcaagataaacttggaatagtgcaaaacttatcctgtggactttctgttgtgccctgtttgtctgtttcagtcttcctcctattatgtaatgtttattttgaggcatcaagcaatattctgaagcagtgaataatactttcttgttttatgtatgggaactctacctatatatcattttcagagcacacaatcaactataacccaaatagtcactaatcgtgtaattagctgtatacccacctaacctaacatggatattttagttgacctgtcagaaattgaaagggagatgctagtatgttacctttccttgcatatggtaatttttttttaataaaagtagagctatatattgtttaatgactgttttgtttttgcaggtgaacatgagtgagaaggactaccagaggaaaaagaacaagttcctacctaagatacatgcctggtattgttctctagtatatagtaactatttcttgaagggattaaggtgtaatggaaaataaggcaaactgttgttttttattttcagggttcaggaacaggtggtgaaactattattccttttagctgtgcttttgaaaggttgctagcggatatgcccccggatgaagctgctaaatattgtgctgaaaaccagattgcaaggcaagccatgtcacactcatataccattaaatgttctttatgtgtttagcttagttccaaaaaaaccaaaggtaaattgcttgatttggaatcaagcaaatcaagcaatactgtcacactcatatatgagtccttttacttggattttatttcctgagtgacgcaatagtgatgcctattttttggttgggtcactacgtgtctttgaggtgaattccatttggtcatactttctataagatacattatatgactatgattctataaacaccaatagaactatcaaaccagcaagagtctttttagttgcatgttgtttaccatatatgtagcttcttttttatatgattcaaaatttctgatctgtcattagttgcttgtccttaagcattctctattttttgctgcagtgtgatcccaaaaattatcaagactggttttgcagcaatccatcttatatactttttcactgctggccctgacgaggtatattttttctggtcatattatgcttatcttacactattacttgttgattttaatataatccatcttttacttcccatgttgctatatgacagtagcattgccctttaacaattgtgttgtgcaatttgctgcactttgttttaagtaatacgcagtactccctcctacaaaagttatacatattacttttaccaccatgaccaaggagaaattaaactcatcttgcatgtaacaaagataaggagtgtatgcacgcatgcaaccaatgagtattaagatggctcctcgggttttgatcaaacatttaatttacctatccatttaaatcttggatgcatacacactacaaataggaacaacttatttgggaaaactaaaatatgaaataggtctaattcttgtggatggagtactttctttagttcttattttttatgttcttaatagttcaaatgcaagcgatgtgaaaattttagttttatacattcttgtttaaatatatgtttgaaatacattttgctggattagtgacatagatggattttctgttcaggtaaagtgttggcagatcagacgtcaaactaaagcacctcaagctgctggtacaattcacactgattttgagagaggcttcatatgcgctgaggtactcatgcgatatactcaggcttcatatgagtagttagtatatgcatgctaatgtggttagatattattgcaaacaattgatctcatgtcactgttaagtagctggtctaattcactagttatactacctcattttgtacagttatccccaactccgcagtactcaatggacacattgatttagatgttttctgatgcgacttttctagtttgatatagttcttttatttgtaataattattctctttgttttatatatttggttgggcttgtctgtccagtagcattgttctttttagctttatgcacatttgaaacttatgtgaaatacatttttctgggattaggtaatgaagttcgacgatctaaaagaactgggtagtgaatctgctgtgaaggtatgcaaggcacctaacaaagttgatattgttcaagtgcctcttttcgatatatacttaatgaaaacgcccattattgcgaattgtaggctgctggaaaatacaggcaggaagggaagacctacgtggtacaggacggggatatcatcttctttaaatttaacgtgtctggaggtggaaagaagtgagtcaatgtttgaaggtgatagcgttccgacagagtggtgcattttactttaaacttctacacttagctctgtagcaataaacaagttatgattcgatattttgtaccatgaggctataaaattatccaaggattgtatgatgaggctttaaatcattgaagaaaaagtgtacggttttgcaatacaagcattcttggcatgtttgtcttgcctgggtctacatctgtaatattaatggataactgccgtgcatgtttggacaactcgctgtcatgcagtcaaatgtggttctttccccacggtaaaattagagccttccacgtacagctgatttctgcaattctatttttaagccatgcataaacagacacaaattaacaattaactggaatagcaagtcttaccacgcatacaattaccagagcaagataaccctacgaattactgctcaaatctagcggacctctacttctggtaacggcccgtttatgaaatatgaacacgagcatagcataattaattacccttccagtgggtaattaaatcaacttaattaaattagggcagcatgacactgacgtgcctatcaaatatccaattaatcgggatgctgatgggcttcttctgggccttgaccgccctctcatgggccttctccttcatcctccggatcttctgcggcagctcgcacacgtagtcccgcgcgcgccgcccttcgccggagagccccgccgcgagctcctccacgcgccactcccgcaccaggtgctcgacgatggagcagtagtccgacaccgtgtacgtcccggcctgctcggcgagggacacgacgcaggcgtagaggtcgtcgcggcggccgtcggagatgggcgaggtcggcatggcgacccctcgccgtagcatgcgcgccaccgcgcgcacgccggcgtccgggtcggcctcgaggagcctggagacgatgcgggtgtaggcggcctcgtgccgcttctcgtcggcggcgacggtgccgcagacgcgggcgagggcggcgtcgccgtgccctcgcgcgccgaccagccgcgccgtgttgccgtgggcgaccgccgtggcgcgctcctggaacgccgtgtagacgaaggcgtggtacgggctgcacggcgggtcgacggccatgccggagcggatgaggcggtgcacggcgcgctccacctcggccatgtcgaagcggccggagaggtacatgtaccggttgagcacgtcgccgtggcggttctcctcggcggaccacccgcggatccaccgcgcccacgccgtggcgtcggcgccggtgaggtcgccgacggcgcggacgcggttcagcgagctctggtacgtgggcagcgcctcctccgtcaccatgttcgccacgaggcacaccaggagcaggtccggcacgccggcggcgcgctcccgcagctcggcgcacgccgcgtggaacccctcgccgccgagcaccgccgggtccgggagcaggtccgacggctgccacgccgcctccaccggcttcagcagcggcagcacgtgctcctccacccacggctccatctgcgtcagcacctctagcttctccggcgacaggtagctcctcatctcctcgtcttcctcccgccgcacggcggcggcgacgtcggccgccgccgacatgatcgcgctgccactgacagcactacccctgcacatcctgcatgcatgagcacgacaacttgcaagttgcaactggtaatttatttctttctcaaccagctgaaaataaatttatgctttgatcaaatcgatgaaatttttggtaagtttgcaaacaatatgtcaagtaagggagtgcacatttgttcttcgatgcagagatcgagttttaatatattttctaaagggttatactttcttcatcatttttaatgtgacgttggttagttaaaaatgaactaatgaacgttatttatatataacattggaagtatgtctagtaaaaaaaaaaacaaaaacataccagcggctgctactgatcatggtgactcgtctaccaaatagtgttcttgatggtgaagaagagttggtgtttggtttgcaacgaagcctattagctaaaggcatcgccattgttgctgttgcagccatgctggaggagaagaagaagaagatgatgatcgtctatggatcgagttgaactattgtgtcttgagttgtgataggtttagtttcagctggtcgaagcctggtgctgcgttgttatatagagagcgagctaggagtatatttgttgcaattatatgacttcttccactttccttggcaccttagttggccacgtgccttcgtgtcagatcgagctcaattatgcgcattgcattaaaaacaaatgtaccactcccaaatttcaaattttaaaacttattttgacttgattttggagtttttttatattattgtaaataaattgctaagaacaaagttttatataaaaatagttttccaggtatttttttaataagccatcggctttagtttagatagattagtgatgaatgagacggagagagattttaatcacccagaggacgttcattgttacttgtttagggcatcttcaatgtataagtctcattggatcataagctgggcctaaattagctatatggtaattgttacaatgtatatggcaaaaaaaaaagaaagatattaagttgggttgcacacaattttaaaaaaaatcttactatatcataactagtactactgcttttttctggtgagagagtctgagggaagagagtcaaatacaaacggtttgttttttcccgatggcgcccaaacctcaagcttaatgtcacttgcgatatttctcataatgtatatggttgatttttggactaaagtccaccttatgtcctacatcatgtcgactaaacggttatgatatttttaaaagaattgataatatagattaatatgtaatatatatcattgtacaaacattaaacatgtaagtttaaatattcaattccaataaatggtaacaaaaataaaaaaaaactaaactaattaatcacctccctctttcagtctttcgtcctcttgcttcatagaggaagttcaataaaagttatcaaacaccttaaattcggttagtcccgatactactaaatcaacctattacggatatataagttaaattaataatgttgcagtgccacccactacagaaacacgcaaaacaaaaaagaacagcaaaatagatatcagaacaactaagaccggcatctatagttctttttccgcctaaggtgcacctccgcgaggtgcccaaggcaagaaccgacacatttgtgaaacataagtgccggttctaactaaaaccaataccagtagtattagtgctggtttttctataaaaaccaatacctatacttatattataggtgacggttttcacctattaaaaaaccgagccaaacccactggctctctctcttcccctttttattaccccttctctaccccttatcttctctcctctatcggtctccctgcatcatcctttctccctctcccatgcgccacggccggccagggatcagtggcgctccacaggtggcgtccccctcgatggcactcggcggccaatggtgtctctccttctctccgcccatcgcctcctttccctctcccccggcctcccaccaacggtgcgcggcctcctcctttccgttgccatatccaacgcctccacgagtttggggatggccagatctacaccctctgttgctccctcttggtcttcaccttgctatggcccgttggccaccgtgagctcggagttggatcctgccatccctactatggcggaggcaccgactactagatccacgtgtcatgatgatgaaggcgaccaccagcagcgtcgtggctccttcccgtgcgtggcaagaggatttttatggctttctttgttgatttcttacttgttgatattggttgtaaaaacgatattggttatcccttttatgctgaaatgggtatctagtgcttgggtagtagatgatcctttgtgataaaatttgtgattcacttagtgattttgatgttgaaaagcaatttatgactgattgagaacaatttgaggcttggacgttgggtttctctgctgctcgatgcattggcttgattcgagctgatgcattgagcctgttttttttattcctcgaaccataaaggtgttggttggaaccggcacctttgaggaggtgccacctgttgagtgccggttaaaatattcagtatctacggccggtttctaatcggcacagaagtgattttgtgtagaagtgccacttgtcttgcacaatataggcggcttccagctcactagacccattggcatatattgctggataacacatggtacgtccacctaggtatacttcttcacgcatgcagggtctagctagggttcaggccattgtttcacccaaagaaattgttgaattttattactatcacacttctatggtaaatttgagacaaaatagctgaacaagatttaatatcgaaaaaaattcacaatttagtttaaatttggagatggtgaaggaaaaaaagaaccaacaacgttctactattgccccgaagtaactcaacctaggaggataggatgtagacaataatattctaaaacaacggatctggacaaactctcgtccatattcgtcgtttcatgataggtcacatcctatcctatttattttggaaatgagggagtatattatcatgatcttggtatcttacataatacatacgttcactatatattgtgctgtaatttaatacacaataaagtttgtatataccctccgtgttttagatatgtttacccttcgtcttattaaaaaaatatatgtaaattttatttattctgttttgacttgttttatcactaacttatattatatactttaagaatgacttatatttttgttatatttgcactaatttttaaacaagacaaatgatcaaactatattcaaaaatcaatatcattatatatttaaaaatagaggtattatatatgtgtctgtatataggtaaaaacaatacaaattgtatataaaaaatagcgagggtaggtcaccagagctatgaggaaagagaggaggcagtctccgagcaccatggctgttgtagtgatgtggttggcccgataccctccttcctcaccaaggtgcattgctgcactgtgcttccctccgtccatggacctcgtctctcttcgccacgatgaaggctgcaatggccacgtcggcctggggatgacgacggtgataaataaaatgggcgaggacgaggtggattgggcaactttgttgtggagatggagcttgaccttgccaatggagtgatcgagctcaagctcttcgtgctacttatggcctcctccttgtcgccgctgcaccccgctccccttcttcctcaatgttgtgcctcccccggccccaccttcccctctagattccgcagcagtgaacagatcgatccgatcataggaaacaaggcaagatttgtggcttcaggacggaatggccgccattgccaccatcatgtgaagctattcgctgcttgggcgcgcggatgtcaatgcggcctacgaggtgctcctctttgcctaccctcggtctctagaactagtatggaggcgtgcgatgaagaagatggtggctgacagctgggccccactacaactaattaaaaatactagcttaggggatattcatacggtttgagaagttggggcatgtaaaatatctagcactaaagttttaggagggcaaatcgtacttttgtgataattgagagaggtaaatcaaacttaaccctaattatggagggcggtgcgacgggcatgcaatgctacggctaagttcttatcccagttttcctaactcatctctctcgttttccgtgggtatgctttttaaactgctaaacggtgtgttttttttaaaaaaattctatacgaaagttgttttaaaaaatcatatcaatccatttttttaaaaaatagtaaatatttaattaatcgtgcaataatacatgcttcgtttatagcttatctagccacatactgttactggtactatactgtagtatgcatgaattataatgtatacatccatatatatgaccacgtgaaacgcttcaaccagtgcagcaaccgtgccatatatacgtacgtacaatcatacttacatcaactgtacagtatatagttggattgatgagtcgtgtcatcgaatagagacccacgccaatgcaagtacatgcatgctgcatatggctgcattcaaggagcatatgttcgcacgtgctagctaaagtgaacagagatggcaggagatgacatgacgatatataattcatattaataattagttcaccaataccacgacaaagctaggcagatctcggttcttttctgattgagtaattaaagtgtaaccgtactttaattgttgatttgagcctaaaatgctgatataatttacttatgattgatttcacctagctatgtagcacaatgcagagagcgagatagcttgcttaattattttttaagataattgaagcttttattaaatttagtcaattactgtaggtaattaaaggtgatacaactgcacactcaggctgatctgcataaatttagatgcacacagtcaaagcttgcttaattcatagtataatataatttgctaatttcacaaagaaatgaagttgatgagatcgtatcctccttgcaattaataaattacttcctctggatctcgtttgcttgatgttttgatcatcgcgacgaacttaaatgtacatatgttccataattaaattttttataactttatgtttataaagttattgaaaatatatagttatatgaaatcatttttcataataaatctactaatattattttcctatattaaattataatatttttacatatattattgatttaaatttttgagttctctgacgagcagacaaccaactttccttctctttactgcatgcgttgaatgaactggaacaatctttacatcggtgtccgtcgttggctgggacatccacatatgacacatgtcagaagtgtttcttgtgtaatccattcaattcgatcgatcaatatatatatacgtctgcatggatgcatgtgttgtaggcacgtacagtccgtggatctgatcatgcactggtatcaagcacgttactcggggtgcgtgtttagttcacgttaaaattagaagtttgattgaaattagaatgatgtgatgaaaaaaattagaaatttatgtgtgtaggaaagttttgatgtgatggaaaagttagaaatttgaagaaaaagttgggaactagatcaggcctcggatcagcaatagctagcaagccttgttttgctagtagtagtactgctcctttcgtcccacaaaagactttatttttatatttctgtgaccaacgtttaatcgaccgtgttatttgaaaattttataaaaaaagttaaaaaaatcacacataaatttttatcatgttttatcatctaatataagaaaaatactaatcataaattttataaaataagataaataattaaatgttgtttctaaaatctgaaaaatagagttttgtgaggagggagtatcttttgcagcagtaaatttgataactcgctgaatgaatcatcaatgcatgcgttagttgcatctacggctgtagtactgtgtttactcctaccctacctaacaattcaacagattcaacccattgaatatctaatggatccgaacagttcttcatatgaattttattcacacgtactacatatactgccgcacacattttggtaaagtctgagttaccgacgcacgcattttacatttctatacctaactagaaaaaactcccgtgcattgcaacggctaaaaatatcttttttcattgatacaaccgctattaggaactaagcgataaattgaaatgttaggatcattatatgtacattataattggaaaagttaataaaaaatgttcctgagtttgggccgaaaacccttctttcctttcttttcagtcccaacctagtccgctacctccctctcatttgactctctccgatccagcccacagtggagctacaggtccagctcgcacagccaactgcactgactctctccgatctagccgactgccctgactctctccgacccaagccctcaagtagagctataggcccagctcgcacattcgactgtcgtagtcttgtgccaatatgccgagccgatcctccccatcaaatcctctggccgatttttttttaataaatcggttgagggtttttgatccactcgatctccttcttccgttttcccgaaatcagaacaaaaggctggccggctatcatcagcgactaagactaaatctagtgaattaaagccgaattaaaaggaaaattgtgagaaaaaaatgatgagggaggaatggggaatcaacttttgcaatcacttggaacaaaaaacgcatgagaatacatattgaagtggcgacggcactaaggtttggttaggcggtggcagcaacgtccaatggatctaatgagataaaataattggctaaaaaagggtatggaaaaaacaatgaaaaaaagcacctaaataaatggagaaaagaaaccgggtgaaaaaaagcaaaaaagaaaagaaaagaaaaaacgaatcggaataagaaaagcagtgaaaaaaagaaacggacaaaaatgatataaagataaaaataaaaaccaactcatgactatcaaaatcccggcaaaaacatctttaatttttataatagtagagaataaagttttttcatccctcggtttctggcttcaattcctaattgttgctgattcgcgtgatacaaattaaatccggacacatgacgcgaattatgacgtcccgcaaataaaacggaaaacaaaaaaaaaggaggaagctagctagcagcctagccaatgcagcggtagcccagcagccagctcacagagcaaaggagcagcagcccagtactgcacgacactgtaccaacgtgtcacggtactgtagcacaaataataccgtttattattcgtgcaaaccagggatcgaagaaaagattatgcaattttatagttaaaagaaagtaaaaaacaatgacatcctccttttgctccttgacatcattggcccatcaaaaaactactctcacaaatcgcattgtatttttttacattattggtccatccaaaatctacccccacaagtcactgtattgtaaaaaaagaaacatgtaatcaccaacaaattgaatcatgtttcctacgcaacgcaagacatcaagatttttttactccgcgttcggttctcaatttcttatgcacctatttttttttctttagaatttttacggtacaatatactctagtaatatataatatccggggacatctcctctgcgagtccctcctaccattgtgccgtcctttgtggcgccgtccgtgtggagctgggtggcgcgcggccctatggccttggacggagcaagctcgtttgttgtgggctccctctcttcattccatgtaggcagtaaggatggtgccgcgagcctgtagagctccgcggatagcatcggcgttttcttagagtccaactggatatccacctacgacggcgacaacgcacgccatgcggtggcttggagcacacaagagaggggcctctgcagggtagggaagcgaatttgagagaaggtggaagtgggagtggtttatggcaacaaaggagcaggatgccgagagaagcttgtcaggagccctagcactctccaacagcggtgctagcagtggtcacctcaaggtgctctgagccctggtgctctcccaaattaagagaatttttacggtacaatatactagtaatatatattaacattataaatgagggcacatttggaattcgctaccaaatttaaaggggtatttagtaattcgtgattcctcttcattccaatcgtcaaatcgatcttagatgcctatcgatctggagcggagagacgacccatggcattgaccgaacgacaaacatcggcggcggtgtgtaggcaacgacgggacggtggggaggccaggtacagcgggaggcgcggctgcggtggtgggcgtgttggccaacaggtgggcggcatagcacgtgccacgtactgctgctggcagcaagcagagcgcataaccatgaggctaagaagctcgcagttgaagccatttgcagctacaatctatgtcgttcgatcatttatactactagtatatatacttgtagtatattgtaccataaaagttctccaaattaaaggtgcagttgagttacttgttgttgcgctgcagaagctcatcggtgatgcgtccgcgctgccctgctcagctcggccctatctctgctgtcaccagccgcacgatgcgtcaccactaccgacaacctcggcccaagacactaccaccaccagctcacccttgccgcttaggtgctagtgaggccttctattttttctatgagatttacatgtgagtcccatgttggataaagactagccaagttgtcaagttagctaaaacgctttctaaatcaccgagggggtatagtttgcaccggttttgatagttgtgggagtcgatatacccagttttacgattgaagtgcacgaattagattcgatcaatagttgaggagtcgaagtacattttcctaaattttagggggggccgtgtacagtaggtatacacagacccatgccaacatgttcaattagctaggtggcatgggcttcattacctagatagatttcgtggatagtgtttggtttgtcgtctcgatcgatcctgtcgccgcttgattaattgcgccccataatgctaacacattctacactcatgtcctctgctttgctaaattatcatcgtaccaacgcgctctaatccctataaagtccagtgttattattacgttgtgtcgcagaccagcacagatcgatagagatatcaaagcatggcacaccatacacgccattgcccatcaaagcattcgaccaagcccatcttttcaataattattcttaattgtctcccaattttgttttgaattccaatatctactacaataattattaattgaacactctgtcacataaatttagagctccactccggtactctctacttgtatagtataaattaatctaagccattgaccatttttcatctaaaggacaagattaatttatactgtcacctttattaacggtagtagaaacgtgagaggatttaatcatcaataaaaatatatagaatgagaggtaaaattgtaatttgtatatcagttgaaaacccttggatggttggaccgtgctggcatgagaaaacggcgtgggggcagactttatctagagtttatttcttcgtccgtattttaatatatgacaccattaattttttttaccaacgtttaaccatttatattatttaaaaaattatgtaattattatttattttattgtgtcttgatttatcatcaaatatttttaagcatgacattttttaagcatgacattgatatttttagggaattgctagacggcagcctactaaaatttttttttgttgtcagctgaattttggtccgttcgatttctgcccaagatgcatgcaaccaacccatctctttcacgtgtccaacgccgcacattttggcccgacccatctgtctctctgtgggctgttccccgtggcccacgcagcacagtatacctagcccaacccacaacatgtgtcattccgacagctacacacgcgccccgtgcactgtttcaaaaaggaaaaagtacacccaaggtccctcaacttgtcatcgagatacaaaatcgtccctaaatcgcaaaaccagataccagacgtccctcaactaacaaaaccgttcactttaggtcccttggtggttttgaccccggttttgtctgacatggcggctgagtcagcgtaggacccacgtgggcctcccatgtcagactatccacgtcagcctcccctcttccccctcctctcccttcctcctctcttcctctctcctacactgctacacacacccagatgagtcgttcggctccgtcgacggcggcggcggtagcgcgtccgcgcgacggcggcggcggccgtagctcgtctgcccaggagcggctccgtcggctgcggcggcggctgtagtgcgtccgtgcgtctccgtcgttgccgccaccgccgccatcggcgacaacctcctggaactggcaccgtcgcgggcaccatagaaggagcggcgggagcggatggggacggcagaggcgacgcgggagaaggtgtcccgacgaaaaatcccaccacgaagctcgccggcctccctcggtggcaacgacacggcggcgaccacgcgggaggaggtcatcgggccgaggcgcgaggaggagggcggagcgacggcggcagttgcgcccgccgcactggcctgccggatgtcccactccccctactgagtcccagctccgccgcctcatcacggacgccgacctctccgcctcctcccaccatccacaaaatctcatttaatgaacgtgaatcatcttttcagttggtagattgcatattttcctcaaaaagtatcatttagaatacaatatcaaactcaagacatcaagaaagtaattaccagccagctctgttagcctttcagcatacatttgggtagaagcctctgtagcaagcatctcctcgcagatttctaccactttatcccactctgtgatgaatgccccaaaaccttcgctcacagacgccaagcagaaacaaacgtcaatcgagcggatgcaagaacctatcccgatccactcaatcgaagcaagaactcccatgaagctggatattttgtttggggggggacaccttgacgccgtggaggagggcggcgttgacccagcacggcagcgggagcgtgacagaggtagtgcgagaagtagacgaagacgtcgatgaggtgccagtgccagagcgcgtaggcgcccgggtcgtcgcccccctgcggcgccgcgtcgtcacggtacccgccccggaagtcgtggcacgcgaggatgtggcgccggggcgggagcggcgcggcccggcgcgaggaggcgagggccggcacggaggcgcggttgaaggggaggtggaagttgccgtcctcggagaggtaggcgcgggatgcgagcaccgcgagtgtggtgatggggtaggagatgggcggcgccggcaaggacgcgtcgaagggcggttcccacagccgccgctcgccgccccccggccgcccggcggccgcgcgcgcctaccagccgccctgcagcgagtgaacgaggagaaaagagagagaggaagggagagagagatatgatgtgcaccctgacatgtggggcctacgtgaggtcccacgctgactcagccgccacatagggtaaaaccgggatcaaaaccactgaaggacctattgtgaccggttttgattagttaagggacgccagatatctggttttgtggtttgaggacgtttttctaactcgatgacaagttcagggaccttcggtgtactttttcctttcaaaaaagaatccacatctttttctcctccgttctcatccgctcattcgagaagagaggcagaagcggagttctcggcgctatcaccgcagcttcgccgcgtcagcgctgctccaccgccgcgaaagatccccttggcagccagctctcccaagcttttctcgcgcgtctcagctgctgccgagggggaggggtgaaagcgggacggggcaaccccggcagccagtgaagcggtgaatttctcggggtcggcgacgggagatggctgctctcaagtttgtccgcaaggtagccacttccgtcagcgagcacccgacgaagtacttcgggcgtggcactgattcggctatggtggttctctctctctggtgggtaaggaccgtaaggtgaccaaccatctctccaacgggcgaggggaccaaccatgtgggggatctcgcagatggacctctgatccatgaactcaggttgaactctgttgacggctgttaagtacaaaattctcgccgtcaatatctgcataaaaccataaaagtaaaacatccaacatagtggtaggatttatttctaactatttccacgagtgttggtgtatatttatatgtaaatgcaacccaccaacgttgagatgaaatgtacatgaagaatataacttccatatccaaccctatggagttttgagcccacaaacccaataagatagatttattttggccaatctctagtagaaaatgtagtgggactcacatgttagaacaccagagaaaaggctgggctggatgggccagccagggttcggccgaatcagcagctagcctaatctagcccaacttcggtatggcggttgtaaccctcatcctatgacggttgtggccgttaataccgatggaaactgtcatcaaaagggacacatggcaaagggagaaggaagatgctctttagattccatggagaatatttcttagcatctccacactcccaagcaagctcacactataaataccactctcatctttcattccaacacacataaaagcttaagctgaattataagaggctctattgtactagattagagatagagtagagtagaagaagtcggattagttccggagttgtccgtaatactcttcttatttttttctgctctgttaattactctgattataatataaatatcttttgggtaatttagttttgcttggtgagaattaccttttggttagatcctaatcagcgtgcgggatcatcgttcactataatttagtaaaatatagtgattgctttagtgagttataaatactatagtagttattaattgcttaaacgcggtgtctaggtagttgatttccggtgtttgctccgtatcccacaataggtttgaggtgggtgtaaaggtggtgatagccctcaagatcacttaagtcctccatgtccgggcacgcagtagagcgatatctgggagcagtgggctggctagtgcccgaagtatcatgttaagattaaactaagctttccgtagatactgtttctaaacggtaaatcctctctatcctttgcctatccttagcttcgtgtccttggatgaacctgacgaggagttgagcacacacgttccctgtggattcgataccttggaatactactgggtggagtgctacatcggtatcttccgtgcgcttgcagattttatctgtgacattaagaaataccaacaaacttgtagtaagccatgagggcaaatcgaccaccaaggtgagcgagtataccttttttttcattttttcaaggcttttcatttgttgtaatttgtgttaattttttttaatttgttttcggaaacattcatctgcgagtcagatctgttaatgtggctaactgatctcgatcgccccagtgcaaaatctaagctgtatttgatttgtgcttagtgttgtgcttagcgcaaaatagttgcgcttagtgttgtctgacaaaaaaattaagcatgtggtgtgatattctcaagttgtaagtatttcagtttctgtttatagcatatgtgaagtatttttttctacccttgcacgtgtggaagtttatgctagctctagaaagtatttcagtataattcagtacatggtggcctgtatggtattcatcagtacatgtgaccataatttgttgttatatgcaaatgttttgtagcatgatcatcgtggaactataacttgtcatgctttgtggtgtatcttttggatttttgtagtatacattttgggccaattgcatatttgccactactttgaatcggtattgtgaatttgccattacaaaaaacataattgcatatttaccaccaaaaatgattggaacccagcatacctaccatcaaactcacaacatagactaacaccgttagaagtttggttttcatgaaagtgaggacaaggatgcccctccacaggaaattgcaatcctaccactggagcatacaacctaataaaatcgtgcagcataagaaaacaaacaacagtggaacaaacattgcaacgaagcatgtggaactgctgtaaaaggttttacaggtggagaatcgatcctataagaaaatgaaaatcagggcttcagaatgaaattgtcgttctaatgttattaatatccagaatcttttctaaatgagcaaatgtttattggacatatatactaccaaaatcaaattctagactaacaactcaaatatcaaggaaataccataacaacttcctctgctgctgttgttggtgtagtctgcccctgttgctgcagccgccgccgccccaagctgcttgttgctgttgctaccggtccgccgccgccgcataatgctgttgtcgcccaagcagcttgttgctgccagctgctgcccaagacgcttcttcaaattggactgccgcagctcccgtcgccaagcagcatgctcgccttgatgccataatcatcaaaatccatctccatgagcttttttactatcaccagctacttcatcgcgaccgatttctaactgatttgctcccgattcgaaggacgagagtatttgggatctagggttcctagagagagtgggggattggttcttctcttctcgcgtgtggtcagattgggagacgggcagtcgggcatggaggggattgaatctagccaagggcaaaaccgacttaccattgatttcttgttttcttgaattatttctatgcccttaattcctccaattcagacgggatggcaaacggaagcaagctggactgactttagtggcaattttgcaattcgtgcttttgtaatggctattccgagttagaggatgaaaacagtggtatatttgcaattctcccatacatttttgggatctccgctatacgtcactcatgaaaaacttgtaggcaattcttgctgcggatgtggcccttgagtttggcgtatcagtatcaagggtgcgatattttcttatgtgttggtttaacacacgaggcaagcaagttcgcccccattatgcatgtttatttgtcactggatacatggatatttgccggtagtcagttttgtttgaattctagttgcagctttgtcagtgcaaattgatgtaaactctgatcacaattgttttgaacctgacaagagatgatatttttcattaagatttgtcaggtacaatagggagaaatgcaaggaagaaccatttttacccgctgaagtctcattaaggactgctgatcatacatatccaccatttgagcaggtattactaataatcttctttatgtgagtctttcacccaacctgaaaaccacaacatgtaatatttgtgatttgttgtaatttatcagttttgtctcaagaaatcatgtcatgtaatatttctagaaatgttttgtgtgaagaagttatgtcgtgccagttttgttcacactctctgagtttgttttttatttttgtctttgtcttttgtctgttctttaaatttaatattaatcaagcttctagtacctaactaattaaagtttactggacttaaagttttttgtcagtttgtttttgtatttttgtcttatttgtctttgtgttcgtctttgtcccttttttaaatttaatattaatcaagccaatttcttagttttgtgaaattttcaggtagcaatgtttgattaggcacttcaagtacttaatacatttcagctagcagtattattcaatggctccttggttcaattcatggattcaaagggccttatgagtttcatgctatagttcaatgactccgtggcccagatcatggattcaaagggatgctatggtccctgcatttttttagtcaacaggttagtcttggcactatcaaacttaactgaacactgtacgatggtagatgttcagaaaccaaaactttctcaaaatgcaggagtgtaactctgctttgttagactaaagtgaaacattgaattaataaagatgcaactctgttatgcagttaaatttatatcatctcccacataataatgcagctcttttccattagctagggtgtaacagctaaagctttgagcatctaagagttgtcatgcaagtagtagtagtagagttcaacccataattaggtagataaatgaatttgtagttctgccagatgctacaaatatcagttaatgcacattggtgtttcagaaatgagcatagttttagaaatggtgtgtttttgtatttgttttgtcaattttttttcagttttgtaaattttgttaaaaaatttaaataattcttggctatagccagctgtgggcaatttgctcacaactgctctcccagccccgcgctctccaagccctatgtgcgccactgctgctgcccatagcttatatcgctaccgactacagtctcgctagtgagattcttcccccgctaaaacctaaaatttttttcttgcacttttatctctggatctcttctttcagtctgtagtacatgtacaagggttatgatgatatgcttgtgatgatgatagtgataatataagggttaattgtttgttttattttttttaagtgtcattgaactaattatcgataatcaacttctgttacaaactcctattaagctactgaaaatctgaaactaacatgacctgtagaaagaacaatccaactcatgtgacactttgctctccagacaactaatggaattagatagtttgcaattttcagttgttttcattgagaactgaacatctcagaggggctgcaggaat

SEQ ID NO: 48074 - DNA, 9735 bp, Oryza sativa
ttaggggtgatcataattaccaaacatcgaacctaattgatctgaaccaataccgaacttaagtgaaaaccaagcaaaaaaaaacaatgaaataattcggtttttttttctaaaatttggttttcgaattacatcatcaccagttcactaatgtcttgcatgacctttacattttatctatttaagaaagcatcatatggattcaacactatctgttagtataaaaattattccatattacaatcatattgtgttgttagtatcttttcagtttttttccttgtgcagtcgtacctaactgagacactaacagtatgcaggatctgcgtgggatgaacttaagcatataagccaggctgttggtttcttggtatgtaactccaaacttaaacatgtggggcgttattaattactattatatatgtgaaaaaaataaaactgatgtaatgcatggctgattttgaatgatgtacacatgatctttcatagacaaaactaccttcttacatggggtttcttgttgtattttgtggtgcgctataggtcatcttcaaaaagttcaggatttcatacgacgaaataatcaatgatctgtgcacggtaagaccgcccctccctccaaactctcacatgaaaaaaagaaaagaaaggggatgtaggtgaagatgaaattaaacccattggcattattatatatgcaggcactgagtgttcaacaactttacaaaatatgcacgcagtactgggatgacaaatataatactgaaagtgtatcggaagaggtgagcagtagatgcaactaattaatataatgcatgccggttgagtacttgagttaccctttgcaaaacgattcaagatgaaggaataagacgtgcatgaaggtagtcgttggtgtgttgaaaatattttgacgagcatcgatgcttggttgattgtacataggtcctaaatgagatgaaaacattgatgaatggaaaggatgcttcggatggtaccttgaaatcattgatgaatgaaaaggatgcttcggatggtacctttttattaaatgaggagataaggtacgtactcaaatataacatatagctagagttttactagtactaccttcgttttctaatacaggatgtcattaactttttttaaaacgtttgattatttgtcttattcaaatttttttgcaaatataagaaaatttaagtcatggttaaagaacatttgacaataaatcaagtcacaataaaataaatgaaaattacatgttttttttcaataagacagaatagccaaacatatatttaaaaagtcaacagcgtcatatattaaataacggagggagttctattttgttgtgttttgtccgtgctgaaaatgaaaagtggatcgaaggaggttgaattaattagtttggagattattaacatgcagcatgccgttatcattggaggagataggcgattcaatggatgccaaggaatttcagaatgtggttccacctcaacaactccttgacaaccccgcgttccaattcttgaagagctgatatatactatattacggtccagctagcaatcgctgtaaattagtgtaggtttccaacatgttatttttagtatagcgatctctaggccggttgggttgggttggtggtgtgtaaggtgcacccacattctttataggcatcatatgcagctgacattgtttctttgtgtaagtaaggtatttaattactaggtactgtacacgtagggggatcatagaatagagagagagagagtcatatgtactactaaaactagctgacgagtaatttgtagtttgtacacacagacaaatagtcccgatggatgatatatgatgaatgcatcatgtgaatatatatatacgtacatacatatatactgtaattaattaaagtagtacgagtccgaaggtacggagcatatctgtaagaaattaagaaaaaaaattaatgtggtggagatgaaggaggagggatcctgaagtggtggagcgcggatcggccgtcgaggcctttggctctgtaatgcgagaggaactccggcatggtggtgctcctgtagagcggtggcggcggcgtggtggtgacgggggcgtacaccctggtgcaggcgtagtcgggacggaagaagcaggcgacggagaggcgaggctccgcggcggcggtggttgccaacacccggtgctccacgcttcggaagaggtcgttggacactagctggaggaggtcgccgatgttgaccaccagagcgccggccaccggagggacgtccacccaccgctggcgctgcctcatgagcacctgcaggcccttgctctcctgcagcagcactgtcaggaagctggggtcggagtggcgtgtggtgcccagcgtcaggtgcggctccgggcatggcgggtagtagtgcgctgccatggtagccagccccccaccgaggccgccgaggtactccggcgggagccccagcgcctccgacagcagctccaacagcgccccgcccagcctctgcaccgcctccacgtactcccccaccacgcccctgcacgccggtgggatctcctccgctgccggccccggccgtggcgtcagctccagcaacagcgtgtcacgccagttggcggccggcgactggaacaggtcgaaattggagttgaacttcaccctccgcccgctgtccctgctgtaccaggctttcttgccctccgccggctgctcgttgaaccgccgcaccgccgccagcatctcctccaggagctcgccggggatgccgtggttcaccacctggaagaaccccacacactgggcggccgccctcacctgaccaaccagatggcctcggtcaacgtccgcctgcagatcgatcaccgggataacatccgcatcctcctccgcatcgtccagtagcagcgggtggtggtggaagatggcggggatggttgtgacgccggcatcgacgaggcccttcacgccggcctttgtgtcgtcgaaggcctggaggtcgcgtagccggtcggagccggagctgctgcccatcgatcgatgacctgatctatccattccagagaggcagggacacactaatccaatccaatccaatcgattcgatgcgataccgattatacagtttactacttgtagttgtagaaaggaagggagggactgccggctatgccagaaatgggccgggtttcgtccaaatgttgtttcctattaggaataagtttaacttatgtccctcaattatcgccaagacttatactcgtccctaaaccgcaatatcagatatggcgtgtccctcaactcctaaaaccgtgcaaataaggtccaagaaggtttggagtgtgatttcgactaatgtggtacctacacggtattaacatggcacttaaagttagaaaaaaccatatatatgacccacatatcagctactgttcagttaaaaactagaaaaattatagtgagacccatgtctcctccccaagctcccagtctcctccgttcgtcagcaattgcatctccgacggcagcgaaggagtcttcctcccttacccacaatgcgagcttgtggtggtgatggattcctagccgcaacccccctccccctggctctctggcgttgccatgacgacggtgtagccgagaatgcttgacacccggtagcagttcgatcatgacaagacgtcggccgacatgatgtcatggctcaagatgttcttgccatagcatagcaggaggccgtactagtaccggaggaggatccagcgacttggaggcgggacccatgcaacaacggaggagacggggacagggagattgggttggaagaggagacctgggtctcgctgatttatttttttaattttaaccatacagttgtcgacgtttggtgtcgcaattcaggtatttgcatagtatggggatcgtcgatgctaggatatacgcgagactgaggtaaaagagacggagacagagatttttatataggttcgggcccctgagttgtcaagtaataaccctacatcctgttggccgaagccggtattgctcttattcaccataatcacaccagtacaatatgtgggtagcctatctaactgttgtcgacatgtcggtctgaaggtctgtaacgctccgctttttgtgaggcgttaaaaactaattcggcaaaatcctaatttcaaaaattccgttccttgtgtgcgaatctaagtcgtgccgtggatctcagtttaaatctatcgttgttccctctcgtcgccatcaaaatcctccacctctaaaatgtcaaccccaattcatcttccaaagtcaaacatcgaaattcaatcgcatccttcgaattcccgccaaatacctgtccccatttccgaaaatatcaaattcccatctcgaatcctttccttgattcctccctaaaccctcgactttgaatatcgaatttgaatccaaatccaaacttcaaatctcaataaaccagcctcctctgtgaaagtctaaatcgcctccctcaagttttgtgggccgattttgtccccctcggcccatctctctctcagccgtcccctccctcctccgcacgtgcgccgcacgcgcgtgtgctgagccgacgccgagctgagttctctctctctcgttctctcgatctctctccccgtttcactccctcccggcgacgatctcccgcccgcgagtttgaaatcggcgccgttgcttcacgcgcgcgcgcccgcgcggtcaccgccgtggtcagccgcctgcgccacgctgccgctcggccccgctgcctgccgcgagctctgcagcgcgtgcccaagccgctccacccacgtccgtccaaaactgagaagcagagccctctctctcccgcttctctccctcccgaaatcggcatggagcaaagccccctttccaccaccctatctccctttttccctcttcggttcgacctctctctctcccgcccctgttcgcttgcgcttggaggcagagacgctgacaccggtgcgccagttcgccgcccccaccttgactgcgccgagctgcccctcccccgctcgcgaatcaatttccaccgcccgatccaccgccttcgccgctctttgcatcctcgtcgtccgccgctcttgcgtcgcccgtgaccgccgccgagcgctcaaccgccaagtcggtttccacctccccaaaccgacctcgccttcgctataaaaacccgagcccctcccatcgaatccttctctcgtttcacttccatcaccgccgcgccattgttgttgctcgccccgctctcgccctcgccgtccgccaccgagcaccggaggagccagtgcgtgcgtggacgcgtgacgaggagctccaggctgcccattgccacctctccctcccttcttccccggccgtgcaccctcggtgccgcgccgccccgccgtcgcgtccacctcgccgcgactccatccgcgccgccaacgccgtttatctcgttggtgagctccccaccgaaccacttccccttgtcgcacgccgcgccatgcccgccgccgttcgccacagctcgccctcgcacctccttggctcgcgtggtagctcggctagcctctcgaatgcgcgtagacgccgtcccaggtctcgccgccgcctggcatggcctcgccgccattgtcgcccgctcccggagaccgccgtcgacgctggccctcctcggtgctcctccaccctatccggagccggaaacgggatccccgactcccagagatactcccaccaccttgaattgaatccttgtcgcccctccgccgtttccctcttttttctcaccgccagcgcgcgccgccgcaatccgccgctgtcggcctttctctcgccgattccttgcgccgcgaccctccccgtgtccccttgaaccttcccaggctgccgccccagtcgccggcctccccacccactcccgcgccatgtcgccccttcagccgccgcatagcgccgccgcgagtttgaatgcggtgaccatcgggtcccgcgtcactgcgtgcgcgtcgcaacaccataccggttcggctaagcccgagcccgcgcgcccttcgctcttctcgcgcgcggccacgtcggcgtgccggcgagattggccgccgccgccggccgtcgtcgcgcgacgtcttcccgatccgagccgtggaatgagttccccttctcctcctcctgccgccggtgcctgccgcccactccggttcaccgccgttcgtcggcgcctctcggccgccgtgagccgtccgatccgggcgagctcggcctccctctctcgcgcttgcgtggcagccacctcagccgtcggccccacttgacctggtcaagccggcgcccagtcagccgccccactcctcctccctctctctctctctctctccgcgcgcctcttgggctgcctccttgtgcccgcgccggcccaatggctcggccgagcctccttcaaccctttgggccgcaccaatgccacccgaaacaagtctaatatacatccctccttgattttcctttccaaaaaggatttaatacatcctttttcctttgttccataaatcaattccttattccaaaattccatgtcccgcttgtcagttgtcacgccccgaactagtcctgaccggaactagcccgtgacgctccaaattaacctattaatcgataccagtcccaggaaacagtgctggtatcacagggagacagaatatcacagcaacagaggtctctttattatagagtagagatacagtcatgttgggctgcggacagatcccgagctcacaactgcattacaaaagggaaacggaagccaggacttggaccaaacaacacaggcgcggcttgggaactaggccgaaaccctaaaactcatcgtagccagcttgctcctggaagaactcctcatcagcaggatccgcttcatcttctttagcaactgggggagattatttatatagagcaagggtgagtacgggggtactcagcaagccatgggaaataagtgtttaatgcatgcttcaaggaaaggctgttgtttttgcaattgattttatttgaactcctttctgaaaacaactaagtgagtgcttctcaaacgacacggatgagacagtgcgtctcgtccggtcggagtatgtgcaatgtatcagtctttagaattgaatcaaggttggcacccggccaacagcttttcaaacagccacccgggccaacaactttcaaatggccacccgggcctagctgatcccatcagctgcagatctttcaaacatcgaacccctttccacaacagcaatttcacaagcagtagtcaaacaaaactacgctaggaatcacctcacatccgcccatgaccgtgggcatggctgttcgaacagtttgttaacctctgcagagggggtacactttacccacacgacattactaacccggatcacccagcccgtggggatcagccacgtcgggagacctccaagctttcatgacaaggcattttcaaagccgacacaggtttaccatatgccgacgagaggggtcccagaccaacaacaggttaggtcccaaaccatactgtgccaggaagcccaggggtcctccccgacaccaccccggcggatccacatgtctctcggcatcaaggctcccctgataagctagttactcagctaggggtgtcccattccacccatgtggtcgtacttgtcttatgtttggatgaaattccaaggaaacggtccttaagtgcaagagcgggaaaccgtacacccggtacattccccggtccgcggttttggaaattcatttagttcgcaagcaccaacccaggtgtcgggttttccaagtcttttgtaaaaccaaagttttacccaagttgttaatcagattttaagttttgaaggcgtccgtcgatactcgcacagggtgcacgaatatcgagacgcaactagatggttacaaggggacatgatataacaattaacaaaggaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtctttgggctccgaaactacacgcgaaacgggacaactcaacaaacggcgaaaataaagccctattaatgacctctaagcgtgccattagatagatctcgagatttgaggaattttggaagttggacggagtcaaacggatttacggttgggaagatattgaatttctaagattattggatttttggtctaaaggaaaaggatttaattaaatcctttttggaaaagaaaagaaaagaaaagaaaagagggagggaatatagacttctcctcggtggctagggcgcggcccgagagaattggggcggtccggccgagctaaatgggccggccggcccaaggcgcgcgcgcgggagggaggagagagagccggtggaccgggctcaccgcgcgcggtcccgggtgggacccgcttgtcggtgactcggttcaccgtgcggagcgagcacgcggcgcacgcgcgcgggcggggctgcgacgcagtgcacgcgcgtggttcgcggaggaacggatgcggcgggcccacgcgcagcctcacggctcgcggtggaacgcgcgcacgggaggggctgaccggggtcggcccgacccgatctcggccgagttggcgccgacgtggcgcctacgtggctgccacgtgggctggcgagaggaagacgaaggcgccggccgcgaatggacggcgggcggcggcggtttctccggggcgccttgcgacgatgaggggcgacggggcgtacaccgggatgacgagggagaatgagagggagcgagccaacggcttggattcgccggagggagtccggcggcggcggatttcggtggcggcaaccggcggagtgcaaagggggaaacggcgacgaggtcacgaggagccaattcccggcggtgagagcatctacgcggctacgggaatccgttgctagcgtcggattgggcggagctacgccgagcgaggccggcgacgagcgggtgctacggagctcgggcagcgacggcggcgagcacacggcgagcgacggcaacggtcggggcggcgccggctagctacggggaggctactcatgctaccaccgaaaactaagggggagagatggagcgaggaggaagaacggagggaggcactaccgtgcgggcggggcgcagtgacgagaggccgacggcgcgggagtaatctctccggcctcgggccggggaagaggaaggagagggtgcgctcggagtccccttccgcgtccacgaatgaaccggctctcccggcgcttggcgatgaacggcggaggcgagacagagctcggaaggcggcggcaacaatggcgatgggaggagaagagagggagggcgcctgggctttaagggcggcaatgtcggtttggaaccgacttgggcggtcaaggcgcgagctggcgcttggcgctcgcgtccaatcggcgacagggcggagggaggatgacgccggcgggaggaaaagggaaaaggagggagagaaagggggctcgcccctttcttctttggg

SEQ ID NO: 48075 - DNA, 25379 bp, Oryza sativa
  unsure (1)..(25379): unsure at all n locations
tggaccccgggggaggcaaaatagacttttgcggaggaatttgatttggaaggatttggattcgggattgaactcgacgatagatcggggatttgagatctgagatggcacggacactagacaacagcaaagaaacaaatttcgcaattagggtttttaagagataattttcccgctaggcgccacgacggaacgggcgctacatcagtgaaattcaataatattcttgagaatattatttctataaattccataaaccatttctcgtattccagaaaattccgataaatctttttcttgtccagaaaatcaagttaagcttccaaaattcatatctcccgatccgtaactccgattgactccgttacacttcctgtaattctctaaaattgagatctatctaatggcactattaattagtctaaatagggtttttcttttggtcttttgtttaggttttcgattgtttgcgtatagtcgcggttaccggatttttgtcgatcgtgggatttctcgaagattcgtgaagcttcgtgaagactttgagcaaggcaagtcaccctttgaccaattgctcctataattggaaaatcattattattttgtttgcaacttgcattattagaatcacccgtttaacttgcttggcctcggtttgcatgccaaaccgacggacctacctagtagtcgcactaattcctgtaggctgtactaccctgattccttgtagctccacctttgtggtacctcggtatccgtgctctctgagcgcgtataccaaatatcccacatacaccgttgtttgtcgaaaacttgggaaatgggtttgagaagccttgaaaacccgacatgtggtgtcggcgtgtttgaaaataaaataaattgtgaaaactcgcgatgcaggggttgtgcctgtgtggcactgtcccgtattcgcatataaggactgattcctgtgggaacttcatccgagcatataacaagtgcgaccacacgggtgcaatgggacgcccctggctgagtaaatagcaaaccagggaagccttgatgccaagagacatgtggattcaacggggtggtgtcgggtagaaccctcgggcttcctggcatagtatggtctgggacctaacctgttgtcggtctgggacccctctcgttggcatatggcaaccctgtgttggctttcgaaatgccttgtcatgaaagccttaaggtctcccgacgtggctgatctcacgggctgggtgatccgggttagtaatgtcatgtgggtaaagtgtaccccctctgcagaggttaactaactgttcgaacagccgtgcccacggtcatgggcggatgtgaggtgtttcctatagcgtagatttgtttgcctgtgctttgtaaaaagttgttgtggtttgggaatcgttaccagaatcagtctatgtggcagaggatgacctgagtggtcaagaaacgaatctgtgtgattcgggatgtctgcgggcatcatagactaggcttcccgagtggaagcggattgttgtgctgctaggcagctggactctgggagtccgagaaaatgaaaaagctctgggagccgattaatcaagtgaaatggctctcggagccgagaagtaatgatctgacccgggaggtcggtacagtaccaattgagttgttgaaaagcatctcttaagtcgatttgagacgcaagtctcttttcgacccaaacttaaaaagaagtaaatcacttagtgatttcaaaatgatttcaaaattaaagatttgcaaaacaaccttgcctctcttccaagcttgcattaaacacctaaattcccgtgacttgctgagtacgaaagtactcacccttgctctatataaatatatatatatatatagttcctccgcctcgaagtgaagatgaagtgaagtgaagaatagggtttcgtcctggttcccagccttcgcctgtggtgttgggtgttagtccgttggttccgctgctgctgctgttgttggtgtttctcgtccacgtcgtcggttgcattctcgggctgttctgagttgcaacctaagttaaggtaaataagtcctctatttattttaaggattgcaatgattcatattcgtcaccgtgggtaccagcgctatgtcctgggactggtactgagatcgcggtttcgtaggaagcggttcgcgccgtttttcctacgacacgcttctattaggtgccgttctacggtggtgccagattggggtgtgacagagaggtgtaacatcccggcctagcgcttaataggattaatagaatactcatattaacaagttgcaacttcttttccagaagccgatctccaaagaactccagggttaagcgtgcttggcctggagcaatttgggatgggtgactgaccgggaaattcttttcccgggttcgcacgagtgaggacaaagtgtgtagaaaagacatgtgttggtctgtgagggcagtctatgacctatgaaagctgccagatgtaagtgggcccggcctgggagaggcgggtcgttacaaggtctgactcgtagtcgacaacagggtagccttcctcctcgaatccaatatggatacaatccgagtagtccttgtcgtttacatgtagaactctggttgtctttccttatctagaactctctcgaggtcagtttctgtataagacatggtatgtggtggatcgtggtggatcctgccgagatttagtcaactactattaggtatgtggtatccataaccctgacagtagcccccgacttcgatgcaaatgaacgagttcatattctcaaccgcagactttggaggaactgttatcgagctcacgtgatcgttctcggtgagtttagagataacattagatttcctttatcagcctcgtgcaggcaccgaaagggtttgtctaagtcaatctctaatgccgaccgagaaagtacagagcatacgactaagtctcccgtcttgctgtaatcgagaatttggattgaactcaagaaattttatctcggcgggtacaccatctcttcattccgtattccttgtcgagatccagcaaccgttctcgaacaatcgagaaggcgtagagtctgcgacagagctttgtcaacattggtcgtactcgccttagtcgatcttggtgtagcactatagagacatggagtcttcgtcaatgtcgcatagaattttcctgaaatcaatactcagaaaagaatatcaaatagaaatagcccctgagcgaacgctcaaagggtgacatgttataatatgtatggaaaactgtaaatgaattaaatttacagatcaatgttttgtatatgagtgtcttctctcttaccgactccgatcagtcagtttgtagagtcatacactctccctagcccccagccttgtcgtcagagaatcgttctcggaggataaggctcttggacccttgacctgccttggttgaacaagcactgatcctagcccccagccgtgaagttggaaagttaatttccgattacacggcttggttaatacgcacggcgagaactcttacatgaccaggtcttacatggtctttcgtctctacaggatctgacaaggccttatcggctctgggcgtccccagccgaagatcccttaggttcctcggaggccttgttaagacggcgtaaagggacaataggataggtttcaacgctaggtgtcatcgtggtaagggatctctgggtaaaacacttggcgatattatgtacctgctatcaactttgttgaagtagaggtagtaggagaaatcgctacaccgctggtcgaggaccagatagtagtcgtaactcgaccacttaaagtggaagtagtgggagaaacgctacatcgttggtcgaggaccaggcagtagtcgtaactcgaccacttgaagtggaagtagtgggagaaatgctacatcgctggtcaaggaccaggcagtagtcgtgactcgaccactccaagtgaggcgagagagatcactacgttttactggttcgagaaccaggagtaggagtctcttaatcacctataggggcgctaaagttggtttattacatgtgcacatcatgtggccagcatgactcacatacccaacttatagcatatcctgatgtctgctcgcaatcatgtcgggtgatcaagccgacgacgttcgcgaggaattatccattaacaaccttttctcgagtagtccagcgatggccggtgctatgagataggtcgtcggtcttcgttgataggttgggtgcgataactccgcatttgtcaagaatgttctcgataatggagtgtactcgaccacaacctactcgagtgctcaattgttcctgaaaattattttctagaaggcaagacatatagcagataatatcgagtatgtactcaaaaactgcgtggatcttctagcattatcaggatataacgatcagattaaatatcaggcattatgtaaaccgtaaacaagcatgatttatacagaagagaacggagcgagcccccagcgttagactgtagttgacctgacatcgaaagcactcgcacaatagatattgtataaaaaacatgctctaggtaaacataataaattattgatctgacaatgctatatgatctgaataggtacgataaattgcatataaaatattgcgtacctgtgtagatatatgacggatatatctacggaattaatagattaatttaaaaaaccaatctaccaattaccttactgcgtactcattcgatatcatgtgatctgacatctcttggtacgccgcggagcttgaggcttggtcgatctcgagagatcgagttgttgatgacgatgattccgatctcgtcgggggacatactccggttgggttagatctcctatagccgaagttgtcgagtagtatgttgtcggagaatccatcttcttaaacccatctcgtcgaaatcctagatcaccaaaatccccctacctggcacacactgtcgatgtttggtgtcgcaattctggtatttgtatagtatggggatcgtcgatactaggatatacgcgagactgaggtaaaagagacggagacagagatttttatacaggttcgggcccctgagttgtcaagtaataaccctatatcctgttggccgaagccggtattgctcttattcaccataatcacaccaatacaatatgtgggtagcctatctaactattgtcgacatgtcagtctgaaggtctgactcgtagtcgacaacaaggtagccttcctcctcgaatccgtgcccggcgagattagagagcgctttcgtctctcctgactgtatccggagacaccataggaaactagccgtggctatccctaaagtcgatatccggcggcttgtcttggcgtatgtaggcttgtatgttgtcccgtgtattatgttgggtgttgattgaggtcgttgattgtctgtgttgatcgccccatggtgggtgtccccctgtcctcctaggggggcttgtatttatacccataggagtccccttgtccaagtagaactagggaaaccaatatggatacaatccgagtagtccttgtcgtttccatgtagaactttggttgtctttccttatccggaactccctcgaggtcagtttccgtataagacatggtatgtggtggatcctgccgagatttagtcaactactattaggtatgtggtatccataaccctgacaacagtcattgacatgtcggtcccacggttttcctaattttaagtgccacgtcaacaccacgtaagcgccatgtcagcctaaactgccaaaaccgtcttaggaccttatttgcactggttttgaaagtagagggacgtgtcatatctggtattgcggttaagggatgaatttcagactcgatgacaaattgatggacctaaattatacattcctattatatcgtcgacttctgtctacaggattttattggacctaagccgacttatgcggggacaccaatgttttaaatagcgggctaaggcatttagcagtttgcttcttaaacagctatagctgcagctatagcaggctaaatggagctatagcggctaaattgtacatgagagcaaatagctagaatccttctcaaacatctatagcgggagatttaaaaccctgggggacacctaactcgcgcgtacaataaaataagcgcttagcattaatcacactggtagctttataatataaaataatataaaataagttgatttttttctaatttaggttgaaattttttaatgtgagctgaaaattttaattttgaaataggatatttcaaatttttagttgaaagttttaaattttaaatgtaaagtttttaaatcttgagttgaaagttttcaaattttggtttggatgttttaaatttgacttgaaagttttaaaattttgagttcaaagttttaaaattaagttgaaagttttcaaagtttgagttgaaagttttcaaatcttgagtgaaaagttttagtttttattagaaagtttactcaaaaatttgaaacttttcaaacttgattcattttaaaatttataagtatattcatttttttcaattcattttgaaattatttacttctaaagtattattcgtttaagttactgcttattatgtgcaaagatatatactgttaacttgcaaatatatgcttagcagaaagacggactctgaaataaatattgaaatcatcaatcagtagctctcaattaggcatccatgcatacatcttttaagcaagagaaaggacatgtatgtggtcaggcgggcggtcaagcttgaagactgacttacacgttgaccaaaaaagcacgcctaaccaactcaccccaattaccagtataatccttccctccctaaaaagaaaaaaaaaacaattctgttaattgatgtacctcgcgggagtactaattaattgagcctctgcctttcaaaagtgtagtgatccagtaaacaattctatccagccaaggcatgcatgcagatgagaaatgcatgaatgataccatctggtctcgctgtctggctgtttgatgagccctaattaacatcacatatactatttaatttaagcaactgatgatgatggaatgaataacccagcatatagtagtatgtagatatgtatagtggagtactctagtagaagatgcatatgatggaaaaagaacaagggatttttttttaaagacgagaacaaggaattgattcagctaatgtagacatatatgcatgcagcatctagctagccaagtcatccatcacatcatcagatcgatcagctaaccttaccttagtagctctctggttaattaattaggcacacgtggggaaatgaatctgtcgctaaaacggagtagtagtagtaagtgcacaaaccaatcggccaaaaaaacggggatcgatcgatatatactctacattatagactccttaagtccttattatatgatcgatttccccacctgaagccggataatcatgaaatagtccgcacaaattaatttcagtttctagaatctgaatatacacagatgcagaatgtgcatgcacctggaattaatcctgtacatacgagaaaacaaataatatgtcacattttgttctaaaacactgcgaggtggcattttaacggaaaggcaatatgcgtaatattttatccggtgtattgatctagtgagtggtattttatccaaatcacaagaatggagtgacatatcatttgttttctcatatatattattaggtgacggattcagaaaactttttaggcctgggcaaacttaataatagataactagcacacacgataatccatataatttaccattgatataacacatgtgatgtagtgaggtttaattgctttgctaattttcttgttaatgtggtttcattagtttgtacatgagtttgattagctaattttcaaaacaattacatagagtattgtgtactccctcgattttacactataaaatattttaggttttaaataaattcatatatggatcatgtatgtgcttcgtatatgtatctaattttatatggatgttagtgaatttagataagagataaaaagatcaaaacatcttatagtatggatcaacgtggaactaagggagtacctactactaaagatcttgcatagtattttgataagatcattgacagtaaactaaggcctcctttgaatcaaaggaaaaaaaaccataggaattttagagcattttatcatatggaaaataattctatagagttctttgaaacaaaggattgtttcctatcctttttttttgaaattcctatgaaattgattttactagagcaattttagaggaaaataagcatgattcctcttctcatgttttcctctccatatgtctaagattcttgtgtttttcatttgtgctaatcaaacaataggaatcctcgtatgttttgtttcggatctgctcagttgagtcaatctgtgtctcactgtcttgttagtgagtgggtgtgtgagacagagaaaaaaaatcatttactggttaataaataatgaattactccaattaattgtgcaagttgcatggggtttggggagggggaaggagcagagcagtatatataaaagggcaaagcctccgtccatttattcatactcgatctattattcggcggcggctgcctctgcttgcttgtgactgtcgtgtctgtgcgtgtgtgtgtacgtacatactccagtatatatatgcattgctgcatgtcgcttcatcctcaccgccgccacggcgacggcgacgtcgacggatcagcatcaggatcaggatcagcgcgcctcaccgccggcctcatcaacttcctcgaatcgcgtcgcgccggcgccatgagcaccaccaacagctcatcctctgtctctgtcccagccatggacgcccatggacaggaggaggaggaggagccgatgcaggtgcagcaacagcaggcgttccgcggggtgcgcaagcggccatggggcaagtttgcggcggagatccgcgactcgacgcgcaacggcgtgcgcgtgtggctgggcacgttcgacagcgcggaggaggcggcgctggcctacgaccaggcggcgttcgccatgcgcgggtcggcggcggtgctcaacttccccatggagcaggtgaggcgttccatggacatgtccctcctgcaggaaggggcgtcgccggtggtggcgctgaagcggcggcactccatgcgagcggcagcagcggggcggcggcgcaagagcgctgcacctgaccggcggatcaggaaggcggaggaggggtgatggagctggaggacctgggacctgactacctggaggagctgctagccgcctcccagcccatcgatatcacctgctgcacaagcccaagccaccactccatctgatctctactcgtatttatcacacgcgcagaggatgcacatcttctgcactacacttgtactagcagtggttaacatgtggatccggttccatgctctgattgttgcttatatttttcaaggaatataaacaaatccgatcctgagttaattagtgtaaatatatagattttgggtttcaggattaccatttttatttttggtggcaccatccagcttaacattgctccgattcacaaaaagaaaaagaaaacactcctactgtacatatacatatatgggcgagcaaattaaagcgggaaatgacgctgtgtttgaaatcgtctaatctgggcccttgttttggtttgctttggtccatggacagattgacggtgctgacgtcacgttgcatgaaagcgaaccgaacgcagatgttgacctggtcaagtccaaagtccaggaggcacgcacgtagtgattcacccacgtgcgtcaatttttttactcactcaaaagcacccagcaacctaaatagtgccctacaatataattatattccctctactatagcactactcctatgcaaaaaaagaagaagagagatattcatttgtaagattattttctactccagcaacttctcttttttagattatccattaccttaaaaaaacaacttttacagtaagtaagacaaatttgtaaaagataatagcctcaagattaaagacacgtggcaaatagatcatttcctccgttggtttgtttgcccaagtgcaatgaattgaaccagattgttgacgaatggggaggagtactggcgattaaaggacgatggatggatcagagttggcaactgccttttaattcatcacatgtggccttggtttgttgctcccaaaacaaaaccaaaagaaaaaaaaaagtcttgttgcctttgactcgaattaggagtattaacaattactagtagtaattgataacaatccttttgcttctgtaaccttctttccttcattctgcgtgcctgttatatatgctaatgctatcggtacaagtctagaagattgagaccgtaatactcttttatcttctctggcctctgggatgatgaatccggcagctcttccccaacttaactgtcatccagttcagtttctttaaagacgacctatctcactacacgtgcgggagttgttattatcacaaaaacataccgtcacggacaaattgtttcaaatctaaccaggcctttggaacatatatatgaatttcagaggattgtcggaagaattgcaataaatcctgcaaaagaatctataaaattcatatagtatttctttaaaacttattcctagcttattagtttgatgaatttcgtaagtatgtttgcattagaaattggtggtcaaattaagattatctaaaatgttgtgttttcttttggattgtgaactaatcgagtgagttgcatgctggctgctgtcttcatcaagacatgtataaaatcgatggaaaagccagaggtcgtggtgcaaaaccatcggcatggagtagttctcagtgtcacgtgaccaaaacaaaaaggatcatttcaatttcaataataataattataatactcctccttgattggtgattgcaacctgtccttgcttaccttggagacgaagagcatatccgttgagcttgcttggaattggatagcctaccatgcaatgcgtaccgctcctgcttccttgctgccgtaacttctaagaagcatccaattgaacacgtgcacgctagttgcacccttttttaaaacatttttaaaagaagaaaaaaaagtggactagtagtataaataatttctaggaaatacagtatatggtacacagcactagcattcagtttgacctgtacctagatcactagatggaggagctgtagtatcagattcatatgcgacaaggcatgatatgcagtgaaaagtggaaacgagaagtttgagcctcatcagttggcctaataagccaaggaaaaaccaaaatttgatttattttttaaacttgatttttttaagttgattttaaaatatttttaatgtattttattttagcgttaacttttaaatcgttacgaacaaatatataaaaaacttactaataaattaaatttttattcccttataaactgatgaggcttattagggaatatgggcaaccgatgaggcttagtcggttccatccattccttgccaacaaatatatactgtactatatacttgtgtgcagcgatatgtgtgcggtgcagtgtgtagcatgagcgttactaagtggtactcatccattgacaatcccaacatagtacattccatccgcgagcaatgctgcaatcgtggaatccacatccacacatgctgctttcttggagccgtcctattacgacttccctcacactgcaccagcactgccactacactcctatactagtagtagttctatgcatctactagacgacgacgactactactatcgaagtggagtagtatcaatgtatctcctccggaaaaaaaaaagaagagggttttgctgccatttctttgggctcttctcccctgatcccctccccctcccccggagaatcttctgatttagtactataattacgtgcattacagtaacaaaaagtgaatcccttgggcttggctttgccactagtatgctttactacagcagcggcagtagtactagtatgacaatcgcttcctggaagggacctcattgtcgcccgccacagcaaagcaatttcgtgccagggtcacagagagatgcatgcttgctggctgccaacatgaaacttcccctttgcatgcttgcttccttcacaaaaaatcacaatcacattgctttcgtcttgtgatagcacatgctactctcatctttcttcttttataaggggaacctccgaaaagggcaggaagttcctgtaatttcactaataagaagaaaatacttgattcagtttataagaaaaaccgatctcaaaaactttacaacagcacaattaattaaataaaaccggccaaaaccctgacattatcaaattgagctaaccacgcagacccagacccactgacaaagaccagcggtccaataagggaaaactcctaagatgaagccttcgagaaggacacaccgacagaatggcgagatcgcccgatccaaacggatataaggttttcacccagagagatccctttaggtggtggagaaggtaaaagatgcccaaggatgtcgttgctagcgtcggcaagccgcaaaggctttcgcctcagagtcccatccaaccaccgcgtccacgaagaaagccacttaatgccacttgcacaccgaaaaccaccacctgtacaacacggccactgaggcactggtgctcaccgatccgttgaaagcatccgtccgtagccccggtcgccttccaccaccacaccacaccatggagctccacagagagaagtgggctaaacgaagagcggccatagctcggcagagcttgccaagacgacctacgtcaccaccttgcatgtcccacgcggagctccacgtcaagccgcgtagctagattgtcggatccgccggacgaccaccagttggacagtctagcctgctagaaaacctggacctggatctagatcttgagaaaaaacggaaggggaaacagagagggaaggaggaaggggaaggaaagacagatgaaggatgagaggcgccgccgccgcaggtggcgagccgagaaaaatagggtcaggagaaaaatgagaaaaggaagaagggaaggaggaaagggaaaggataagggacgaagggagaaggaggcggggggtgggggggagcctactactcggcgttggtcacctcccgtgagtcgtcctctattcctcttgtctttcttcaattgttattattgtcataaatcaggagaacataggattatgtagggattattatgtaccagcccggccgggcagatggaaccgtctgtcgaattcagtaaaacaaagttccaggaagcagatataattcatcatggttaatactttgattggttgcaataaactggatggagttacatgctaataatttaaaaccgcaagcaatactagtacttgtttgcctcggctttggcggccttccaagggcaaacacattcaatttggtcctgcaaggccctcatgctctccgcgattgcaatgcaagtgcaatttcagaaatatactactacttacaagcaatactactcaggaatgactcaccagatatttactcaggccatcttttcggagctgattgctctcctccctcactaacattcattcgcttcaatcccctcagtgccactgcaacaagctaatgaggcacacattagattgcgcaacaagtgaacacagaaactattatgcatcaatcaaaaatacaattctatgtgacttcaccagaaaatataatgactgattgttcaaggaactctgggaaacagttccacataaatgtttcttactccaaaccatttcaggttaatttcttccaaaaaggaattggtctacagcattcaacctattgtgcctagtggttagagattatcctcccagtgacaattaacagcacgtcaaggatgtgctactggaaaaaaaagcatgacactgtacatgatctggatgcatcatcgcattgtttcgccatgccacaagaattgtagtactaatccataaagggattgaaatagtgagcactcaccctactgggaggttcattttgtagtctgggacttctccgaggctctgcattctggttttgcaaataggactgaccactttggagaagagacgatggactctggttttgcaaaagcgataccctcctgttcgagacatcagccgacagattctggtgcggcaaataggacagattgtgattttgcaaattgggtagattgttctggacaaaggatggcatggtctggttcttcaaatagggtggattggtcagggcaagagatggtagattctggttttgcaaaacgggtgatctgtcgtggacaattgatggccctgaagtgttatctgcatggttttccctagaaaatctttgtcgagtttcttcggttggagtactagtaatagcagtattgttgcgtgaatactgagtggcggcagctcgagctccggctatggcggcagtgacactgggagatttgtctagtgcggcggaccttgaggagtgaagttgaagagatccagggttgagagagaggggattggtggggtcagggagtgggaaattgacaggcagtggaccttgaacaggtgaaagacccctgactgctccctcatagatctgtgacatgacagaaagaagatgaacagattcattagaaggacaagtgagaaaattaagcagcagctgcattgtttatgcactgtgatctctcttatgttatttagaagagaagagaggacacacccgtctctctaaattgtaaacaccctggtaaccacgcatgtcgaatggaaccaccagtttctgcattgcattgcataattcgcattgcagcaaaaaaaaagaataatacaattaagcaaatttagaatgaaaagaagtgcagcgtgaaatactagtgagttgaggtgacctgtgggttttcacaaagccagcagaagtcggtcaatgcttcgagcctgacctgcaggtagtgaagaagatgattggaattgggaaggtgcaggtagtagtaatagagtagggttgagtagatacagattggggcacatgttcccaggaagcaagctcttgagaggtgacacagcctaccacctcgacgcatcctattgagtagtagtaggagtatgagaattgaactcctagcatggtagttgcagttagtagtagagagtagcgtcgtaccgaggaggcgggagacagggtagtggtgcgggaaggtgatgttggtgattccgtcgagggcgtaaatctccctgtagaactcctccatggccttgatggtgtccgcctcggggaccttggaagccgcgtggatccaaagccgccctgctttcaattcaattcatcaatcttaatcttattaatcttggattggaggaggaaggaaggaaagaaagggatagatagctaccggtgaggggcgatggccatgagcggccctcgacgcgcttgattccgtggacgagcagcgacgcccacggctggtgcatcgtcaggcaagggttccggagccttcccccgccgccgccgcgcatgccgccgccgccgtgcttccaatccaatcggaatcggaatcggaatcgggattgccgtcgaatcgctcctactcctacctactctttttttttttttgaactttactcctacctactcttggtcgaggggaagaaggatcatctcatctgtctgctcttgtcttgggccaactgtgtactgctatttgttagttgggccaaattaaggctttgtttgggcccaacatatattatatagactgtgagcgtctgattttttttgatagatagtactcctagatggtttcttcactcttaattaacaactggaactactcgtttcttatacaaagtgagtctaacttaactggctagattacttgtggtggaactatcccaccaagtttaaattctagatttaatacgagtgctcacgattacgtctaattatttatggcagacgacgtgtttgtagtgacttcgccaatcttaagtcaatcactggattatcattcaatggataagaaagctgctatattttttaaaaaaaataaaagaagaagaaagaaaatcgcgtgcgcctgaaatctacacattcgatgcatagataacatcattggatagccatagattaattaagatggtctccgcaaaacaaattaattaatactcatacatatataccggcaaaaaaggaaagaaagcagagatggaatcagttcacattgggagtaggtactgaaagtcgtagtcgtatggaatgacgtcgacgaggtgatggatgttgagacggtgtccggaccacctgaggcaatcaaccatggatttcctgagagaccaggacgtgggcagctggtcgcaaatccagcgaacaagcgagtccaggtcctttgcgaagtcgtgcatgttggagtgtatgaggcttgggatcatcagcctcctcctcgtcgatgtcaccaccagcgatgcctgcagatactccagcttcgccttctccagatccatcatcacacgatcagccttgtatattcgtagctgcaatgcaatgcaaatccattagttacagttgcattcaacagctagctagcagcttaatggagtagtaattaattaccgcgggagatgatctgttgccacagcagagtgcgaacagaatgttgggttctgagctgttgagcccgtaacgactcctcacctgctgttcttccacatccacctcgcatttccagaattcctgcattctcgaatggatataatcgttgccagagccagagccacgagaagaatgaatgaatgaaatgcctcacttctttgacactggatggctgtctgaggatgaaattctctatcaccaaggcgttcaacttttgccctgatacattcagcgtggccttgttcttcagtgcaagtagcttttcagggtttgagggtagtccattgtgcaaaatcccctgaaatacaaagttgatttaattgtcatcatcagctagacagtccgtttgtgcagagagaccgattcgattcaattattaataaatactccacgtacgtacgtgcatgatgcaggtgttgtatatgttgagccagaaggcaagcttttggtggtgagtgagaaacctcaaatccacatgctgcagtgcctccagcatccccctgcatatgaaatgctcaacttttaattactaattagtggatctgctgctaattagcaggtgcattatcaggtagtagcaaataaagtaggcaagcattagtgtaagtacctgagcttggtgagcaggggagaggtggagaatcctctgaggtcgaaagcggaggaagtgaagctgacgaggttcttgtaggggcctatatctctgacgatggaatccgggatggcgaagatgccgtagtgatcctgctgccccgaccggcaatcctgctgctgctgctgtttgttcattaccaggctggtgtcgattctgaagcttccacctcctcctcctccctgatgctgcctggtcagtgaaggcgatgaggaagaggacctactactagcgttgttgttgttgttgtcctgctgctgcagctgcaggtcggcgaccctcgaggacctgagcagtcggatgaagatgcagatgaggcacttgacgatcctctccgacagcttgttgggctgctgcaccatcttcttctttttgttactactactactagtatcatcgagtgaattaagctttggactgggagtgggaggtttattgctgacgatggtcatgagaggatgatgatggcggcttgtgtcgaggccgttgatggcctgactgatgaagaacatggacttgatgttggcatgatctcctgctgcagatcctccactattaacattggcattgacagtgtcgtcgtgggtgaggttgattgcattctgggtagttgtggtggccgccgccttcttcatgcttcggatctgggtctccaggcgggcaatctcctcctccaccagcaccagctctgctagaagctccttggcctgcatccattttcattttcattctcattcctagctactccactaactcatcgactctgcttctggcttctaccttgtgcgggatgaatgcagggatgttgtggaggacggatggagacgacaatgatgatgatgatttggtggtgtttgagtgctgaagggcgcggtttaggatatcatgcaccgcctcctcgttccgcagctgcttcttcagctcactcacctgcttatattttataatgtacactgcttattgcgtctgctgctgatccaacaaataaatttaagctaattaattaattacctcttgctcaagtctctgccgcagccgccgcgcgggcactgttcttctgctctgtaattgaaattaaacagctagctagccttgtcagatactacaatatagtacgtattttttttcagagaatggattaccggacactgtcatcgatatgatcgaatttaattagctacaatggcaattaaggtggatgggacgggatcaatcatcagacctgaggatgagggtgaggatgggcgtcatcgtgagacgacggtggtggtgcagcgccggtgccggagagcagctggtgaagatggggcggaggagtagtgcttcccgcggtcacgtactcctccatatactatactagtgcactgtacgatgggatgaactagctagcgatggttcattatattagaaccgtctggcgggagcaagctagctaggtgaagaagaagaagaatgatcgatgatggatggatcgaggaggaagaaaggtagagctagagcttagagagagcagatggttgggagggcgctgtcgtacaaggattggcaggtgaggtgcggccgaagtacgcaaactgctgctgctatgtttgggcgatccgatccagggaggggaggggattgatcaccgatcgatcgatcacctatcctatatatatgcaagcaaccaaacacttctagttctagcttatgtggtagtcgatcttgtgctagtgccatgggttggtggcgtcatcgagcgcgcgcgttacatcccatctacatttcccattccaattttattttaaatactactactacgactactttttttcccttccacacaacacatgcctatcttgccttgtaatccacacgcacaactgcatccaccatgtcatgtaatctctctgtttttcctctcctctccttgttgagtgcaacctactcaacaccgctaccttacctggcgccttcttttctctgcttattttctgtatcttagtgcagttgggtggaatcaacattttcatcttcactaaccacctgctatccgtacgtaccacgcatgggttttaccattttaacttttttttaatcatttatagctagcgtccgttatattcttactgttttcgacattcatctcaatatatacaagatggggtcctgcacatatatctcttctctgccatcttcaaagccaagtcatcctccttccatatgtattcccaccgtgtgtaacccatgcgctcgcggatcatacgtaattaaataactactgcatctaatgttttattctcaatcaccctcctactatatcctaatttatatgggcatggtccgttagaacgtatgagtatgttactggttacaacaaaatgacaatatatttcaagaggcctggatggctgcaaaatttcctaattcttccctctacaacgggtaggaaaggattattttcccttgttatcctataatttattgagtgaatggcaatttgggtcacattttattacacaagtttactttggaccacccttaaaccaatattttcactttggacccgagtaactttgttgttttctcggtttagaccaccccaaacaatttattcatcaccccaacctcaattaaattagttttgatacaccggtgaactttcccgtatatatcttcataaaaatggacggtagatatgaaccgtaaagagagttgggtggtccaaactgaaaatggtaaagttagtccaaagttaaacgattactttaaaggtggtccaaagtgaaactttacgaacaaaaggtggcctaaactataatttactctgatttattcatgcaagccaaatggcatatataaaaattaatccttataaattcaaattatttgttttctctgtgaacctaacaagccgatttgaacctaacaaattcaaattcctatctccgcccctctaccaccggcccagccccctcccccccccccaaaccgccgacccctcccggtagtcaagaagatcctcgtccgacctcggcaacaagagcgacttcctcctccgctctaaccccgcccacaagatccccgtcctcctccacgctagtcgagtccctgatcatgctccaataccatgatgacgccttccccgatacccccacctcctccctccgtcgaactcctcctcctccggcgaagccgacaccgcgtacgcgcgcaccaaggcaagattctaagcagactacgtcgacaagaagctctaccgctgcgggatcaagctatggaggctcaagggggagctgcaagccgcggtgcgatgcaagatggtggagatcctctggacgatggaggcgaagcgggagttcttcttttgtagcggcgggcttggcttcaccaatgttgcgctcgtgctattcacgacatggttctacagctacgagtggtgcggtgggttcagcatcaatgaggtagcgccaaagctggcgacgtgggcacgacagtgcatatagatcgactccatcgccaagcacctcccctcgccggagaaggtgcatgacttcatcagcgtcctccgaaataagtacgacgttaagtagatgggatctcaacatcgatcggtctccgtcgagtgattcatcgtgagatcgatcgatgcaaagttgcagggattgattggctgtttcgtttgctatgtcattggctttcccgcgctccctgccttgtcgctctctaggcacttactggtggagagaggagatagagatagagaaaaagagggtgaagtgaaggaagtgggtcctactattttttattttcttgtttgattgacataatgggccctacatattttttttaaaaaaatttagttttcaattttgttatttttttaatcaaactgcacgtcaatgtcatgtgggacgaagtcctagtcgaactagtcacgtaggagccagaaccggagacaatacaaccgaaggatttcatttgcactagttttgtaagttggtgttgtatatttttcggttcaagatgaaaattggactgagtgacaacttgaggagctaaagtgaacttattcttataaaaggccgtgggtttacccgcaaaaaaggggggccatggatcgttgggccgaaacaacacacaggtcatccggccgctctcttctttgggctggtggaattaattatagtataataaggaaaagcagaaagaaaagcgtggcacggcacggcgacggcgagcgatacaagaagaaagaaaaagtctcacctcggaacggaacagcagcatgtgggcccacaccacacgtctttcgtcgcaatgccacgccatcatcgatccctttccttcatcaggagttaatcccctttctctccctcccggccgccgccccgccccgcccatcttgtcagatccttcttcatagttacgaccaatcctatccaatccaattgttttgagaaccaagggaattaaggagaagaatcgaggaagaagaagaggccatggttgtgtacgagcaggatccggatgttctccgatggagccttcaccttcttcttccacccgccgctgccctacactaccaacaacgcaccagcagcgtcgactgcgatgagatgatcgcccacgccctccaggaggagctttcctacgcccaatcccaatccctatcctcctccatcctccatctccccccctctggtattccctcttccctttcctccgctcttgtacactacagtattaatctttcttgttttttctacagctcctccactaaaggaagacgaacaagatgatgcgccaccaccaccacccccctttagttcttgttcaacccctgcagattatactaatactaataatcataatgcccatgactgcttaatcgagtttgtcgatgatttctctgctctagatggccaagttggcaaaagattacacgacatgattcccattcctgtaactaactctctactgcttattccccaccttctcttcacccattcatcatttaaatattcttgtcaaaatattaatccattaatgattaccttgcttcttcctcttcttcttcttgatgctacttgttggttaccctttccttccttctcttattgtagcatgttccaaaaactaacggggacattccttctgttgatgaagccttttcagatcaccaaagactccttcacaggtaataaattgccctcaactgtatttctaactctaccaatacaactttaacctcatgccaacttttctatgttcatgtcttagtaatgcgcgagtctcccataggtgtttcacttaatgttggttctggaaactgaccccatgcatggcgccatgtgatttcttatttaggttggagctgtatgatcttgctgagctcaaggttgaaggggatggcaattgtcaggtattacttcaaatatgtactctttttctctattttatgctctacttatctcttttagcatgtatcttatacacagttccgagcattgtccgatcaattttaccgcaccactgaacaccacagatttgttcggcaacaaatagtgaaacaggttattcttggtgaagtcatcatgttttcttgttacaactctacttcctcatctcatttttccctttttcaaccgttccacagcttgagtcttatccggaaatttatgcaggatatgtccctatggattatagggaatatctaaaaaagatgataaagtaagtatttctcgtttttattaacaagtaaatctttgctttatagtgtaacattaggcattttcactttgtggccacaaaatcgaccaggaacggggagtggggtgaccacgttacattgcaggctgctgcagactcggtaaagatgatgtttccacacttcctgacttattaaataattattcttctgtttatcggaattatgctgtatacagaataagagttatttgtattggacagcatggtctgggattcattaagtgatgaataatcgaaagaaatcatatatatctgaataatttaaatctcaacaaaaaaagaatggtattttctctagtttttattttggtaaccagcataccttaacaggtacgtagtatattgcaatctcatgcacatcattaatatagtataggtattgctccccctggacttggtcgtgttgcttttgtgctacttgatttttcttctctttgcccaacactcaaacttcatgattctcataggtggtattgtaatgtcctcccttatcataataccaggcctatacatctgttgtgttctcgtttgagattgagtagcattttgtgaatgaccaagtcatggatttcctagaaccagggataccgtgcatctgctccttgctatcaatgtgaaactcaagtatctgcattgttttttgcagtatggtgtaaagattttcatcctgacatcattcagagatacttgctacattgaaatccttcctgttgttcagaaatcagaaagaggtaacctttcttttcaaattatgttgctactgaattgtattactgaaattagcaactacttatattatccagtcaaacatagatgcagatcttcatcagttgatatgacccgccttatcattaagaatctctgcatgtaacttcattgttcttagttagtttgcatagtggattgtactttttcaatagatgtgtatctaatgtgtttctgttcattttttccttaaaaaacccagttatatgcttgagtttttgggctgaggtgcactacaactcgatatatccagaaggaggtacagtttgtcatttagataccgtgttcatctaggagtgtctctttggcggattgatgcggtagctcaccagtgcatgtttgtggtgcagagttaccagttatggagaacaaaaggaaaaggtggtggcatttttagatcagcaactggtgtacactccattgggctgggtacactccatttgatttgatttgatgttggttagatcagtggccattttgttggggctatatgtcagtgtaggaatgttgatttgtgagtgtacataacacatttagtcaggaggaagaatagctgtgacaatagatgaatgtatcatgtattggatattattgatgttatatagggtcacttagagttgggtttagaatagagtagctgggtgtggagctatctaaacctcttctctgtctctaatttattttgcaacatgtttggttgaaatctaactctacgagaggtgaagctaaagctttaccaaacaaacccatacgagaggtgaagctaaagctaaacccacaggagtatgttaagaagaatcgattcttttcttctgacgtaatgcagtttgcatattataccactcgctttaatcatagatacacgatggtcatacatatattatgattaggacagtcaaaccttcaaaattttaaacataaacaacttctgaaatacttagtttaaaaacaaaagagcggtactaatagatatgatactatgatagtacttttcaagacatatgcattgatatttttttagaggaagagacaaaaaaaagaaaactagcatttaaaaactttttatggttgatatctcacaggtttgacacaatctcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48076 - DNA, 7156 bp, Oryza sativa
agtagggcggcggggcggaggagtcgatggagctgaaggcagcacgcgaggggaggggaggagacaaggctggcgggcggcatggctagggctagggctgccttgccactggaagtctggaagtcgatgtcgatccaatcatccaaccatggggagaaagagaactacaagggaagggagcaccacacccccacccccacccacccacccacgaggaggaagaagccgatggatagatttacccctttttttaactgctacctactcggctactcctatataagcacaagagagaaagaaaagggctagagagctgctttggtgtttcttgggccaagctagtgtgtgcagcaccatcagatcaagtacgtgattcctagtgctttgctgaattactaagcgatttatcaatatattttttccaacaatcaaattagaagtaaaaagaaaaaaataaaatatcagggtttatcagtacttatcataaaacaaacaaatgatattcacgctttaaaacatattgataaatatatgttaaatatttaaaaatgatagatagatttgataaaatattgtagtcggagggtgaactcctcaagcggagaactagaaagcccccattttagttcggcggggggcagcggatgagaatcgaggtttggaggaaggagtgatgtggaggggggtctggcccctcaagaacgatgagacaaaaaggggtttatacaggttcggaccgctaagaggcgtaataccctactcctgtatgtggttgattctgtgaggaacaaagtgtatccgtcggttgaaatccgagagctccctctcctcactaggcctggaccttcttttatacctcaaggggttaccacaggggcccaaaaatccacctagggaagaaggaaaacattctttgcatttattacatgtcttattcctctgacagagaagaccatgcgcacaacatctcagcatggccccatcagatcacgccgagcgacacgggggacgcctacgtcattctgcattaactgcttgaaaacttccaggcacccgttcccaccaaggaaagaataccccaatttaactggagcaggaaattgtccccagtttgtatacgaggcaaagggcttctcatcatggtgatgtgaccagatggcaccgggcacatgccacttgacaggcggtcagtgcgcggtcagtgcacaggtgcactcaccctgccacactggtcattcgagcgtcgtgcagcctatcagccacgcctacacgccacggccgtaggatctgccttaaatgcggttaggtgggcgttgggcgcgcccactcaacccgcacatgctggcggatgcgtggcctgacccctaactgtgaaggggtagccgccgctccaccccgggctcgacccccctcgggggagttccacgtgggtgtttgggggcggcctcctctctctagacatgatactccctaacctatatcaccgacaattgtgcaaatgatgtgagggtgtgatgattggatatgcttgtatgtttatttgtagaattaaataaattgtcgatgatgttgtatgcttgcatgaggttaaatatgtaattattgctagtgggtgatgatgtggtatggttgcatgttgagctttagatttagtgggctataactttatagaaagtatagataaaacaggagaagacgttgttacaacggagccgtcggtgggaaatccacttttgactccctcaaccataataccgtataccttatcccctataactattaaaaccgatgtaatttgacttcctaatcattattcatgatgtggctcattgacctgctccaaccagctaacgtggctcattggccccacatatcagtgcccctcctctctctctcttcccctattctctcctcttgcatggttgcatctcctccggctatggcacccatccctgcaactacctcaacttgaatggcgatgaggtgaacggggcgggttgaatgatgacaaggtgaggcaacccgcaagtagggaggtgaccaactttgatactttgcgcgctacctgcttcgcgaggaaccatgcccacaacggcgtcacagactctatccccaatagcaagcatggcccaaacacgtgcaacacctattgtgtcgtccctgtgcccaatagcgtcgctgggcatgatgtcaacgacaggtgcaatgttgccactgtcgaggacatctttacggcttgggtcatcaaccacgtgaggatgagagaggcgaaagcgaacttcactcccgtcaatcggccctacagcacgatgtctgagctgttacgaggggttggtgctgtcgctaccgccctcgccgctctagggtcgtcatcgccgttgttcctcttgggcaccaccgcgcatatatggtcaatgaggtagcggatctagacacctccagccgtggcttgccctacaacacggcacctgagccatcgccgtattctctcaagggagggagggggggttggtgctgccaccatcatcctcgctgctcccgaccgctacactgttctcccacgtgctcaccaagataccgacaaaagggggaaaaccataaaagaacccgaccgctacgctgtcctcctaggtgctcaccaagataccagcaaaagagggggaaaccataaaagaagtgagttgagtggattcattggggagagaggccaccaccaacaatggcgagttcgtggtggtggcagtgtggttgtcgtccaagagcccaccgtcacctgcctgccaaggctgatagaagaggaggggaaacgaaccgctgccgcagcaaaggagagatgagaaagacaagccacgttagcgaaaaccgctttcaaaaccactaagaaaatcaaattgcaccagttttaataattaggagggtcaagatatcgtattaccggagtcaaaatgcacttattcctccttcatactaatggcatatgggaaggtttgtctgacccaactaaagcccttgagatattacaaatctgcaaaaccaaaatgtacatatgtttggtagatctgaatgatattgagataagaagatggcaatttgtaaaagtaaaacgtagtcgggagctgatgctcataaattagctaagtttgcatgtactacaaccctctttttttctttattgagggtacttgatttgtcgatatatatttatgcaagtacacttaaaacctgttagtcatgaataaaactctgaacttttctttcctcaaaatatgagagagggagagagactgctgcacctttcctctcaaaagctttgccgcatctgcatgggtttttggctatttaagggtcctcctcctcttactactagcaattaatagaatgagagaattaattaataatttttatggagtagtcagcatttttctctcgaaaaacaaaagagaaaaagaaaatcatctcgatctcaatagcactccgaatctggatcgatcgggtcgtcgtcggagaatataattgatcaccatggttccggtgaatttcggggattcgtcgtcgattcccccagtggatgcggtggtgccaatggcaatggctcctcggttactctgcttcctcttcctcctcctgcagctgttgctcttcccccgcgtcgccgccatcgtcctcgccgcaacccccgtcctgcttctcgccgccttcctcctcgccctcgtcctcgtctacagcgagcccaacaacaataatgagcccgatcatctgattccgatcaggatcaggtcgcgcaatccccatgcccatgaccatgcctcctcctgcaccgcctccggatcatcggacgacgacgacgacgcccaagactcggactcggagtcggtctcggagcctgccgatgatgagaaggctgcggtgtggacggcagaggacgagaaaagcatccagaacatcggctcgctggagctggagaggaatgccgctgtggagaagctcatgtcctcaagaagcatgcaccgctactacgccgccgaccgcgacctcatcgacctcgacctcgacggcgatggccaccagctgccccccggctccgctccctccatgcaccgcaaccccttcttcttccacgatgaccaacaagcagcagcgtcaacggcgaagctgttcagccgacacgagagcttcaggccatacttcgtcgccgacaagacgcagcagccggtcgtcctcgagagcagcggtggcggcggctcttcctcgtctttgtcttcgtcttcctctgccagcggcgaccgtgccggccagcatatgaagcaagaagccgtggctgacttttcctccagctccaaggccatggtggtgacggtggatgcagagctccccaaccccaagtccatggtaacggtggatgtagagctcatcagcgactcctcggatgatgacgacgacgacattatgtcgttgcccggccagcaaataactaaggtagcgagcagcatgtcagacgacgacgatggggaatcctcctttgaggtggagagcatcacacgacaggtaaatgaaactttgcatgcccatgctgctgctgctgctgccgccgccgccgccgcccgtgaaggaagagaagaaaaagaagagaagaacaagttggcatcgattgaggaggacgagaggagggagcgcgacgtctttccgtctccgtccccgttcctccggcaaactctgccaccattaatggcgacggcggtggttctcctcctcctgccgccaccaccgccgctcccaaagcagtcgtagcagcagccagatacaagacgccctccaagaaggcagtcgtaggtttcttccgaaaatgaccaacttaattaattttaattagttactgtttcttcttattcttcaattcaattcatcttaatttagccagctcaatcttttaccatacgtcacttataaagaggagggtttatagtatgtcgtagtacactgtatgcaacacgtttgtattgtagtactacgtatgcatgcatatcagaatatgtacagagtagtacagttcagcaagcacgtaggcgacctttctggcttctgggtcgcaaagccagctgcgctgatgattctgattcttatctcacccatgcatccatctctgttctgcatctaatagaatagagcccttgaaagcaagcaaagaacaaggaattatttaatattaatgccttacttgatgcatacgtacctttgcctgataccccttttccagcaacagcaaaactaccatgcgcagattggcatcctcttccaccgtttcgtttggtaggcaagcaagcaaaagacaatccattcctggttcctctccttaaaaaccaaaccaagcgggcctatgtttactgaagattagtctttaacaggggccaattccttcccgtcatcaaacagacagacaaacaaccaacacaatgatgatcaattctgccttaacggctgcttccttccaatctcctcccactttcatcaaactacaagtacagctaaggcctcagaagcgccgcctgcaacaccaacaacagcttctgattgttggcaacaacggggcaataacaataggaaagcaggagttcgtgctaaagcctgtacaagcaacactagggccaaattcaactggtggccgcgggggttcgcccctacccgatgtgatccagcagttctactcctccctcaacgagaaggacagcaaacgtcttgaaaacctgattgctcctgactgcatcatcgacgacaacgcatactataagctgctggacatcaaggttttacttgttcttcattctcatattacagacctacagtatataagctacagcattttttagtccactgctccatatatatattggaaaccgagctatcaagacctggttaccatactcaaaattattcacagcaacttcgctgcatgtagagtacccaaacctacttcaggagactgatggatgcaatgggaaagaatttcaaatttgccatcgatgaggtttctcaaggagtggaacccactttcgcagtaatgtggcatcttggtaagatactgtgtaatacaactcaatagaagtgataagacaatcaacttggataatggtataattatattgcttttacagaatggaatggtaaaaccatccccttcaccaagggctgcagcttctacatatgttcaagaaaagaagcagcacttgttattaggtagttcatataaataactgctcttgggagattttctttgtctatttcaaaaacaatattttttgtttccatgtttcctttgcattcatgttagctgactcttagagctataacgttgcagtggctatgcttcggtttagcctctaaataaataaaaataatattccccttctgttatctctgatggtattctaacacaatgcaggaaaattcatatcttccaagagtcaccagtgaaaccatgcaagttttcactggtaggcatgctaatgagtttcttgtctatattaccatacagtccaactgaatcagaagtataactctcactgatgaaatattccaatgcttacaggaaatactaaatatcgctaccaacttgtttgacacattcccgaatatagctgaaggtacatgcttcatagaatcaactgtttagtttataatgttggtagctaaaaagcagtctaaaaatgttagtgcacatgcaggtttattaaataatccagaacaagcaatacagccctttgtgaggctttacaagtccttcgtgaagcctttcatcgtcccttttcttgcatactatacccacttttggacatacttggctaaagtattgactatgatgctccatttgttgtatagaataatcaaatggtatgtttaaagactagaatgactgaaaagtccatattgtgaaaatagaaattatatacgtaccttatctgtgcacaaacaattacaggtagccaaacaagaaaggggactgtatggggactaccaatggatcagaacttttcagatgatgtcatgtcgttgccagaagtttatcttgtccattctcctgcctagaaagagtgaacatcatttcgtttttaaggaatttaccgttactctattagtataaaactgtagataatctctggaa

SEQ ID NO: 48077 - DNA, 2238 bp, Oryza sativa
actaacagtatgacctgcacatttcaggagagatgtacaatctgctaattttcaagcttcatgatgttttttcaccttagcattggcaacaatgtaaatgtactcatttctatctatagcattaagcattgtattttcaaacttaaatttgctttatgacacaaatccagttttctcttgtgggattaaaacccaggtaaaaaagacaatgaacaataaactttagaccaaacagtaaagaatgttatatgttgcatatagcatttacgaggagccaaaccggtgatgttgtatgagaggattgtgagttcctttcagttaactaaggcagtggacgtcatactatacatgaactttagaagagcatatttcaaagaaaagggggagcataataacgtattcaatgtaatgttctagttgtggtcaccataccataaaatttccaaaataacgtttgcagatgaaacatgtgcaccaaagagctaaatggattcatcattactcttctcacctcctgtgctcaacttgaagatgccagaagggaaagcccaagaaataacccttgtggatcttggggcctgcagacgacactcttctatcaccggagtaccgcagatgccatccttgatgaatgattggccacaatctaagttccttgcaatatttccacctatgactcgattcttacagagatttcaagatgccaatagagccctgcacattaactaggtctggctggatgggtataacatcaatggtgctcgctgcctctgtaagacgacctgatcgtcctaacatatccagaaagagtgtgtagtggctcctctgtgggagaacaccaaacaaattgcccatagagttgaagtatttgatgccaatgtcaactaagccactgcggttgcaagcgaaaagcattagtgagaaagtgatgccatcaggcttagctccaaccaatgtcatgtcttcgaaagccgacaacgcttcattataatactcgttggataccagtgcagacatcaaggcattccaggacacaacttttggctcgctgattgactggaaaacgctcctagcatcccccatacacttgcatttgctgtacatgtcaataagactgttagagaccgaaatgtcactactcaatcctagtttcaccgagcagctatgcaactgcttcccagtctctatggatgccaagcttgcagcagacgaaaggaagctagcgatgctgaaaccatcgatatcaacatcctcatggaacatccggacaaacatttcaagggtcctctgttgaaggcccatctgatttaaccctctagcaaggcttgtgtatgtgaacctgtcccttatgaaggccattgtggtcgccactgcccatgcatcatccatccttgcaaacctaacataaacatcaaccaaggagttcccaacagctgcatccaaagattcaaagctggtcttgagaatgtagccatggattttcctggcatgcaggaaagctagcgaggagctactgcctttgagaagagtggagacggtgaacgagttgggaagcaccccgctaagccgcatctgagaaaatgccaaaaacgcctcctcatctctgccatggcatgcaagtccagcgatcaaggcagtccaggacacgacattcggcttgtcgactgcatggaaagtgtgcaacaagtcgagtaaacggctggaggacttgctgtacaagtccacaagtgcattgcagactgaggtatcatgctctagtccaaacttgaacaagcgggcatgaatctgccgtccaggctgcagtgcccggaaggaggagcaagcagagatcagggcagcgtaggtgaaggcattgggcagcactgcagcacgggtcatggagcggaacatctgaagagcagactggaggtctccactccgcgcgtagccagtaatgatggcggtccagagcacgacgtcggtttgaggcgtggagtggagcacggtgtgggcatagcccatgttgccgcagttgcagtacatatggaggagcgcggtcttgagcaccaggttgagacccgctccccagcgcaggagctgagcatgaagctgagtgccttggtggtgcaggcggccggaggcgcaggcagagagtagctgggcgaaggtgtgttgagtgggcggcgcaccggcttggagcatgcagggatagagcgcgagagcttgcctccatgggccgcgcccgcgcggacgagagca

SEQ ID NO: 48078 - DNA, 3179 bp, Oryza sativa
ggcggagcaggcgagctcgtctgcggcggcggtggtcgggtggacggcgagaacgcagcagaagacagtgagcgcggcgtcgtggcgaccggagcgagcgtggtcagcgacggcggcggcccaggaggaggcagagcggcggaggcggaggcacatatcaatcgatcgatatgggttcattgaattcatttcatttcatgggttgggttgggtgggggattgcaatgcagactgcagttcccttctctctctccccctctctctctacaccttctctctcctcctgaaccttgcaggaactctctctctcaaaaaaaaaccttgcaggaagaactgaagacccaattcaaacaatccacattttgtgattttgatcaggtaggtcagtgctccagatcacctgaggaccaatttcttcgattcgagttgggaaatgctccctgattatccatcatttgcaaccttcaccaacatctctccaacaaatatgcctctccaacaaatatgcttctccaacaaattatgcttctgcagcgaattctccactcatctctctatcaaatgcctttgaactcattcctgcaacaaatactagtatgccttcatttattgtgcattttcctgtcgaacaaacaaatcgtcaattgcaaaccatatgcaacagaactgcagtagagtagcagcatcttctccattctatgctccgctcattaatccttgttcatgtatacagcatgtattatagtagcattcaacaaggatgcactcacagcatctcttacatacaaggcaccagtgcattctcatcttgttaaaaaaaggagaaaaggatcttaaaaacacagtgagcatacatcacatgggacaaaatgaatttccatatatatcctcttaagtctcttcctcctcttcctcagatgcatcatgcgcgccaaacagcctgttcaagatggcctggttccatcctaatcgtcgagctgagcttgagtgcaagattcttgtggtaaagttgcgccacttagaggggctgttgcgaccatcatcccctgatgactcaccatggcacacgccagatctgcgagtatctggatagtacttgaggaccacaccgttcttgtaaggatctactcctagttcccgcggcagtggaatccccactatttggacatgagatatgctgaaaattagtacatgtgccacattgtcagtgcaacgaaacaaagttcagaacaaaacaataactcaacagtacccaactcaccatatgtaatatagatcatccatttcctgtttctgaaccctaccaagaaactcaatcttcacaactccaccgatgcatagaactgcgcgtggaagcttaaaagactgaaggacactttcctggaatatggtacattatttacattcagcaagtttgcacacgagaactgcaatgatgtattgacctatatatgttggaccaggaacacaagatttgcccctctacatctagcacattcaaaaaactgctaccaggatatgtagggttggtttagtagggcaatatattgtatttggtttgttaccaaccaaagtgataaaaaaaatttgatgctacaaaattttggccgattttttttaatctaagcacatgcaacctcataattccaaatgtgagcatgtattgtcctgaattctgtttctaatcaaactagctagcaggcacaaagcaaatgatccattaacatgttttgctagtattacaattaccctttgctgatgcagcttctatgtgaaacaaatcaagatttgttagcacacataatattatgattttgatgatccaagcagatggattatatttcaaccggccgctacagttccaattttcaaaacgaaaacaacatccaagtcaaatatggattaagaaaaaaaaagacgaagaaagctcgagactaacggcatgacggcacggtgccctatctcgtaatggttgatccaaccaattgcaaatggtaataagattttcttttctgacgacaaacaatcaattagacctaaacaagtcgctacgagctagtgatttgtccaatgatcagcagccattagtttgttatatttcgtttgacattaagtccgatggaagaccactgcacacacatgtgggcttcttgattaaaaatagaattccatccattacctgctcatatttggaattagaaggttgcatgtgcttagatgtgaaaatttctgaaattttggtaatgtagagtgtgtttgatttgctagcaaaaattggtaaaccaacccatacatgccaaaaataaatcctgcatcaagaatgcttagtttttaggggaggcatgtgacggcatgaaaaacactgacctgcagcattggaaattgtggagatgtgtacgtccagatatagttgtcatcagcagccaactggccttcattatcatgagatacaagtaattgagatggtagaggtgtctttgggtaacccatctggaagcggacatattttgcggagtatattggatcaccatactggaagaaagctgggtgcaagagacaggtaatactagtatttagcaagaggagtaaaaagaaggaaggaggatgggtgggctgacctctgaatggctgtatgttgatttgttgaacgaggcatagatcggagcgaagcctgtaaaagaggcattcgggcacagcaggatcgaagtggccggcgctggaccaataagagggcctcatcatggccacccaatcggtgggcacaagggtgttttgtatggtctcctcagggaaattgtcggtggtggaggcaccgatgcagcggatgatgcagtcctgggggtcatccaagagaagggcatagctgagatgcatgtacgccctgtgctggtgctccgcatccgactcagaagcagaggcaatggcttgtttggtaataatacgggtgaagtttgaagcttcagggcaaaggcgcaggcattggatcttgctgaagccattccgaacaactgagggcaaggacagcaaaaccagttggtccaatatactactaatttataaggattaaggatggagaaatcaatcaaaaaattggagtacttggtgcaattaagaggatatattactactataccgagtatatattattgaaggatgaggaaagagaagagatgggggta

SEQ ID NO: 48079 - DNA, 18183 bp, Oryza sativa
  unsure (1)..(18183): unsure at all n locations
ccggcccacctaccattttttgatgtacagattgcttgttgatttgatataaaaagaaaagaagaagaagaagaagaagaggatagaatagaaggggaggaggagagacgagaggagtggttgtggccatggccatggcggccgccgtccaccgcttccttggcgtatttcccgccccgtcgacgcccacgcctccgcctcgacaactatcgcctcgcccccatcacattcctccttccctcgtccgatgttgttcctcgtcccccgtatgcgccgccacagttgcagttgcacaaccccaagagttcgtcgtcgtcaccttctataagttcgtctccatcgacgacccccgcgccgaggtgtccaggcacctccacttcctccaggttcctattccttctctccctcttcctcttccctcttctcctctatgtgaaattgttgcagctaacaaggctcgatttgattgtaccaagaatttatatgtactcgtctctctctctctcagggccgcgacatacatggccgcatttacatgaacgagcagggaatcaatgcccaggtaaaacaagcttctgtttcatttctttctttcttttcttatatcgctctagtgcttccaccaacatggagtactacggtatttaccatgtcttttatcattatatgacaacttgactgagactggtgacatggtaacatgaatgaatgatgattgtgtttagtaacaagcacatgtgttgcttaaggtccggcttgatttagattattgccgtggactctctactcgagtatagtgataaattaaatattttataaaataaacttaactaataccttaaaataactggtataagcaatgccgtagaagaaattttttaataaacattacttttagatttttagaagcgtggagcaaataatatgtttcaataaccaggtgaataagctaaaaagtagattaacaacaaagtcaaccacaactgtgaagatgtacatatgtttctacaataatatcactgccttttaccttgcattttctcttttaagcagcaatgaataaattaacatgtatgaagaagaaaacctgaaaatctttaaaatgtttattttttagcatggctagccataatatgaatgtgctgagccctgcattacatgtacaaattattacataatatgattgtttttatatcaatttctactctaatttcttcctcttgtcacagtacagtggtccacataaagatgcggtagcatatgcagactggcttagaaaagaccatcgatttcgtgatctacttgtccaaacttcaccatcgttatgtggccatgcttttcctcgcttgaaactgcggtacaaaccatcgcttgttcaggtaagccatgctttcattctactgcacaggggaaacagaagctaatagcttacctggatacgctgatctgctttctatattgaatttctcaagtgtctcaatgaactgaagattgtcatacaggaaaaaatattcttctactaacctgctaaacttctaaatctaactgaatgtagatgattttttttacatgattggaaatacaatgtgtataaaaaaaataatgaaactgtttctttcaagggtctagatactgagcaaataatcagacgtgcgagtttctagagcttctcctggatatacattgatatattttaaaatggcctagaccttctcctgatgctatatggtggcaaccttatgcctccgagctccttttgctgctgttacatttgaatgaaaaaataactgtctatcgtactgattcctgctctggaagagatgtttattttgctgtgaaccttaactgggtttcttatattctttgggctggctgggtgcctaacggcagaacctgggaatgtaattcatttccattatctaaaaacaataattctcttggtataacaaagctggaaacaattcttttggattttgagtggagcgcaggataaggatttggtaagaagagtctatttatggaaatggcatcctgtctttcctcagtaacggagtgagtagctaccccaacttctgttccagttccattactaggcaggagtccaaagtaaatcttcccaactccacgactgcatcttccatgaagatcaggagacccctcacattctgctgcccatgagacttgcctttgtgcaccccttcaactaaactctgatctgcggtgtaaatattattaatcaattgtccactgcctggaaatttggagcttttacaagttgatgtcttagcatattctagagcaattaccctagctcttttcaacatttcgaaagtgcagtatacaccaatacatgtttttcaaatgcagtgtttcaagttttctttttggtgacagcgcaaggtccattcatgtagttgttccatcatttaagtctcttcagtttgtatttatctcggtctgtttggtggaggtgcgaactgaaaagatctgaactttttatctatactgtactaggacattacagtttgttagaaaataatccaatttactatatgaagtctctagacatcttatttcaaataaaaactcccagttggaaggaggttgttcacatcttcctttggtggaccctagcatgcgtgctacaccattgactccatcagagtggagggaaagacttgaagctagaaaatgccttgatgtgtcatcgagtgaagcagctggagatagctctggaaggaggcttttgctcctcgatgtcaggaatggtaaagtatatttttatttaatacaaacttgtatagtttagcagctgtttcctaagtactgccaaatcaacaagtgatgaatagagataagcatatttttacggctgaaaatagctattagtgctgttgtgttaatagaaaaaaaagggtttgcataacaggaggcaaaaccataaatccttgtaattggtagagtggtgctgttatgatctgtggtgtatatttaccatggctagagagagtcggagactattgagagaaaaatttccaatgtcggaagtatgtctagattatagtgtagattgaccgtatatatgtagagttgatataattcccttttagagaaaagggtgtgttttcttatacaaatttataagaaaaaactgtattttaagaataaatataggagctgtacagaaaatataactatattttcaacgaattaaatttaaaaatatacctcttttttcattattttgcgtttatatacctatgtggcgaaaatctgcacaaatatacatctttcacagtgtggtttcgcgggaccgagacggtcccgcactaccattccgcgggaccggcggtcccgtagcccagccatgcggcaccgtctcgctctcgcagcccgaaagagcggtatcgtgtggcatgcgggctgacgcaaggtaccgcgccagcggtaccgccagccagccgcgcgtgaccgctgcatggatcggtcacggatcagctgcatgcatctgcatgcatccaaccgtcccgcgggactgccgatcccgcgttttggacgggtatatttacgcaaattctccacatacaggtatataaatataaattattgtaaaaataagtatattcgtaatttttttcctattttcaactacaaacataatgtaggtttgtttttcatatatcacaagctcgatggatctgcctgttctatcgggtcactcttttgattttggactggaatttatgtttttctacttccctttttttaaaaaaatttcttgtcagattatgaatgggatattggacattttcaaggagctcagcgacctaatgtggactgcttcaggagcacatcctttgggctctcagagtcagagcaggaggtaagactagctactgtgatgtatgccacagtagagtttgttagttattggactagtttcggctggacactcctacttggtactgagtgtgtaactgtgtgtgtatgcagatggattcttcagatcctctaaatggtatagacaaagaaaatacagatatattaatgtactgcactggtggcataagatgtgatgtgtattcaacaattcttaggtaagcagatatcgacattctcactttgtggaatggaaatagtatgcatctggcgttctaataagactttctttcgagtctgtttcattcccgtacactatgttcccaggaagaagggcttccggaacctgtatacattgaagggaggagtgtccaattatctgaaggaggaggggtctgcaggatgggtggggaatttgttcgtgtttgatggacggctctccctgccaccggcaacgtacaagcctggagcaggtgatgatgatgatgaggaggaggaggaggggagaaacagaagcagttcagagctggggagatgctatgcatgtgggtcagaggtggttgagttgaggcaccggaactgcgcaaacatcgactgcaaccggctttacctgtatgttcgttcgtcgtctctgctaatgccagcaattttttctttctttctttctttcattcttacagtagatattagcagtaatgtgtataaaacgaacgaacgagtgatgaactgaagtgaagtgattatcctattaattaggtgctgcgggcgatgcgtggaggagctgagaggatgctgcggtgagggctgcaccgccgcgcctcgcctgcgaccgctgctgccatcacaccagagataccacaagtggcatctctaccgccatttggacctgggggcaccatcatctccatcctagcttactagtatagtactccatgctgccatgcatttggatggattggattggattttcctgttgtttcctgcacgcttaactgtgcgtgtagtctcatctgtcatgccccaagtctcaaatctgcgtgccttctttcagcttcagttggtaccaaagctgactcacctccacgacgaccttctcttaattttcctcttggccagcctcctctttactttcggtggattcctatgtatagtccctttattgattatgtatattttgattagggacacgtctacacggcgaccacttcatcccaagtgtaaaccctccttttcagcttctaaaaatagcaaaagaagcactttgcatggatgtaccccgactagcgataccattggaaataaggtatgaaaacagtatggaaattttgcgtgttcgtatctcaaccatcattagctgatgagatggtttatgaaaggttcgctggataacactaaacattgcacgcgcatgggatagattttacctttaattaggtgatgtgttcgattgtccaaattagtaacaaaatgattagcaaaattatgacaagcttagaatgtagattgcttgactcttcgaaatctggactgtttggaaatactgaagattttggattttactcttgaaatctagattgcttgacccttaaaatatatagtttgagaaactaaagtttatagaagatgttgcagctgccataagctcctcaaacaatacctatgcatgatgcgctcaccattgctttgcttctgctcgctcatgtgcaccaatttaatttaattttgcaacaagattgtactactagctagtaataatggagtataccaagaaagcaaaaaaatgtgttgctggtggtgaaattaatttacatcataaaactataaaccatgcatctaaattgaacttagtagagtgaactaaatccgatttttctaaattctcaacatgccgattacttaatactatctttattctaaaatgtaataacctattatcgaatgacatatattccagtgctataaatatcgaaagatcatattagtaggacttaataaattaacggaggtaatagttagacaggatggataataataggcaaactgctcaaacaatttatacctcccaagagtgggatgcatgcgtgcagctgtggaagcaagcagggagcaggatccatgcatgaatgggaaaaaggctaacttttctgaatccatattcctttgtccctgagctgaaaaggcacactttcttcttcctttacaaactggagtagtgctccaataattaattactataatgatctttgttgtttaatagggtaggtgatctagctttattccattgttgtgttagtttgttctccctaatcagaggagatccctaccacataaattaagcaaatcgattgagcaatctagcacaggtgtcaaataagctacctagctgcgtgtattaatttgatccatcaagcatggtggcaacaactaactaactactactaatcatgcacacacgatcgcaagctatctacccaactaatcctaggctactgatcgatttttttttgggtgtgttaaagccaatcaatacaatctattcatctagttgcatcataatttacggcagaccaaatccttcgcttcagctagtctctatagtattaaatatattgtcacgtaagaaaaaaaatgacaagagagttaatgagaagaggggaaaaggagatgaaaaagatgatagaccattctcatgcaagatattagttctaggcaaaaccaagtttaaaaattatgtagttaaataaagagaagataggtgattggataaatcatctattatataaaatatatagtttctatacatgatatccatatggcatgataagtatgaaaactgatagatctacattagcattgtccttagtaagtgggaggattatgagtcggtcgatctggttcatacacctacggtttatatacaattaattagtattgagctactatatgtctaataatagaaaatatatactcttaaatataagcatcttgaatattcaaacttttacgtgacataagtatttctggacaccaatataatgcacgagaatccaaatattttcatgtatattctagaattgtaaattataagtgcgtaggacgatcggagtacatgattggcctgaattagtttatgaagttacgtggaaaacagaaaagtatctagatcgatcactctgcattgggactatattccagttccagtgctgtccaaaatacatatgcatgaggacggacggtgtgacggtgatgactcatcatgaagtggcggattcaggattcccaacacttcagatggaagaaaagaattaaagccgaccaacacccacacaacccatgtgcagcgtctctctctcatcatccatcatgcatgatctcctctagttaattaaatcatgtttgacacagctttaaatctttcatccacgttgaatttaaaatttatttgttaagttatagtaatttaaaattttatattttctttaaaatgataacaaaataatctatcattttttataaacgtaatcgcagatcagatatagatttatggagatgtgccaaacagtgtatagctaccggcctagccttccatttcaattttctccgatcaaaacttctttattacaataatttactagaaaatttatcgcccaaatttgtgcagtgcgtttttaaatttacaggttgcttttatacataactcttaccttttattttcttaaatttaattataatttacatatatatagtatatttcaaaagtataattgaatttgttatacaagtttccataaatacattgcatttcatatacaagtatatatttataaaaatctataccaaagttctatattatttggacccataataataatctaatagtacaacaaattaatctctctttttctcaaacgtgatggcttatgtagctagatttttttagacggaataggactcgatatacagattttaacttatgcttaaatagattcaaagttttatatataacagattttaaaagtagaaattaatttatttgtatacaaccctagctatcgttctgcttgttataagattattatgtatgttcaaaattaactctagcacatacgcgtaaaattgaactttgcaccagagctagcctaatgcgtgtaaatatgtttttctctaattaatatggtaatttctataactgcaatgcaaacaaactggctagctcgttatttttcacgacctctcttaatatattatatataatacatagatactttgtttcttcaaactctaattacgctgaataattttatatatggaaaacaagagtctaatgaggcaaattaaattgtcggctgcgttagctctatacatttgcgcctgatgcttgcatttgtctacaaataaacataatgggttctgggggttgaaatataagagaattcgcaacattaattttgtccttgatatttattcgaatgggatttaactaatcctataaaaatatagggggattaattgttaaagttaattaccgtttcaatttttttaaagcagtgatctctttgtggcatggcttggggtgaggtaaaatcgaactaatcagctgttatacatacccttgaacatgcatgatcgaggatacatgaacgcagctggctggcctgttattgtaacatcccggcctagagtttaataggattaatagaatactcatatcaacaagttgcaacttcttttccagaagtcaatctccaaagaactccagggttaagcgtgcttggcctggagcaatttgggagggttaagcgtgcttggcctggagcaatttgggatgggtgaccgaccgggaaattcttcccgggtgcacacgagtgaggacaaagtgtgcagaaaagacatgtgttgccctgtgaggagtctatgacctatgaaaactatcagatgtaagcgggcccggcctgggggaaggcgggacatgtgttgccctgtgaggagtctatgacctatgaaagctatcagatgtaagcgggcccggcctgggagaaggcgggacgttacaaaatggtatcagagccgactctcgcggtttcacgggcgcgtgtgtcgcagttgcgcaggcatggtgcgcatggctggtgtagattggtctgtgagggcagtcttatgacctatgaaagctatcagatgtaagcgggctcggcctaggggaaggcgggacgttacaaaatagtatcagagccgactctcgcgctttcatgggcgcgtgtgagtctatgacctatgaaagctatcagatgtaagcgggctcggcctgggggaaggcgggctcggcctgggggaaggcgggacgttacaaaatggtatcagagccgactctcgcgctttcacgggcgcgtgtgtcgcagttgcgcagacatggtgcgcatggctggtgtaaaccgggagtggttacacagcatggcacatgcgctgggggaaggcgggacgttacaaaatggtattagagccgactctcgcggtttcacgggcgcgtgtgtcacagttgcgcaggcatagtgcgcatggctgatgtagaccgggagtggttacacagcatggcacatacgctggcactggacacatggacgtggccaagagaggacgttcctggcctggggttgatcgacgggggcgtcgatcactcttaagggggtgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgacccggaaattcttcccgggtgcacacgagtgaggacaaagtgtgcagaaaagacatgtgttggtttgtgagggcagtctgtgacctatgaaagctatcagatgtaagcgggcctttcctgggggaaggcgggacgttacagttatcgaggtacctttgctatatctctactccactatctgtgagggcagtctgtgacctaagcgggcccttcctgggggaaggcgggacgggacgttacagttatcgaggtacctttgctatatctctactccactataataattagttaatatattaagtgatcgtacataaatgcccggcgacctatatactccatgtctccagttagctactcgtctgtttcataatataaggtagatatgatatatatatatatatatatatatatatattctagtataataaatctagatatactaagatgtgttatatttatctaaaatctcttatattatgatatggagggagtagctttataatcacaagagatgacgcgcgaacaccaattaattaattaagttgccacactattccgatccggccccggcgatcgatcgaggtgccctcgatctcggcatagtactataccattccttctcctcattgcaagctaattaaggcaactattaagctaattactgatctactccactctttttcgagggataacggttagaataggtgtcaaataacaaataaacaagttctatgaatttagagttataataggtatcgaatatgctagttctattaagagttggacttgaaattgtaataggccagtggttgggggtgaagttaaagtcgaatctagtaacccaacaactctcttaaataaagaggggacactataatataactatgacgactacaatatagcataaacacgcatggattttggaaagcgtgtatattgaattttttagctcgggtcataagacaaggaagaaaatgttctctttaacaaactggagtctatgatgtgaccgctaagtaggagtccaattttgcttgacaagacaagtgatgataggagagaaggtggagctagactgttgcaagtggagtctagaggaagaagttatatggctagcggagtctttctaaggcagcgggtttgatgtagactcatcgggcagcttacagtgaagctgcaaagaagacaacccaggtttggaggaccaatggatagacatggtgattctactacttttgagtgacgtatatttctcaaggtgaagttttttagaataggtgtcgaatatactatttctatttggttacagtttggatttggagttggaataggtgtcgaatatactagttctattaggagttggacttggagttgtaatatgtgataaggggtgaagttagagtcagactctgttgtcgacatttgatgtcgcgactacggtatttggacagtatggggatcgtcggtgctagggtatacgcgagactgaggtaaaagagacggagacagggatttttatacacgttcgggcccctgaacggtcaggtaataaccctacatcctgttggccgaagccggtattgctcttattcatgataaccacaccagtacaatgttggggtagcctatctaactattgtcgacatgtcggtctgacgatctgactcgtagtcgacaacagggtagccttcctcctcgaatccgtgcccggtgagatcagagatagcgctttcgtctctcctatccggagacaccgtagggtactagctgtgcttatccctgaagtcgatattcggcggcgtgtcttggcgtatgtaggcttctatgttgtggcttctatgtcgattgtgttgggtgttgattgtctcatggtgggtgtccccctgtcctcctaggggggcttgtatttatatccataggtgtccccttgtccaagtagaactagggaaaccaatatggatacaatccgggtagtccttgtcatttccatgtagaactctggttatctttccttatgcggaactctaggttgtttccgtataggacatggtatatggtgggtcctgccaagatgtagtcgactactattaggtatgtggtatccataaccctaacatctgtaacttagaaactctcttaaataaagagaggggcaccacaatgtaactatgacgactacaatgtagcatagacacgtaaggagatgatgacagggtggccatgaacttgtaatggctaggtactatactgattggggaggagcgcccataatcagatacctggataggggtgtgcagaaaaagaccgagaccgagaccgagaaatttggtcatcatttcgttcctaagtagtgaaagaccgaattttgttcggtcaattcggttagtctcctcggttaaccaaatagactaaattaacaaaaaaatgtctaaatgcaatctacaatccactaagttcaataggatcaaactctaattttcacatccctacttcttctaggcatgcaacctaataagagtttttactcatacgtgcttatgattttttttgtgatttttgtgttggaaatttccattatttctttgcacatatgaaaatgttgctgaatttcagtcaggatcgagaccaagaccgaatttgtcggtcctgacatttctgcgttgaaattcgatcttcacttttcaaagaccgaaatgcctgaaagaccgaagaccgagaccgaaaatttcggtcagaccaaatgcccatcccatccctagagatgtaggcttcgaataaacttcgttaataaaaattatgtctttctgtgtcgttatctaatgtgtcttagatgatcaatgactgatatgatcgagaaggttagtcgtcgttccgttatattgattggccttataataatatgtaacacctatacgcagccttactaattagctagccttcaacatcgtccttaactctctattatatgccaaattattattttaagatttaatataatgtgtgaaattggcaggaattgacatatagattggcatgaaaatgcctacatactgctaagaatttcgtaattaattttacacatgtaaaattagaaaaataatgatataggtagagtatttacgccgatatatgttttgccggagatgaggtatattacaaaattgcagatgggtatcagatttatgctaagttggataagagagagaaaaaaacaggccacaaatggctgtattgtgatggtcacacatccaatggcttgcgcccaaccttgccgcacaccagcctccagctattgctatccagtcccgctccgctaggccacctgtggccctgtgccgagcattgttgcttgagcaagcgcgcgcgagagagagaaagattgaggggaagacaaagaagggaaacgaaaggagtggagagagaagaagaaatagatatgtgggtctcacgtgtatgggtattttggtctatatgatgacagaagacgtgatggtgatggcatggttctaattttaaaaaattctaatggcacccaaccaatatcgcggataataaagatttttctaatatagtaaatttgtagtaaatggatggatcaaatttaccctagattagttgcttcattgtattgtctatatatagttgattataagccataacacttattagaaatgaaaataatttatcgataaacattttatatatgtattgatagtaaattaaaagtcaatactggaaaaataaacttaaaaggaaaatcaaaatcaacgctaaagttgatttctaaaatttagattttggtttgacagataagcaaaacacaaaacgatggagctctaagcatatgcttgacatagatatttggctgcggcttattagaagctttggcatgaggcagtagagattctccgggaaaaagaaaaatcaatgcagcattttgagctagctagctagctgaggtggggcatatatataagtcgccgcattgtgcagtactacatatcacaatatcacatggctagctagctgagtatcgatcagtcatctggactggtctgtacgttcgaagctagctagctagctcgtctgagaagaagaagaagatctgagctactccttctaattcgatcgccatgggcgagcaagttaagctcaacgacgacaaggtagctaggctagcgatcgaagcatgtgtacatttattatatatatgcagccagtagtctgcagataattatattgagtattgagcggtggagtgaattatgcaggaggagggcggcaaggagaagaattcgaagcaggtggaagaagtagcaccggcggcagagaagaaggaggaagctgcagcagcagcagatgcagggagcaaggaagaagagcaggtgccgccgccaccggcaccggtgatcctgggcgtggagcttcattgcaccggttgcgccaggaggatgaggcggtgcatcctgcggagcaagggcgtgcagggcgtggaggtggacatgggcggcaaccagctcaccgtcacgggcatcgtagaccctcaagccctctgcgctcgcctccgccacaagaccttgcgcaacgccaccgtcatctccccgccgccgcccccaactagtaccgaggaccaagaccagcaccagccatccccgcggccgccgctcgtccattcgcaggtgagcgatgtgacgacggtggagctcctggtgaacatgcactgcgaggcctgcgcccagcaactgcacaaaaagattctcaagatgagaggtgaggtaccgtctgcttgagccttgagatggatcgatcgatatattatagtaattgactagcaacttaataattagctgctcgtgtactcgtgtcctgcgcaggggtccaaaccgctgacaccaacttgagcaccggcaagctgacggtgaccggtaccgtctcaggcgacaagctcgccgagtacatccaccgccgcacaggcaagctcgccacggtcgtcgtgcccccgcccccaaagcccaaggaggaggaggaggagaagaccaacgacgacaagcctcctcctcctcctgcagccgaagctgacaagaaagatgaggaaaataagccggcggcggaagacggcagcagcaagctgcagaatgaagcagagggcaacgccaacaaggaagcagcagcagcagcagaggaggaggcgcccgaggaggagaaggcagcagcgattgcgaataataagcagcagcaggaggatggttcggtggtggtggangggttnnngncggaggagatgatgaagnggatgcacttgtactggncgacgtacgggcacggttacacgagttactaccaccaccaccaccaccaccagggcggtcatgctcacccctgtgcaaatcttcactcgtgggtgcctccaccaccaccaccaccaccacctcctcctcctgtgtactacagcagctacgtcatgctggaccgaccgccaccgccgccgccgcagctcttcagcgacgagaacccaaacgcgtgcgtcatctcatagcaccttaatttccctatgaaacgagacattggccttggctacgtaccagctgctgcgatttaatgaacccaggatttcgatgtatacgatacgtactctctcctattcgtatgtagtctcacgcctattagttttacttgacatccatctcctatcgatgtatccgcttgcccgccgccgctcctgcccctcgccgcccgccgcgggagaaagagagaaggccccacagtgggtcccacaaattttatttttacgtgaatgataaatgggtcccacacatactttctaattctaatgtcacctaagtgccacgttaacgccacgtcgaataaagatcaagccaatattgccacgtaggcaccacgtcagtaaaatcatcatccaaaaccatcgagagggagtcaaattgctccgattttaatggttgaggggtcgagatatatattccgtattattgttcaggatacgaatcagcttcggcaacttaataagggagtcaaactgaacttatttcgcaggacaactactcttcaaggagaggcccaaatcaagcccaattgggggtaacaaaaccagctgccgctgcactggctggagcctggagggggaagaactcagaagaacaggcatcggcgggcttggttcggctgaacctcgtcaatctctattccttccacactctctcttgttcctctacactgcgaagcttccggaatctagaagcttgtatcctctacttcttcttatccaatctgtttggtattttttttcatgagattaaattggatttgattgctcttgagataattgagttgagaaacgtcaggaagcggaagcggaagcggtgtcgagctgtatggaggatgcgacgtcctgaatccgttttcaccggcgttcccgcgttgccatcctattcctagctcgtcgtcaccctgtcccttgtacgcagctagcctaggcgaaggcaagggcgacgccagagcagtgagggtgcctctggaggccgttgctagctccactggatctgagcccctcggtggtaatcattctccctcagccatccatgttaattgctggacagacagggccgtctataggaatttggggcctcggggtgaaatgcagagtgggacctataatttaaaaaatcatatctaatataaataaaatatattttcacttaattatatagatgcaatatgtgttctaatattacgaatttacgatctataatctactcaatcactatctaatcttacccgtctaagcctccgaggtcgagctgttgagggtcgagtcgacgatgatgagcggacgaggaggagaaaggcaggagctaggagacgagacaaggtagcaaggcaaagccatcgccgctgccgcttggagcgttggaatcgcaaggagcaagttgtatcgccgccgccgcctcaatcgccgtgaatggaattgggatcgacgtctcgtcgtctcgatctctgaaatcggcgccacacggaattagatcgctcagcaaccaacagaaggcgaaatcaacgatcgcacaacattctcttgaatttgggtcaggcctaccattattgatctacccattgggctattgcctattagctgatattgtgttgcattactatagctgaagtggtccttcatgtttatatggggcccccaaaaaacgagggccctgtgcgggtgcctatttggcacatgcccatcgacggccttgtggacagacaatcgagcgacaattaagagcactaatcaattaattaattaagtttctcatggtattaagctacgagactgcggcagggcccgcgatgtggcactacggccaccgacatacgtattgctctcttgtcattcgaaaacgtccggagagggctacccgtcggacgtccgatgctttaggaaaaaatcggacgctgacgtcagcgccgatttacgtgcaaaactacttttaaactgatttttatcttaaattacttatccaaatcatgatccgattacaccattaaattcgttgcaattaaatcttcaaaacatggatatattccgatgaaaaaaaaagcttattattgaattatttttaaatgttgcacggtgtttcaccaggtatatcggaattgtttcactaagtagatcgaaaatgtttcactcgtttaaatctggtgttgtttcactttatataaaaacaatgtttcagcaaatagcgaaagaatgtttcagtttactgcaacattagatgtatacatagtgaaacattataagtacactaggtggaacatttttcggtgaaacaaaaaatgaaacaaattttcttaataggaggtttccaaaatatgtgggttttttgttgtaatgaaatatttcagttcactgcaacattagatctatacatagtggaacattgtgagtgcactaggtgaaacattttttgtggaacaaaaaaacaaaccaaattctcttaatagagggtttccaaaatatgtgggtgatttattgcaacggcgcgttccactgcaacatttgatccgtacacatttgatccgtacacagtgaaacatcatgagtacactagctgaaacattgtaaaactactggttgaaacatcaaaagagaccacatgcaacattaaaaaaatcaataaaaaaattaaaatatttttttgttgaaatataatcatgtgtggtcttgttgtaaagatttaattgtaacgaattcagtggtgcaatcagatcgtagattagataaatagtttacgataaaaaaatcttttgaagaaagaagaaaagaaaagattctttgcatgcaacatgctgcagtggcagacatcgtccgatttttctccaccccgccggtcatctaagtgtgagcatttttgaaaacgtcccagtcgtcacttggtcttacgatttcgtcacaagttcgcgct

SEQ ID NO: 48080 - DNA, 7995 bp, Oryza sativa
gtagaaccgttcgtatctcatatatttctgagaaaaaaaaagatttagctcccctctgtttctctttagcaaaaagaaagaatagaagaaagaatagaagggttcaattcgagttgatgaacaacaattggttatcatctttcagacaaattacctcagttgaggagatacatgagctagtgcaattgggaggtttgctcaactcactcagaatgttgatgacatagtttggaactggactgaatctggaacatatacaaccaagagtgcttatatatatatatcagtttgctggttcatacactgcaattgattttaccacgctctgtaaagcccaggctgagccaaaaatgaaatgttttggttggcttgtcctccaccaaagaactttaatggctcaaaatttgctcagaagatattggtcttgtaattggatttactgtttgtgtacctccgccttcgaagacaccaatcatctgttcgcggattgtccgtttgttaaacaagtatggactacagtatgtatgtggcaaaatttgcccctagctctcaattcccttccgtcccgcatctcaacctggtgggatgagcttaaaggtgcagaaagagaaggtcaaaaaacgctcgctcgcggtgctctcctgacaacttggtgaaacatttagctagagagaaatagtagaattttccaaaatttagctagctcagaattgtcagtagcatatcgggtaaaacaagatatagatttgcgcaaagtggctttcaggccaccttaatttctccttttgctgtaactcttccctaggtcttcctgggtggtttttgaccccttaattaaattccggcagatcttctgtcgtcattctcctaaaaaaaacttcaacagtataatttcatttttttcaaatatttgcggcctatggacttgatcactattttttttaatccctctatgatcggatgactccagtacacgtcaatattttattttactcccttcatgatcggatgattccaatacacatgtcttcaagtaattgtaaaaaaaaaatactgaaagctataggcccacttgtgaagatcatgggttttaatcctatacgtacgtgaggttttctaatactacatgtagtaaaaatctaacaaacggaaaatgattttaattaatgttgagtgaaacctgcagtgcaggactacaggggcatggtaggattacacttcaagcaaataatttactccctacttaaaaggtgtagatggatacatcgtccaatttctatgtatagtactgtagataatttacttataattaatgtactatgccagaagcaagatcttagtgatcattttattgtactgcattttgaaaagtgaggtgggtggtgtcaggggatgggggtgggggtgcatccgtgaagagtgcgttttaattatggcataataacccagatgcgctttagcgcattcctgtatataagagtatacatgcatgtggctacaatggagacagtacaacaatttttgaagatgaagtaggaaaatatagaataattgaattgcaaatatgaaaaatcaaccatacatatatgtatgtagctagattacgtacagacagtacagatgaattacggatataattataaaaaacaaattaaaacagtagatcgaagaataataaaatatattgcaagggtgcatgggattaaaaatggggtgatcggtaggaggaggaggcgaaggccttggcggcagcgcccctgaggatgtagtgatggtagatcattgcggcggcggcgccggcgaaggggcccacccagaagatccagaggtgggaccaggccttggtggtgccgaggccgaggacgagggcggggccaaggctgcgggcggggttgatgccagtgccggtgatggggatggtggcaaggtgcacaaccagcaccgccaacccgatgggaagcggcgccagcaccggcacgtgagagtccctggccttccgcttcgggtccgtcgccgagaacaccgtgtacaccagcacgaacgtgcccaccatctccgccacgacccctgcccccgccgagtagcccgccgccagctcgttggcacctccgccgtgccgcgcgtactgcccgccaccgtgcatcgccctggcgagccctgcgccgcacacggcgcccacgcactgcgccatcgtgtacagcgccgctcgcggcagcgacacccttcgcgcgagcaccatggcgaaggtcacggctgggttcatgtgccccccggagatgccagcggtgcagtacaccagcacgaagatgaggccaccaaaggcccaggcaatgccaagcacgccggcgccgccctcgcccgactgccgcttctcaccgatcacggtgctcacactgatgcacaccaacagcagcgtggctgtgaactccgcaatggcggcgcgatacagtgaccacttacctagctcgccggtgtccactagcggcgcgggaggaggatcctggtagtccttaggattgctgccgctgccgctgcctgcagccattgttgctaacaatattgaaatggaaatggaatgaacctagctaacctagctagctagaacgatatatatgatgcagctgagtccaattgaatgatcgattgatgatgtatatatatataggataccttctctagggactggcatttgatagacaaaaacaatttcaaaaatcttttacaaattataaaattctcctcactcgctccaccagcatcctacaccgcccggcctcgctcgctagctgccaaagcccaaaggcacgagcggcaccggtgagaaccatcccctcctccgattctctccctctcccttccacccctcttctcctcctcaagctagcgacagcgaggtgcccctgtcccaccgtattccacatcttcggcagctctccgctgtcagatttttcaccattggccgtcgactcctaatcagaggcctcgctttgcccctaccgtcaatgctagcccaccagtctcccctattcctatggctttggcatctcactgtctcccatctcccaccgccaccatccggggccctaattggtcgaggttgtcaccatcagtcgccgaagttcatcaaagtcatcagagttggaggagaggcccattggagtacgaatcgcaaagtagatctgaagattagaaatttacaagattttgtctctattttcctttcgaggtttagtaattttgtatttaataattgacattcgaaccgtttatcctcaaattttgatctgtagttctttttaccgaaaaagttagaaattactagtacttcaatagatattatattatcaagagcgttgctcccatccagcaacttgtaccggtaggtactagtaccggaaggtacagagataaatccatccgtccatgttagaagggtacgattgaaaaacagagaaagtagtcgcgccccctcttctccttttcgctctttctcgtttcctccctccgtgcggcaccgctttctcatctaatctcttttttttcctcccctcggcgagcgcagccccgcccgtgcgaagcccacctgagccacacgcaggctcgccccaaatctgcccgccccgcatccacgctccggccgacggaagcaactcgccgacgccgccgcttcctcccacgaagcaagttgccgctgcctcccacggatcccgccgcctcccgcggatcaagtccaggccgacgaagcaagtcgccgacgccgcctactcctctcacggatcggatcggatgggaaggggagatttgctcgccgcctactcctctcacggatcgaatggcaaagatttggtagaaaaccctatttccctcccctggacacttctacgcgaaaagacaaaattacccttccaccactccaaatattctagtaccgatggtacccgctggatgggagcaaatttgtatctggaggtaccacagatttttcaccatctgattgagctgattggatggctcagatttggtaccggacagtaaggtgcctgttggataggagcaattaattgcccctatatattattcctattaccatagtacgacactatatatgatcatactgctagctggatgcaaaacgctccatccatttcacatgtccattttctttatggtttccgtttcaaaagttattgggaagaagctgagaagaatcaaatcctctttgcttattcgtgaaggaatacatatacactgaatttataattagttatgcacatacagtatctgttggtgggatcttggatcttcggcagttttgccttctctttaatttaattaatttcagatttgctcggatcgatcgattgctttgataccggtgggcataaagcaccatttccattttacaaagttgattcatgcattcatcagtattgttatatcatgtactaaactacaatttctttacagaggtaatcgatctgctctttcttccttcctttcctttcttaatttctttcaatttctcccgtcaaacccgctttattattgttctgaaacatccaaaattaattagcagtaagtctcgctctcgtcgtgcactgcaaattcgatgttccacaattgacagatataacggtattagcatggctaattcgcagcttcattgcgggatcgagacatcatcaatatatatgcaaatggaatcgatcgatcaaacgaatgtgttttgtgcttgtgtgtaacataatatacatatgcataccaagtactacatatacagaaagtcacataaacgcgcactcaaaatacacagcttacaagcaacgtacacagatgtaggcaatagtatgtatgtactactaacatgtctgtatgtgtatgtactactaagaaacaaattagttaatgcacaagctgcattaacatgacagatcaggatcagccaactcacggtcacagtacaatcaccttctgcctgcggaacggtgacagtagggagaacgaccgagaagctgcaggccacattatagcaaaacacaattagcatccatttttaccaaacgaaaacttttggaaccaactcatagaatgcactgctgttcttgccaaaatctctcgctaaggggctaaaaagaaggacaaaagtgaaaaccagatagaatatagatactagctaggtttctagtttcacataacaaatcctgccactaaattattcaaccgatgcataaatgcatttgaccaaataggttgaaggcaaccaatattaattgagagcgcgtttctaacttctaacctttagatgaagaaccagagtcatctcgcgaaatgagggttttcagcattgaccctgaaacattaagcaccagcaacaagtgttaaacccacaaacattgagtgaattgcaatttcctcttttttggaaacaaacgtgactaccaatagataggtcctaaatttttctatctttatctcgattttaataggatgccattactacttacatgatgaccttccgtaaacaaactaacttaaataattagtaaatttcacaaaagtctagatttagaggtccatgtaaccctataccatcaatggagttgctcttcaccgatagactgatagtcttcaatggagttgtaaagcctataaaataggcaaccatgcatgtgtatgattactgatgtaagtataccacctattatatatctaggaaattaaagtatccgtcaattaaccacgataggatactcatacacacaagcgaagaagctgctcttttccagcatgattaattcccctcatgttctcttaaataatccatcctcatataggatgtcctccgtttctggccacaccccctcaaattgctctgactgtgggaccacccgatcacccatgcactacaaaacaattagggggggggggaggagatcaatgacaccagcaacgatgcatcctagttcagttgacgggtgcaacagagttaccttaagctttgtctcggcttttcaagtcgaggaagagccaagcgccatcttacgaaccaaagtagcatggggagcgcagtctgcgggaggaagaatgggtacggcagtcgctggggacaaatgataaggtaagcccgtgctcatcggttttcaggaggacgagccacgggagcaggggtggggacggggcagtgtttgtgtgcgccacacgccaccaagagtggcagatgccacccacgtggaggcattcaaccttgcacaggaagcagcggatgatgtcctagatgaggctgtcggggaggtttgcccatgaccgatcagttacagccattggagacggccagaaaggcaagcaaaaatggcacgagataagaccgatgtgcaacttgcattattaggtgctacaactccattaaagactagcagcttctttacttgcgtgtgctttttttgaaaacgcaatgcgtttcatttcattaagaagagggaaaatattattcaagggaacataggaggaattaattgtgctagcttcttcgctttcatgtacccggtcgtggctaattgatggatactttaattttccggatatacagtaggtggtatacttgcatcagtaatcacataactccattgaagactagtagggatttcagtctatcagcaaagagcaattccattgacggttgcttgctgtaactaggagatctccaattcttctccttagctaggcaattgctgaatgtgaagacacagtgttgtgccatcgtgcaggcacacatgcctggatgtcacacgatgcagaagcatttttagtagcagttgtgagcatggttagagggtagatagtgtgtcactaagcccatcttgcccagcgtggcagctgggggtggacgatggggcaccgtgccgcggctgctgaggcagtgcagtgaacagagaggaggcagcagaggttgagggaggtccactgatgatttggagatggaagacagcgcaagatggtgagcggtgcagcattttgtcaaagtggtggggcaccagaggagcacaaatcaggattgctagcctgattgatggtccagcctatgtggctccaccttatctgctgagagttgtaggctaaaaatatgtggtgtattgtgttatatacttgtatgtgcaaatgtaccagcattatgtgaaaaaagttaaaacccggtgttttgtgttatatacttatgttacttgcgcgcatgtagctagtgttatgtgaaaattaataaaacctggtgtccttgttaataaaacctggtgttttgtgtaccatatatggcttaaaatctggtattatgaaatttactcataagtaatggattgttaaggggcgagtatcataccgtctccggctaaggctccgtcaacagatgatgcatcagaatccattgtacctgatgtgtggctcttcctaccaaacttcaaaagtttcctgaagccttttgattccttattacgaggtttttcatttgcttcaggggtctcctccactgaaactgtcgatactgggtctagtactcgagccctaatgctctcggcatgcacaggtgtttcagattcaactggtagtgcatgggggtaagcatgaatggtggctgaatcattctccaacgatgtcaccctagcaaaaggggcctggtagggtttctccacagcagacaaggtcaattcctcagtctcatccttcagatgctccgtcatcacctagtcatcacaagcattcttttatcacttcaacttgtggaatttaatagaacaaaagtaactgttgcattctagttgaagtcttcataaacaccttatttgtgcaaagaaacagaaaaaaaacagataaccttttagggaagccttaagtaaacaactgagaagataagcggaagccttaagtaaacaactgagaagaagataagcggaagccttaagtaaacaactgagaagaagataagcatcatacctcgtaattaccctg

SEQ ID NO: 48081 - DNA, 3123 bp, Oryza sativa
gtgcacgtttctgtgcatctgttagccgggtttttgacgatggcaatctcctggccgaagcatccttctttttatccaaacattcctgtaatctaagcttcttatctttctctagcttctttacttcaccctcaacccccagtgatacatcatccgcatttgcatcttcaaccatgatggcaggttgaatctgcatctggctatcatagtccattgctggatcatatccatatgtgacatcttcatattcacgctctggcatcaactcatcgggctcatagaaaagttggtctccagcctttgcatctgttgtcttcttaacagttccaggaagctcaacatctatatcaatggcggtacagctttctggtccaagattatcctgtgagttagacctaacaggtatcataaaggactcatcagccacactatgcatgttcttttccatcagggttggactcttgtactgtccctctgcaagaggatccaaataactcccactgtccattggcttttcctgaccataaacgatgaagtcttcacttgctcctctcctgtatcctccacctccagcttctatctccttaatatcgccatccacaaaactcctaccttcagccgagatcacaagttcgtcaccagacagcattttcctggacctaatcctcccatgggctgaattgaaaccaattgtcttcccttcattgaaatcggtagaatctcgctccactaaaagaagaggatcatcagtggttctgctttctttccttcttgctggcggtggtcctctctcagtagcaaataggtctgcgtcattatcttttgtcttctcttcagttcttagcaagaaactctggaagacattccagtttccttggtctccatcttgcctgtgagctacttcatccctgctatactcatctccaggctcaagaatgatttttctgctctcctttttctttgaactagatctcttattctttcgcttgctgtattcagtgtgtgaatcatcactgtcctcagatgctacatcagaactcgtttgtgactcgctctctgatgagccatgcttttttgacgtcacattgatgttccttatgacaactacactgggtttcttcttgcctgatcgcttgccctttttatgcaacttgtggccatgagagctctctatctctgaaccactctggccactttcatcatccaatgtttctgagtccttgctatctgacgagtgcttccttgatactctcctctctgagtggtggtacctaggatcatccattggggggtagggtggagggtagtatgggttcaccccagggtagtaaggcatgccttgcatgggatatggtggatgaattgcccatggtggatatgctgattgatatggaccatggaggtattcgctgggagctcctgagtgctgagctgtcctctgatctgtcaagcacccaagtgatttctcagatacaagaaccttatctttgcaaaaatggttatgtagaaaccatttgtgctgtacaggttgacttaaaagcatatatgaattcgacatgtttgcacaatgataagtgaaagtaagcagaaaatatttgcaccacaattctgacttctgagtaacattggttagtgaaatcaataatcatgcacataacaatagaacatcaggaaactgttttatcaaccaggcagtaaatacaagataagagtgatttttagagctttctgaaagaaagtttagttatcacaccaagcataccagctttagcagcatcttcaccatttgcatctccattcgaaatagaaagcgtttccaggttttgcttcatgttgtctcccataaacataattccagaagcattaaagggaggaaattcagaccgtgcagacattgcctccggttcaacttcaatccattggccagtttcatgctttcttctccacaactcagtgaactgtgtgcatgccttcctattgattgacaaaacaccaaaggtgtgagaataaaggaccaatacagtactcaccaactgttccagtggtaattttgttttgctctttaatggaacatatccacacctctattctggtgtaatattccagcacagactacattatatcaataatgtatgaatcaagacaggtcagctgctgctatattgatatacccaattttatggtcgaagatatttgtatgttgcaacaactatcagcattataacatgttaatagcatatgttaatagcaccagaatagtataaaagaaaattgtagtgtagtaacatatagtgatatagattaggctcctgataaattagcagccatgtgaaaaaatgtacggggtattcaaaatgggaaatccaattcagcaagcaagacactaccttgggcatatcaaggtagtaacacttacatcaagcgtgaagcaccaaaacggtctgcgaatgtgatcaaaaatcccaggttgtcaatattaaacccagccgctacagcacgcgcaaaggccatagcctgctccttacgtaagacaattttgcgagtctccagaactctaagtaattgaactctgcaaattatgaaacatgtaaagaaatggttccatttgcgtctgagacacagactttgtccaaaacaaaatacagataaagaccttaaatgttacatgtgacatgtcacttcactatatgattattcaacctgcataaggaccttacatgctccacatactgttacttcattacatggacatgcaatgaacaggtgtgtttcttcattaagtaggagcatgtattgctacacgaaaattgtctaatttaagaattaagacattaaatgttccatgtaaaccggttttgttgccagatattagacaagtttaggcaacgtgcacggaaaaggggggatattaagcatagaaatactttgaattctcctcctgagttgcattatcattctgcacaggtggaggtggttgaatgcccggctgccatgacacagaatatcagaattatatggcacaattagaaaagaagaaagttttatccatgcaactttaccttgtacagaataagtgatttatccccatcaagatcgtaatttgtcttgctgggctgcaggaat

SEQ ID NO: 48082 - DNA, 5554 bp, Oryza sativa
tgccatttcccctgtacattctattgcattttaatagttctattatgcacctaactcaacagttgtgtctgatgttacattacaccaactcctatagtgaatagtttagattctaaaacagcatggcctgcatcctacatgcatgttttgtggtcctagcaagtagcgatatacgcttaattttcggttctcaataagtagtgctgaataattaggtaaccaagagaaagcttcatagatgtgcagtctgttcgatgcatgacgatgaaaagaaagaatagcaagtgctatacctccaatgcattccgccaatttttcattataatcttctacctaacgaagcacaaagaagagcatgtcattaatcatatcatatttctaatattaagcagtagtacactacatgctatagcataaaattctatacttacagatctcaatccaagattgtcaccgccctggccagtgatggcatcctcgatctgcaatatctcagactctatagtcgttactcgttccaggacctctggtgtactgacgaaacggacaaacctgccagaaaccaaccatgcaaatgaccaccacctgacaatggcatgagctatcagcaaatacgatccaaccgaagcacagcaccaacctctccacggtgccccttgtaaaccatggtgcatcaatctctgggtctacctcaagtgtgatggagtaccctccctttgcaatctgttgttgggcaaccttgagatgtgcaacgaacgggttcagcaaaccagaggctatcttctccttccgtccatttgctatcacaactaaatcacacctacaaaggaggaggcgaaacaaaaaaaaattgactatgaagtgatgcggtcactgctggagctacagccacgaaggcagaagagtcactgtgcatagcagcaagcaagcagtaacagtagaggttgagtattaataagaatgatactgctccaaattaattagatctacaacagcagttgttttggcccaggtttgtcactcgggcatttgacatcagacgctatcttcccaggtggaaggaagatgtcaactttaccatgtccggcaatcaatattcccaatggaaggaccgaacttgtaatcgcgcaaagatgaaacctggattggatcagaccacggcaccaccaccagaagaagaagaagaagatccggactgctcaccttgtgcgggtgggggtgagctggaacaccgctgaatcaagccgcgtctccggcctcattgcagagcgattcttcccaatccctccttctcttcagatcttggagtatgattggatcatcagatgctatggaccagcggaggaaagaacaaagaaaggagagaattttggaacagagcaaatgcaggttgagacagactccctccctcccagtactgggattgattggattccttgttaccagtagaagaagggaacaacgacaatagaaacagagataataaataatatcaagggcaggaaagaaaaataaatactgctagtaaattagatagataaacggcgaggcatggaaccaagagagaggagagtggtgcagacagagagacacaaggattggcttttattatcggagatggtggttgttggattagaaatgaagaaactttctctataataatgagatgagaaatgaagaaaatgtttttaagaataacgagaaacgaagaaacttcttttttttagaataacgaaaaaaattatagaaaaaaaatgagaaatggagaaactacgctatctccaacatatgtgtattggcatgaagtatccgattcagttatggatgacttaatgatgtggtaatgatcttgattataatgatgatgatgaggtggttgcgtagttagttgcattgcatgtggtagatgagagagagagagagagagagaggagaggcggtaggcggttgttgtttcttcttcaggcaggtgagggtgagcctccgggtccgggcagggggatcatacatacatacatacatacatacatactggagtgagtactgtctactagtagtattagaaccataataatactgccttccatagtttccattccatatgagctgtcgagatgtgcatctaatttcgctcgctggaatgggtgaggtgatacgtctcatcatcatcgaccagtgggcatcaattacctaacgaactgacgctacaacactctcaatcggcatataattagtagtaggagttgctatttattagttagcgaataaatcacgccttgtaattctaattctaataattctaattagggagggagtcgcctagaatagatcacaagagctccgccgtcgattgatgcgtccatcccaaaattagctgctgcgccttcatatataaacgacgaatgaattgattgattgattgattggtgctctcttttatcgatctggaaactggaatatattatatatatagagagagagagagaggggcaaacaagaagaaaagaagaagaagatggtggtgatggtgaggcagcggcagcaaaggcagccggtgatggtggtggtgatggtgtgctgggcgctgctggcgacggcggcgcgcggaaactgccgcgacgagtgcctcgccgggtgccaaggttgggccatcatctgccacctctcctgcaacagcgcctgcctcggcgaagtcggcatctccgccatgagcaccgccacaccacagtccatcacggatcaggatcagcagcatccatcacagcagcagcaacaagcacaacaatcggtctccgtgctcaagggtctcgaccctgacaaaatctgaaacgaattgttttcttgctaccattcattttcaaatcccatatacatacactgcactacacacacacacacatggaataattcatgttttctcttcaaattccattgctctttctattaattattaatttacacagcacgttccacatagattagtattgtcaacatttttgccccaaccatgtacacctcacccctaaagtaaaaaaagtcattcatttgtctaaactagtataataacaaattacgggctaccttctgtaacgaagccaacgaatcaaaaataaacaacacaaactctatacgtacgcacgtctgggaagctatgcaagttaagattctggcagccgtcgcgctgaggccccttctcctcttcatctccaatccttcttcatttccacagtttcacggatctgtcatggctcgcagaagctatcatcccagtgaactgagagtgcgccaaagcagctataaggccttcatgtgcctggaccgtgttctgtgattatctgacaagctccatagctccatcgtctgcacaaatgacaccaaagaccatcaatcagttgccattccgacggttaaaagtcttttggacacacaagacatattatcgaggaggagcaatttgtctaagaaattaatataggtagcactttcttaagacatgtaatatgtgctcggctatttacattgataccaccagggcggtcaatgctttgtgacttaatagcaagaggaaaatagtgtacttgtctttaggataagtgaagccatataatactcgtcagtgtactagaatatcacgttctctctctctctctctctcactcacccttccccttaatcccccactctcgctccaacacacagcctcctcccccccccccctccatgttatgataggagagaaaagaatgtgagaaaataaaccagtctctaggctcttatgaccatggcaaaaggtgttcctatctagcatgttggcaatcgcagaatgtcaaaaggcagttatatgtgtaaaggatttacctggtaaccaccaactatcagaacattcggatatcttggatgaaatatgcaagactggtattggtttccatgagatcttaactcatggatgcatgcgcctgatgctaccgaccaaaccttcacagtatcctgacttacagatgccacacgttcacccttttcatcccaacagatgcagtttacctcattggtatgaacctaactcaagcaaacaaaacaatgattgattaccttgcgttgcaaaagctgcataagatcaagcatcccatatgtattaccttaggcagtgagtgcaaacttgcctccttttcaacatcaacaatattcacaatgcttccagttgccacagctaggagctgtccaatttgaggctgaaacctgaccctaccagtaccaccctgtttcatctgtaatgacatcaagtaaatatcattgaattggcccaagtgtgaacggtttacaaatttcaaaggataaggaaccaaggaccaaccctggagatacgtgaaactttactttgaccaattttccagaaacaaatttctccattgtcgtcacaagagcatagaacctctgtagatttcgggtgaaaatctacagaggttacatgggaactatgcccatgaaaagtctgtacagcaccagttcgctggaaaaatcgagaacatgtttgacttaggttaccagcaaaacagtaaagtgtgatttgactgcctcatagtcaaccactagcatcatgaaatgaaacaaattaaaatcaaggcatttgttcacagtacatggattggcacagaactacagtgacgtcacatgcgcatttactatgcgtgagcgatagcttatggaatccatgacatgataagaaattccacgggaagtatcaaatgacagcttacagcagtactgtttcagattcttgcatatagttttgcatttagcaactagagatttctgcttcaatatcaactttcaaaactaacagtatccctgtaacaaatgaggcacgatttacatcatcaagttgggttatgcacaagagaaggtgttcatgtgcagcatgaaagatacgatagtactctgacagacctcaagtgcttcacaatgttgtataaatatctagataaaatcacctacagcaaatcttgggtcataacaactactacgtaactcccatgtgggccatcggttaagattcagatagatcaatatagagagatgtggcagtaactaaaagagcctgttcttttttaaaaatctgatttggcagcttatgcgatgagtgccacaatagcacccatagaaaggtttgtgatagaaaattccccaaaaaattccttgtttgcaagagcgagcttaaaaacagtaatatacatagtaggtgatataggtttgcggtgctctcttgccacagccagaaaataaaagtttacgatgcaatgtcaatagtcagctctgaaatgaaccaaaaaggaaagtataacttacctaagtaagaaaattactatagaggagaaaaatagatagataaaagactaaaaagaaattacttcgattgcattccatagtcgaacagttccatcagaagatgatgtagctaactgagttgaattcggtttgaatcttatatctgtaataaagttcgtatgttcttctattttagtatccatgttaagattgtccatattccagaggaaga

SEQ ID NO: 48083 - DNA, 2935 bp, Oryza sativa
atttaccctttaaggaatcctgctctgaggaccctttcttcaatgaagcaaatatgtcccgcccatctccatcatcatttgacaaaaatgaatcaacgttttcatcaaaatcaacaaaactatccagattatcctgtcaataacagaagttactcaagcacagccaactgattgccaaaaactgataacgttgatggaagagcacagcacataccatttgatttgaggatgaagcaagtccactggttccatctgcaccgcaaattaatgaactcttttgtacaatgttcatgttgctagccactggtaacccaccaccaggtgtgtgagtggaaggagttgagggtggggaagggccaacagtatttcctgtgcctgtactattagctgcgccggaagaggttggtttccgttttctagtattctggatatcaagaataattggaacattcaggtatcgcccatatagagttagggaaagttgatattatttgtaacaagctaattagttcattcaacctgttgcaattgctgctgctgctgctgtaattccataagacggtgacctgagggctgctgcatttgagccatcttcaactaataggattgcaaaatagtgtgtgcagttaatgaatacatgcatacagtactaaaaaacgacaaaaatagtataattacccatagaatatattgtgttgctagaacaaggtgaaaatgaacctccagaattgttctcaattagaaattatcacattatcagagaaagcgaatatctaagccattgattttgaggtgggtccataagttaaaacaaaaaaaaatactgaaattcggatttagattttttttttaaaatacaagataaagagctaatgtcaaatacaaagcagggaaaactgtaatattattacaaaataaaacaaaatggccagtttaatttccattcaaatatcaaagaaaatatcctgagtaattataacacagaacaaggaacagaaagtgaaccactaacgtagtgttcttaattgaaacaggtgaatgtattgatagaaccgtagaataatatgaaagcaaaacataggtcattatggatatgcaaacttatgtttggacatgtcattaactcttaaataaagtttctcagaccgattgcatactgaccttcatcatataatctgattcatctggtcgaacctttggtgaaccagatggagctggagaacccattctagcaaggtcattctgtgattgtgcttgagcaattaattgttgttgtggcgataaaagttgaaattggtttggagatgccatcaactgcttctgcacacctaaatttgaccggagttggtcaatacctgggaccttcagcaggcaactagtaggtaagcttttcttcaaggaaaccagagaagtatgcaagcatatggaaagggatatcagcaaactcactgtaagaggccagcctttcagtggtacactaccaacaccttgatttaatcctaagtagaagcaaaagaattataaggaaaaatgtgccttccatcatttactggaattgctaatcaaacgctgatggccacatgctaactagctacaaataaatcaagaaatccccaagtgtgaactttggggctaaagcttatcttccatctgagaatactaggcataaaaaaaaagcgcttgtacacaaaacagatttttatgggaatgtcatgcacctattccataaagtccaaggttaccatctgttttcctcatagagaaacagagagaatagttgtgtgattgcaattaactcaccagtggaaactaatccagattttggttgcatcattcctgatccatacaaagttgaagggtctgtaggcattgatctttgtgacatggcagcatcacctttcatgtccttgaaaatggttggacagagagtaagaagtgagaggcggtacataaaccaatggagtttgagaagatggaagggtattacaggttgctggtttcttgagtggatctgctgtagagctgacatgttgaccgaggcaccctgaaccagttgtctgaatggcgagagttttcatgaggaacggtaatctttgagatggttgctggggggaagaagaaaataaagttacccagtttggttagttgctggtttgaggagagcaatcctgttagcgtccaggagttggtgggaagcatcggaatcggtgggattggggttcctcattcggtcttgcatcattttagaagcgaggacagcagaaacatcagagttgagagcatccatagcagcattgagagggggatctcttcgctgctggtgggcattctgctgctgttgcagtagctggagcctcatctgctgttccctggatttgatctaaaacagaggcaagagcattagagattttgggacccggcatgattgtgatgatgattttctgttacgagtagtgcgagaatacgtctatcggaataggaggaggaggctgaggctgaggctgtggtggtttgtctcttgttcttgcatcgaagatgtcccagaagatggaccaccattcgaagaggaagcctccaggagcatcgatggctgcgttccgttggctcagcatcaatcaatcaatctatcaatcaagagaagaagaagaagaagaagtataggatgcgtgcgtacccacgggatcggtggcgaccttgccctcggtcatgaaggccttagcggtgttgtgcatgttgcgcttcaccaggtagtcgtagatgtacacatccagcctggaatcgcacgcatccatcagatcagttcagttcatccacacccccaaatcgatcgatgaatctaatcaattccgcatccgaaaggaggaagaagaagaagaagaagaaattcacaaaacacgcacatcttgtctgcctcccaattgctccgcgccatcta

SEQ ID NO: 48084 - DNA, 3404 bp, Oryza sativa
gaaggaattcctcctttactcgacctaaacaaatcacaaccatccgttttcattaatgactaatctccaactaaactccctatcaatttccctcgcctttaccaaacaagatattgagattaaaaaatcaaatttctatgatattgggattaaaaaatcaaatttctatcttaatctcatcatcaataaactcctaatcccctttgctcgagttgccaaacacgccgctactactcctataagtgtagttgtggtttttttttccaacatttcaccgtccatcttatttaaaaaaattatagaaaaatttaaaaaatagtcacacataaagtattattcgtgtttttattatctaatccgtacctaattaaaaatgtgaagcttccagtagtttttggtcttttttttctattttttcccgattacgttgtcggttttttctccttctgaattttgttcgctgttttttttgccttataatgatttggtatttttgtcatcctattttttcccatcgctgggttttcatgttcgatcccgccaccgcaggccaaaccctagcgccgccgcaacgtcaatatgtatccccgtgcgtttctcaaattaattgcaaaaatcaatttctcaccccctcccccattattttcctcatgatttccactttcaattcgactttaatttgctggatttaatctcatttgttgatgatggccggccggcgagcttccctggtcgtttttatcacgagttttgtggatttgcttcgattttgagaaaacgaaaataggagatcgaggggaataaaagccctcaatattttcggagttcgagaaagattcagtcggatttgatggggagtatcggctccggcatacgggcacgggactatcttccggtcttccggatgttaaagacggtagtcggctatgcgagcagggcctgtggctccacttgtgggcatggccgaagtgaggcagggcaagtggagggaggtagaactgagctagggctgaaatggaaggaaagaatgagcttttggccttaaaaaagaattgtcattaactttttcagctataatgtatagcaattctaatgtttcaatttatttctcacctcctaatagttgttgtatcactgaaaaaacatctttgcatgttgcaacgcatgagtattttttctagtagcaacaaaatcatgtacggttttggaacatagatttttttgaatagaacgaacgaccgtaacggatgttggctcaatccgagggaaattatgtggaagctttgcatcgattactaaaactagactttctcaatttagagacttaagagcagaagaaaagatggaaaaattcaaccatctcccaaaaagagatgtggcaatcttaaagagaaaattatctaccaaacaaagatatctcggcgggatcaaatatatgacccaattatgtatatacgtaagatttaagaacgaggtgttttaacgtaaggcagaaggcgcgaagagcccgggctgctgctgtaggatttgaaaagggagtcattgtatcgttgggtcggaggtttgctccagaaaaattcggaacaaaacgtctaccgcgttgaagcccacagccccatggagtccgattcaaccaggaggattacgccatgctaatgtgccggttcttattcgaagaaccttgccttttgtttagcttgagactcaatcattgtggctctagtatgaatctaaggttttaattgaattgattcataggatcgcaacaagataatttctaccagaaaactaaagattcaaagggttaggtttttctttttttttctagggtaataaattcaaagttataaaattcaaacaaagatactaatcataaaaaaaatcaaataaaacaaacagtcaaacattagacataaatagtgtaaaactgcagtccatctaggttagtaggattgaagcacttgtgcctatcagcatatccgatgaatatatttatctttttttaattgaacatatatattactcattattgtaaacacaatattatactttttctgtccccaaatatgttagcttttatacatggatctagatccgttgcaacttctctgaaaatattaatattactcgagtggtacttctttcccatgtttcaaatactcctgacaggacctaaataagttattggacattctcttaatggtttctattcagatgagcttattgacggtaccttttctagaaaaggtcaataaattccaaaatctatttcgccctcgagtagcaacaaaagttatgcctagattcgtgtacaaaaatgaacttgttttcggacaaagggagtatacctttgttttggcttccatggcattttacctgtggcttaagattagctaggtatatgatttcaaagtcacattagtagctttaattataaacagagtagaaaactttgaatctacaaaagacaatattggttgtagacgaggtcacccgcgaatgatacaggagctagctaggttaagatagagataataaacgatataatgccaccatggtgttaattaataggcttgatgatggcaatataataggaggcagaccacttagtgatggttgagctaaattgtggtggctagaattggaatgagatatatattttttttattacatttatgttattctttcttttcacacaagaagggccgctataaaagggagagttaaatgaccctagtgtgtgtgtaaatgtgtttttaagttgttggggattgatgtgtgttcccttgttgacatatacaccttctacatgcaatacttccatgtccttttatcttcactaggctaaaaaaagtaaagaacataggccaatcaaagctcttgacgcttggtcacattgccacccctcctctttccatcgccgagttgctcctcatattctctccaaaattaagtatacatcacaagttaggggcctccatttggtgttttcatacgatcgagggcaatgccagatcgtgagatttagctataatttatcaccctctttcttggctttcttgatcatcaccgtgttcccaaatattacagacataagttggtggtatcgattgcatcatgggatagaattgatgtctacaattttggctcgataattccatcctacgcaatggtaatagcttgtttccttattgttcttgtttctttgaatatcaaaacttattattgcatagcatctttcttttctaacatggtgttaccttgacttctgttgaacattccacatattgttagacaaaaaatatttgacaaataatgcatatgagtcgaatgcatttattacgctatgtataacaatttgtaccacaaaaattcatgtatgtgcattaacactttatgatgca

SEQ ID NO: 48085 - DNA, 6015 bp, Oryza sativa
tttaaactacattacaggcttccaagagtcgtttcgttgtgggatctcatgtctgggtcgaggacccagatgaggcttggatggatggcctggtagaggagatcaatgaaaatgatctcgtagtaaactgcacttctggcaagaaggtcaccattaatgtgggaagtgcctatcctaaggatacagaatctccccgaggtggtgtggaggatatgacaaggctagcttatttgcatgagccaggagtactccaaaatctaaagtccagatatgcactcaatgaaatatatgtaagttgagctcccaacatatcatctttagctttattattattgtatccaatgaaaacactttcgcttatttttataacttcttccatgaacattgtttgtctcgacattgctttaaaaaaagaaaaagaaaaaaggacctatactaagctggtgtttgaatctcctgaagatgaagatgaagataaagattaagtgttttacgcaaaacgaggtggtaataacgtgtgattaattgagttttaattattacaaacttggaattggattaatctgatattttagaacaactttcatatagaaagttttcgcacaaaacacaccgtttagcagtttgaaaagcgtgccagtttacccaacttttgttgtagattcgaacagggccttgatacaaattctacactaccatattttggtgttagcaccactaaaataatcagctcaatcgaaactaacccatatcaaatattatcattgacttaataaaaaaatccaataagataaaaaaaaactttacttgagttatctatttattttgccctaatatataagtagctttgtttcgtattatgaagtggttatatatactttagaaaaaaactctttacccttgtgagtgctgggatgtccttatagaaaattgtttatgcatgttgtgtgctaatcatcttggatgtgctggtttggttagttctccttatggttccataattcttgatgttttggacagctgcatggtctccaaaacttctctttgattatgattttcaattataatatattttataaaaataagtaaatgtttcattgcactaaagtacttttagggactaatctatacatcgtgttctagtgtctccaaattaaatgttttaaaaaattattgatagttgaagtactaattgtttgacctcaatctttgtccaaaacatcaagaattatttgaccagatggagtagaagcagattagccaaattatgttggaattctcccccccccccatattttcattcctccatcacctgcctcccttccttggtggcactgttggccaccgcctctccatgggcagcccattattccttttcctcttgacactgtcgatgattggttcatcaatgtgctgcatggttgagcaattttttttctcaggatctgcattcccagctcccattcctctctcacaaatgcgactgcgccgacggggagcacgttgtgacggcagcgaactagaaatgcatgtgatggcttgcttttccaaactaccccaccctcatcgcccaagtgtcgtcatcatctgcgggcgggaggtctccagatcttcgagttcatggcggattcaaatcagaaatggtagataaggcaggacaaaaccaaccatgcatccatgcccccccccctgtcccatgcctccactgccatctctgcctcatccatcccgtacccacgtcgaggaccaatgctgccaatgctctgagtggaagaagaagaagctattttttaggtagggggctaatcttgtctaaactcacactgttaggcccaacaatgacgaattcgttttttttttttggagtgggggagggggggggtctgctacttggtgtttacctatgcttgctaccaatataattttctcaaatgatattcattttcttgtagcttccctaatgcatttaaactcttctttcagacttatactgggaatattttaatagctgtcaatccatttcaaaggcttcctcacctctacaacaatcacatgatgggaatttacaaaggagctgaatttggtgagctgggtccccatccatttgctatcgcagatcgttcgtataggtgggttttcctcctctctcacattatggtgccttattatatgtcacatatatatggatcatactcaagtgcccctcttgtttcctgtctagacttatgatcaataatcgtatcagccaagcaattttagtaagtggagagagtggagctggcaagacagaaagcactaaaatgcttatgcagtatcttgcatttatgggtggcaaagctcaggctgaagggaggtcagtgcagcaacaaattctggaggtacgtttcgtgccactccactttttttggtgtgggtggggaggtgggggtgctgacagtagaaacaccatacaaaagtcatcccttaattaatttcattttaacattcactctcattagtggttagacacttcacattagtaacatttatatgcctaccatcaaagatattctcctttcagggctaagaaacagtagtgtaccattcatatatgtttctaacatatctatttgggtgacacagtccaaccctgttcttgaggcatttggcaatgcaaaaacagtcaggaacaacaattcaaggtaaacacacaaaatacaacacaataatagtccttcacttttctaaggtggttattaatttatctttgaacctttccatatctctctctaacaatttggttttcacatgttcgtggttttgcagtcgttttggcaaatttgttgagattcaatttgatgacaatgggaagatttcaggagctgccataaggacttatcttctagaaaggtcacgtgtttgtcaaatatctgacccagaaagaaactatcactgcttttacatgctatgtgctgcaccttcagaggtaaaagcctcgtcaatacaaccttttattcctaaatttttgttgcacccacaattttggaactaccagattttatagttagatttttactgtgggtttgtaatgaaaacatgtcatgtgggtcctatttctcatggtaaatataaaaagaagcttgtgagcatctcaaaggtttgaaacgtatagtggctaactactacgaggtaaaatatgtacactatttcttccctgaataaaaatttcaccttcaaattttcatcttctaattctatcaagcttacaaaatggctaattttgattttaccttgcacaatttgatcattgttttgtttttagtccttttgacttataacttgtttacctatagctttgatatgtgaatgttgatcaggattgcaagaaatataaattgggagaagccaaaacatttcactatcttaatcaatctaattgtattgaacttgatgggttggatgactccaaagaatacacggataccagaagggctatgagtattgtgggtattagttctgatgaacaggtatgaccaaggttttaccagcaatcaatttagtacatcgggagtagaggggcaacattacattcaacatatatttccatgtcttaggatgcgatattcagagttgtagctgctattcttcatttgggaaatgtggagtttgcagaaggaagcgaagcagattcttctatgcctaaggatgagaaatcccaattccatcttaggacagcagctgaacttttcatgtatttatttcttcactgttttagtttagaggtttacccaaaatttcctacttccatcccttacttggacatggattggctacattttacaggtgtgatgaaaagggtctcgaggaatcattgtgtaagcgtgttatggcaacacgtggggagagtatcacaaaaaatttagatccacgagctgcagctcttagtagagatgcattatctaggattgtttattcacgtttgtttgattggtaagtttacaagcaatcattttgggaaatatttttctgctgccttgtataatacatggtacagacagtaataagttataattattgttaactattgtattttcactactacaggcttgtaaataaaatcaatagttcaattggtcaagatcccgattcaaagattttgattggtgtactggacatttatggttttgaaagtttcaagacaaacaggtgcttaactggtatgcttttgcatttaatctactatttatgtccaaaatacatttagaccttacatatagaggactcttggtagatgggctttaccatttgcatatgtacccaatatgaagtatgcctgagtatgggttgggtggaactaatcaaagtttatgtatcgaattttcaaatattgtgggtcggacacttgtacagctagtaacaaaatttctggggcctacaaatatgtgtttgcgcgcgcacgcacacaaataaaaacatgagtacaaagtgacctaagtattgattgcttaaatggttagatcactgtatacttggtacaagttggtgaagttgcgatgggagacaatgtgcactctacatgaagtgttgttgtagatattgtcatatttttcttttgaaaaaggcaaacagccaaacattcccttatgtcgaatgaaaaatgcttcaaggtgttccttctgttagtgaaacatcaccttgtttgttgacagtagaacataatgctaagtgctacggtctagataagaatgtaaacagttcactttgtagtgatacgtagtggttggaatcatgagggttgtttaacttgtagcaacctagatgatttgctaagcaaatatatgctagtaaagtagacacaagtagccatatgggactaatccctgcattaggccttcgtgagacaaactagactagggtatcgcagttgtcatcataatgaagcattgtcagaaacaagagggaaacaaatttgctacctgaataaaaaatagctctaatttggcatattttacttatgggcttagtgtagatgccctaactggttgaaggtgagttttagcaacttgtgaatgaataatcatctgcttatgtgtcaaatttgaaagaagatacctcttgtaagctgacatttttttaatattatgcagctttgagcaattctgtatcaatctaaccaatgagaagcttcaacaacattttaaccaggttataaactggaaatactccactgaaagttctacattttgtttgatttaggttattcaaccactttaactttgagttctctaatcaacacatctttcattaacagcatgtgtttaagatggaacaagaagaatatacaaaagaagaaattgattggagttacatccaatttgtagataaccaagaaattcttgatctcattgagaaggtaaataaatttagagtcttatttaataccatttttatgatcaattttggtgcctatcatcaaaattgtggtaaccattaagcaagacattacagttgtaatctaatgaaagcattgagtactttgaatttattatatctctttcactataactaggaagatgacaagttacatgtcgttaatgatggttagtaattaaacttttatagcagcttgctttgtggattctaataattatgttctataacttcttgcatgccatatttgcatttcacttaatagcgtaccttcgacccacgaacctacttatgtgtcaaataagtggtaacccgctagtttccacatcgtggctcagcttgcgcacctagagatgcaagtggatagacccataaattcatttatatgtcaaattagtagataacccgcaagtcaatccgcgggttacgtactaattttgcctataagcgggtacgctggttggcccgcctgtatccctatttctattgctttttattttattttctcaagcaatacatttttatagcctacttgattttggttcatgcacacttataggtcttgtatgttgtttagatattgaaaaaattgcaattgttgatcca

SEQ ID NO: 48086 - DNA, 1048 bp, Oryza sativa
tgcttgttcgaaacatgcattggttcttgccatcgctgtaaggaccatcattgttagaaggcttgaatattgcctactaatttgccgatgtttattcttgatttactttttacttggtcttggactcctggagttagtaaaatttttccaagatccaagagggacgtttgttagcatttggcttggattggctatttacacggtaaatgcgcgtcatgcatgttctaaatatgtatcttcttttattgcaggtcacttatcaaacagatcttttcctagataaaaatatagattatgctgtaaatgaacaccaaatcttgctaaatgcttcaaaatgttcttttgtttcaagtctttttccaccttgtgaagaatcaacaaaatcaactaaattttcttcaataggatcaagtttcaaggtaaaacgatgtttgttttctcttgcctttccatcatattatgcataaccatttactcccttgatcgcgtgatctcacagcaacaactacaatctttgttggaaactctaagtgctatagaaccacactacatccgttgcataaaacccaataatgttctcaagccagcaatatttgaaaacagtaatgttctccagcaacttcgatgtggggtgagatcttgcgattcaatttatttatattcatgaatactcaagtgaacatgctaacctgaaatttgattatgttggccaccactgttaactaatatgcatgtttacaccccccccccacattgttggacaatttgctaaccttgtgcatagataagggcaacttatttagttattttgatacatcttaggcgggccggataaactagaacatgatactattcttttacatgtgtgtgtgcgcgcgcgcgtgtgtgtgaaatcttcttggaatcaaacagtaacctacatgtcacttcaatttagacagtttactacctattcttaaacatttttccttctgtatagtttacatgcagaaaaggtgcaatttcaccatttttaagttcataaaattgatttttttatcagggagtt

SEQ ID NO: 48087 - DNA, 2455 bp, Oryza sativa
aacagatgctaaaatgtaggaaaacaaagaggggcattgtacttacacttaagctttaattgccttagtttcaggtgtataaaagcaaccatctatcagaagacgaaagctggccagaccaaatcgggcggatcgatcgatgagggtgatcgaatggagatgccacggctagattatttatgcccctaggattctgggagctgaggaggaggatgatcacatggaagtgatgaggcggtttcacttgagctgtgcacgcacgggaggagcgaaccgcaagccgtgctgggtgaagcttggcagctgaaagcatgagagaaatggcttctgcgtgcatgatgagcatgagccttgttctggcttcctctgcctcctggtcatgcgagtctgatgcaactgggtgcatgtgtgtgcaagcaaatgcctccttgttcaattggagctctgggagagccagaaccaaccactgaaatctatctcaggaggaggggatcagccaagtgttcatggaatacttggataagtttgttgtggttttcattgacgacatcctggtatactcacaatcagagaaagaccatcagcagcatctccgtctggtgttgggaaagttgcgggaacatcaattgtatgccaagcttagcaagtgtgagttctggttgtccgaagtcaaattcttagggcacgtgatatccgctaaaggagttgctgtggaccctgaaatagtgaccgccgtcactgactggaagcaacccaagacagtcactcaagtccgcagatttttgggtttggcaggatactaccgaagattcatcgagaacttctccaaaatcgctcaacccatgacacagttgctgaagaaggaggaaaaatttgtgtggacaccgcaatgcgagaagacattccaaactctcaaagaaaagctggtttcctcgccagtgttaatcttaccggatactcgcaaggacttcctagtgtactgtgacgcttcgcgccaaggattggggtgcgtgctcacgcaggaaggccacgtggtagcctatgcctcccgccagcttcggcctcatgaaggcaactaccctacccatgatttggagttagccgctgtggttcatgctctaaagatctggcggcactatctcattgagaatcgctgtgaaatatatactgatcataagagtttgaaatacatcttcactcagtcggatctgaatcttcggcagagaagatggttagagctcatcaaggattatgatgtgggaatccactatcaccctggtaaggccaacgtggtcgcagacgtgctgagtcgaaaaagctgttgcaacactcttggcgtccgtggcattccaccggaacttaatcaacagatggaagccctgaacctaagcatcgttagccatggattcttggctactctagaagccaagcctaccttgctcgatcaaatccgcgaggctcagaagaatgatccagatatgcatgggatcctcaagaatatgaaacagggtaaagccgcttgtttcacagaggatgaacacggaaccctacggaacgaaaatcgggtatgcgttccagacgacagggaacttaaacagttgatacttcaggaagctcacgaaagtccctattccatccatcctggcagcacgaagatgtacttggacttgaaagagaaatactggtgggttagtatgaagtgggaaattgcagagttcgtggccctttgtgatgtgtgccagcgtgtcaaggaagagcaccaacgaccggtcggacttctccaacctctacaagtaccagaatggaaatgggatgaaattgggatcgatttcatcaccggacttccaaaaatccagggcgggtatgattctatatgggtagtcgtggatcgactaaccaaggtagctcggtttattcctgtgaagaccacctatggagggaacaaactagccgaactctacttcgctaggatcgtgagtctccatggcgttcctaagaaaattatatctgataggggaagccaattcacgtctcacttctggaagaagctccaagaagagttgggtacccgattaaatttcagcaccgcgtatcacccgcagacagatggacagaccgagcatctgtcgcgtcccaaaacgactctaaaatacatcctcgaaattatgcatagaataagtaaaatccatgtgaaagcctccaacaattaaaatgtgctaagttaaaagtcaaataaggcttggaggatttttgtatatttcataaaagcctaaaatgcgtaaataaattttagtggaattttcagagcacaaatattaattaagaagaaaaaaacaaagttaaaatggttttgtaaaaagaaaaaccctaaaagtctttttcccccccctctccccctcttgggccggctcggcccacctcccttcctctctctcctctcccccgcggcccattc

SEQ ID NO: 48088 - DNA, 25402 bp, Oryza sativa
tttaggctgggctcggggtgcatggtttgatagtagcacctcggccatataaggaccggtctccgggcctccgttgcatagcactaccgtacttccacatgtctagtgggtaaggcttagtttgtggctcagtctggttataaacaaaagtacacggatggagatggaagaagtcgggggtcgatggacatctccagggcaaatgaaggctacacgagctgcggcccagtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttctgtctgtataccgtggtggtatgtggcacgtggttacacgtgaggaagatgtgtcttgtgggtaaagatgtacacctctgatcagagtataatttattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtgtgggttcacggccttgataaataatattgtttagttctagaatcgtgtttaccaaatagctttgagcaactaaagatctttaaatgctgtttactgtaaccctaatcctttatagtgtaactcctttgtgggtgtgtcttgttgagtacggtggttgtactcagtcttgctcaatttttcccaaacctagaagaggagcccctagaagatgaaggctttggtgtctagctcgtgcctgccgtcaagcgcctgtggtcgtcgccctagtcttccgctgtttctcggttgtctttgtgtgtgctgggccttcgctgcccatgtaataaattaactatttacgcttccgcttgttaaactctgaattgtatcaacttctggtgtaccttgcctcctgggacaaggaataatacacgcacgtaaggaacgcccgttgggttatttccggtcgtgacaagttggtatcagagccacccttaaccctaggacgagccgtaggtcccaagccttagcaatattttcgaaataaaaatcctttgtatttgtgaaaatcctctagtctctctctgtcttgctgcttcgtttatcgccaaaatctgacctttaaaatgttgcttttctttttgtttttgtttgtagatggccggcagcgtcagccgtcgtggtctggacatgactggtttcgtcttggagctgcggggcatgtgcgttgtcctggggtatccgcatggagtggactaccagggcaggccgcttccggagcaggagggtgacgatgcagagccccacgctgcttgggaggttactgcagtgatcctcactggctctcccgagcggacttcgctggcagtcaccgcgggtggagattctttctccgccgcttgccagagcgccgctctcctcgccatctgcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaatctgaagatcctggagctgcgtcaagagaacctgcagctcaagaaagacctagacgcagtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcatggacttgcttcgtcgagaaccctcgtgccgagcccgcgtgtcacgcccggaaattcactagtaatttccgaactaatttgtgcataaaatcctcgtccaggaatcagccgaggtacacaaactgacaatttaatatacaaatccatcttaataataacgttacatacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagtatatgacatactcaacaagccacacagcaaatatgcaagtgcacaaggattccaaaggaatggcataatataggctcatttgcaaaagcagcatttagcaaagagttaagataagtaaaacagtagagtaattaatcatcaattttaatcaacactgaacaacacacccatgctgtacaggcccaaccatcctgaacaaccatacccggctgtacagatctaactccaaaccaggagctaagcaaattattaccaattataacatccataattattgtgaaaggtgtgagactaatcacgaaaaacattgctcaacccgcccataaccgcgggcacggctattcgaatagttttactctggccagaggtgtaccactgtacccacaagacacaaccccacatcatgtcaccatgtgcctcagtaccaccacggtacctcggaaaggagttgtgacaataccccttgcacaacataacccattatagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtctcacaacagtagctcgcgaaccggtccttaattgccatgagcacgaccttcaaaaccatgtgctcacaacccaccactaatcatattttaattaccaattaattatcataacacgattaaccatcgtgagctaccattaaatataaccataaataataatgtagtataaatgattcatcccattagtgagctaatgtctctaagcattgctaagcaattatatatataacattcagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttagaatctgtgtgacttgccttgcaacaatcgatcttcaattaatcttcttgatcacttccgacgcactcacgaaccttcgcaacgacggaaacgacaagctaacacgcaaaacgaagaaaaagactaataaaaaccaaataaacaatacatataaaataaacaaacatgtagatcataattttagatgaattatgagacttgaacagccttattctgacttcaaaagaatttattatgaattttacaagattaaatctaattaaagcccatttaaaaagaattaaataaatttaattcaatttatggacaattttaatatgtagatctttattttagaaaaatttagcaacttgaaccacctgaaacggatctacggttatttagatatgattttccgaagatttaatctattaaaagaaattggaaaaggagaagatgatgacgtcagcatgacgtcacccacggaggccggctagggttggcgacctcgccggagctaggatggtcggccgcggctttggaggacatgtacacgtagaggacgacgagacgaacccaacggtactcaccctcgaaccaaacgacgaacgacgacggccggcgacgagatgaacggcggcggcggctcagacctcgccggagatggagctccggtggccggcgacgaaaggggacgggtggccgagcttcctcactcctcggcgcacctcttggcggcggcggcaacggcagcgacggcaggggcggcggcgcgacctcgccgaagctcggccggcggcggcggcgagttggacgacgcggcgacgaggctacggggcactagagagctcgggaaaaggggcaaacgaaagaggagtactagagggtcctatttatagccttggattgaagagatcggactcctcccgcaagaaatcgatccgagaaatcaaaaactcggttttggagataaactcgaaaacgagtttgattcggataaaatacccaacgatttgctccgattcttgaggggaaagatagaggagaacgagaggataaaatcccctcaaacaatcggaagaaaagaggccggattgggtgcggatttgagaggagaaaggagcggctcgggctcggcatctcggccggcttgggcgaggccggaggttgaagaaacctctgacatgtgggccccacatgtcggcggctagagggagagggggcgggcggcgtcggctgggccggcttgggccggttcggccgcgcgcggggagaaagaatgttgggccgaattcagcccaacgacttaagggagggtttttaaaactttttcaattaaaataattcatgaaatgatgtttcatttattaaaaatacttcccttgctcaaacaattcccagaaaattctagaaaatagaggaacaagcaaagtatttaataaaattttatctagctcaattttatattgagatttagcaaattaaaattagatcttctcttttaagcttttaaaatcatttctaataattccttttaaacaacaatttataacttaaggattttaaacaagaaaagcacttaacaattataattagatcattattgatcaaataattactgaactgttctttgtatcatttaggaattgagctccgaaaaatccgagaaaattccagagagtataattaaccatggagaattaaaaaaaattaaatccatccatgctttatatttaggagattttatttcccacaattaacttcacttgtaaattaatgaacatttaatataaattctattattaatttattaaataatttataaatcctgaaacgaaaatcaggatgtgacaccgcgcccgtggttccccaggagggggaagcctccggcgttggcagcacggaagatgcgctgttgctcaccttccgtcctggcccgtcgcagcggtagacgagcagttagtaggcttgcgcgtgtgttctttctcgtttgtcttcttgttggagttgtgtggggcatggttatgccggtgtgtggcataactgtgtcggagcctgcctttattttatttgcctaagcaacttgaactttaatgaaccaatttaatagcagtaataaattcaagaattatggtagtcgtgggtggttagctttaattgtcagctctctctgtttgttggttctgtgtggggttttcagatggtgatgaccaggagaagtgctagtaccggtgatggcaaccaacctgaaggcagcaaccacaaccaccagggcagcccacctccacctcctcctccgcctccaccaccaccaccagataccaacgccattctcacccaaatcctcgcccagcaggccaacatgatgattgctttcctccaccacctccaaaatccgccacaacataatgctccaccaccacccccacaacactctaaactcgccgagttcctccgcatccgtccacccaccttctttagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggctcgcttcactgccgctttccggagaacccatgtgcccgccggagtcgtggcccttaagaaaagggaattccgagagttgaagcaaggcaaccgctccgtgatggagtatttgcatgagttcaacaacctggcccgttacgccccggaggatgtgcggagatgaggagaagcaagagaagttcttggcaggaatggaccctgagctgtccgtccgtctagtttccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcgtcctcgcagcagcaacctcgctccgcgccccgacctcaattcgtggtgcgcgtcccacagccgcagcaacagcagagtcagcaagggactcgtgcgccccgtcctcctacaccaactgtgcagcctggtcaaggccgcagggacgctcaaggtccgcagcgtctgtgcttcaactgcttcgagcctgggcactttgcggataaatgcccgaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcatcccactcgttcatatctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattcttctagacaccaagaacttggatgtgatccttgggatgaattggttggctcaattccaaggagtagtggattgcgcgagacgcactgttactctgtaccgagggccggaacaaccggttgttttctttgcacccccaacctctgtcagaagttcagaacttcatcagatagtactgtcagaaatccccatcgtcagggagttcggagatgtgtttccggaagaactacccggtatgccgcccaagcgagagattgagttccggatagatcttgctccaggaaccactcctctgtacaagcgaccctaccgtatggcagcaaatgaactggccgaatttaagaaacagttggaagagttaaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgattagcttaaaagtgccacggtattctccaagatcgatcttcgttccggaaatcaccagttgcgcattagggaagaagatattccgaagaccgcattcaccacgcgatacggactgtatgaattcacggtgatgtcattcggtctaaccaatgctcctgccttcttcatgaacttaatgaacaaagtgttcatggaatacttggataagtttgttgtggtgttcattgatgacattctgatatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctatggaccccgaaacagtgaccgccgtcactgattggaagcaacccaagacagtcactcaagtccgcagtttcttaggtttggcgggatactaccggaggttcatcgagaacttctccaaaatcgctcgacccatgacacagttgttgaagaaagaagagaaatttgtgtggagcccgcaatgcgagaaggcgtttcaaactctcaaagaaaagctggtttcctcgctagtgttagtcttgccagatactcgcaaggatttcatggtgtattgtgacgcttcgcgccaaggattggggtgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcaaaggagatggttagaactcatcaaggattatgatgtgggaattcactatcatcctggtaaggccaacgtggtcgccgacgctctaagtcgaaagagccattgcaacactcttaacgtccgtggcattccacccgaacttaaccaacagatggaagccctgaatctgagcatagtgggtcgtggattcttggctacgctggaagccaagcccaccttgctcgatcaaatccgcgaggctcagaagaacgacccggacatgcgtggactcctcaaaaatatgaaacagggtaaagccgcgggtttcacagaggatgaacacggagccctatggaacggaaatcgggtatgcgttccggatgtcagagaactcaaacagctgatacttcaggaagctcacgaaagtccttattccatccaccctggcagtacgaagatgtacttagacttgaaggagaaatactggtgggttagtatgaagcgggaaattgcagagttcgtggtcctttgtgatgtgtgccagcgtgtcaaggcagagcaccaacgaccggccggacttctccaacctctccaagtaccagaatggaaatgggatgaaattgggatggacttcatcaccggacttccaaaaacccaaggtggatatgattctatatgggtagttgtggaccggttaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccttatgaagcgttgtatgggcgcaaatgccggacaccgctcttgtgggaccaagttggggaaagtcaagtgttcgggactgatatcctgagagaagctgaagcgaaggtcagaaccattcgggataatttaaaggtggcacagccacggcagaaaagttatgcagataaccgtcgccgtaacctggaattcgcggtggacgattttgtgtaccttcgaatcacgccattgcggggtgtacacaggtttcggacaaaagggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgtctccgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcccgatctcttcgccagttcttccgaatctcggggtcgagattccgtttaaggggggtaggtttgtcgcgtcccaaaacgactctaaaatacatcctcgaaattatgcatataataagtaaaatccatgtgaaagcctccaacaattaaaatgtgctaagttaaaagtcaaataaggcttggaggatttttgtatatttcctaaaagcctaaaatgcgtaaataaattttagtggaattttcagagcacaaatattaattaagaagaaaaaaacaaagttaaaatggttttgtaaaaagaaaaaccctaaaagtcttttccccccctctccccctcttgggccggctcggcctcctccccgcgcgcgtgccgctgacggacgggcccgcccgccaccctcgctgacgggtggggcccacccgtcatccccttcctcccgccgctcctgccgcctcgcccgtgccctagcgccgccgccgccgcgaatcccgccgctcccgtccgccccgcgcgcaatcaagaggggggaaacactccccgtgattccctccctctttccccccacttttctctctctctccctcggatttgttcggaaacgtttccccctaaacctcgccggcgcatcaatggcggccggatcttccgcggccgattccccctcatccggccgctctctccccctcccaaccctatataaacactccccgtgcctccctccaccgtttccgccactcgccgctctctctctccgccggaatcgagctcgcgccgtcgctctctctctccgccgtcaccgccgagctccggtccgccgccgtagtcgccccggaccttctcccgcttcggcgtcgccttctccgggttcgccgcaacctcgccgacctcgtccacccctccgtttcgcccgccaaccgccggaacgccgccgtccccgtcgacccgagccgcgccgccgccttcctccgctccggtcgccgttcccgtcgtcgctgtcgacccggggtgagccgtggaccgccgtttcgcttcccccttccctcatctctctcgggcgccgctccgccgcgctggtggtcgccggcggcgaccatcggggcgcgggtgcgccacctcccgtcggctgtgccggcgtggccgccttcgggcgcgccccgcggctgccatgtggggcccggtcgtcagccgcccgcgccctcgggtgcggctgacgcgtgggacccacggcgccggccggtgtgagccgggtgcacccggtccaccgtggaccgtgaggctgccgcgtgggccccactcccgtggacccggtccgcgcgctcctcccctcggctaacgcaataaatccgattttaaattaaaatttaaatgaagaaattcgcaaatatccatttaaagagcatataaacttcaaatggccataacttgaccatttgaactcggaattggaccgttcaagtctctaatttctccttaagaagtcaagaacccatttttgtgctttgtttctgcttgttatatggagtttattagagtataagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgtattgttattattaccttgttcaccctagaataaacaaaaccccaactagtggacactctactcatggtatcactagtatgattttagttagatgcttcgctttttaattaggtaacattaggtggtttttcaactctagactttgggaatatttatatcacccggatactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttctgtctgtataccgtggtggtatgtggcacgtggttacacgtgaggaagatgtgtcttgtgagtaaagatgtacacctctgatcagagtataatctattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtgtgggttcacggccttgataaataatattgtttagttctagaatcgtgtttaccaaatagctttgagcaactaaagatctttaaatgctgtttactgcaaccctaaccctttatagtgtaactcctttgtactcccttgcatttattctgcacttgtgggtgtgtcttgttgagtacggtggttgtactcagtcttgctcaatttttcccaaacccagaagaggagcccctagaagatgaaggctttggtgtctagctcgtgcctgccgtcaagcgcctgtggtcgtcgccctagtcttccgctgtttctcgattgtctttgtgtgtgctgggccttcgctgcccatgtaataaattaactatttacgctaccgcttgttaaactctgaattgtatcaacttctggtgtaccttgcctcctgggacaaggaataatacacgcacgtaaggaacgcccgttgggttatttccggtcgtgacagcatctaaatcagatcctagaagatatgctccgtgcctgtgttctagatttcgggaagacctgggataagagtctcccctatgccgagttctcctacaataacagctaccaagccagcctacaaatggcaccctatgaagcgttgtatggccgcaaatgccggacaccgctattgtgggaccaagttggggaaagccaagtgttcgggactgatatcctgagagaagctgaagctaaagtcaaaaccattcgggataatctaaaggtggcacagtctcggcagaaaagttatgcagacaaccgacgccgtaacctagaatttgcagtggatgattttgtgtaccttcgggtcacgccattgcggggcgtacacaggtttcagacgaaagggaagctcgcacctcggtttgtgggtcctttccgtatcgttgctcgacgcggagaagtcgcttaccagttggagctgcccgcatccttgggcaacgtgcatgatgtgttccatgtgtcgcaactcaagaaatgtcttcgagtgccatccgagcaggccgattcagagcaaattgacgttcgcgaagacttgacctatgtagagagaccagtaaaaatcctggacaccatggagcgcaggaccaagaaccgggtaatccgtttttgcaaggtctaatggagcaaccacgctgaggaagaaggtacttgggaacgtgaagacgagctgaaggcagcccatcccgatctcttcgccagttcttccgaatcctggggtcaagattccgtttaaggggggtaggtttgtcacgtcccaaaatgaccctaaaatatatcctttaaattatgcctagaataattaaaatccatgtgaaagcctccaaaaattaaaatgtgcaaagtaaaagtcaaacaaggcttagaggatttttgtatatttcctaaaagcctaaaatgtgtaaataaattttagtggaattttcagagcacaaataataattaagaagaaataaacaaagttaaaatgattttataaaaagaaaaaccttaaaatttcccccctccccctcttgggccggctcggcccatctccccccctctctctctcctctcccccgcggcccattcggcccctccccgcgctcacgccgctgacgggcgggcccgcccaccaccctcgctgacgggtggggcccacccgtcatccccgacctcccgccgctcccgccgtctcgcccgcgcctagccccgccgccgccgcgaatcccgccgcctcccgtcgtccccgcgtgcaataaagtggggggaatcattccccgtgatcccctctccctttccccccatttttccctctctctctcgcgttcaaacgggcggatttgcccccgcaaatctcgccggcaccattgatggcggccggacctcccgtgccggtttccttcccctctggccgctctctcccccttccaaccctatttaaaccctccccgcacttcatccgaccgttttcgcctctcgccgcccttccttctcgccggattcgagctcgcgacgtcgctctctctctccgccgtcgccgccgagctctggtccgccgccgtcgtcgccccggaccgcctcccacctcggcgccgcctcctttggcttcaccgcatcctcgccgacctcgtccacctctccgtttcggtcgccaaccgccggagcgccgtcgtccccgtcgacccgatccgcgccaccgcctccctccgctccggccgcctcccccgtcgccgccgtcgccccgggatgagctgtggaccgtcgcctcctttccccttcccttccctctctcggccgccgctccgccgcgccggtggtcgccggctccgaccatcggagcgtgggcgcgccgcctcccgccgaccgcgcaagcatggccgccctcgggcgtgccgagtggctaccgcgtggggcctggctgtcagccgcccgcgcccttgggtgcggctgacgtgtggggcccacagcgccgaccggtgtgagcccgggtccttaagaagtcaagaacccatttttgtgctttgttcctgcttgttatatggagtttattagagtaaaagcctttttcttgtttccattggtcgtgtagacgctgcagcttcggaagatccgctcttcgtggaggttgaagccgacgtttgggaaagcgagcaaggacatattgaacatattgaatcccattttataaaattattttgatttaaattattgcattatcgctttatttaaattcccgcgttatcactgttttattcagccatgcctatttacctttgttatgaccttattattatggctattgttattattattaccttgttcaccctagactaaacaaaaccccaactagtgggcactccactcatggtgctactagtatgaatttaggtagatgcttcgctggttaattaggcaacattaggtggttttacaactttagactttgggaatattcatatcacctggacattatggaatggttggattattgcggaattggattcacacctccccctctattcaaaaccctcaaaatggttttaggctgggctcggggtgcatggttttgatggtagcacctcggccatatatggaccggtcttcgggcctctgttgcaaagcactaccgtacttccacatgtctagtgggtaaggcttagtttctggctcagtctggttataaacaaaagtacacggatggggatggacgaagtcgggagtcgatggacatctctagggcaaatgaaggctacacgagctgcggcccggtagtcgagatgtcatggcacagggctggtgtcctgctgctaggggctcagtcctgcccacctgtcccgaaggttccggccgtaggtggggttgggtcggtactcttgtctatggctaggatgggttggaaactatgtcacgtctttcgtccgtatgccgtggtggtatgtggcacgtggttacacgtgaggaagatgtgtcttgtgggtaaagatgtacacctttgatcagagtataatctattcgaatagccgcgccctcggttatgggcaagccgagcaatgtacccaagttaatattttaatccttataacctgcttaacaactaaaatgtggaatggttggcctgggttggcttgggacgagctgggacccagggtcgggttgccagtttggtttgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccccttatatgataacccgcttgtactcccttacatttattctgcacttgtgggtgtgtcttgttgagtacggtggttgtactcagtcttgctcaatttttcccaaacccagaagaggagttcctagaagatgaaggctttagtgtttagcttgtgcctgccgtcaagcgcctgtggtcgtcgccctagtcttccgctgtttcacatttgtctttgtgtgtgctgggccttcgacgcccatgtaataaattaattatttacgcttctgcttgttaaactctgaattgtatcgacttttggtgtgccttgcctcctgggacaaggaataatgcacgcacgtaaggaacgcccgttgggttatttctggtcgtgacactgctgatcggcaagagcagaagcctctacaacaagcatgcaatgcaaactcaattccaccgtgcaacagatcaactcctatctaccggtgtcttttctttctaatattaaatttttccggcgagattcagttatcagtttgaagcggccggggtcgacgtggactcggactccaaaccaaaaccattaagcaactgctcgtcatcaagcgatcaaggaggaatagatggaataatttactgtagtcatgtatgctcttgatggtgcataacttggcctacagctgtatattacatgtttccagtcacgaagctatctaccggccaaacagttttttatttttctacaaagcgcaagcattcatcaaggcacacagcttggtgtcgaggttatcaagattgcgatctggctattccaagtcgatttatatttttcgccaaaattccggctattagacctttgaaacaagagcttctggatcacaaaccactaccaggtttatcgttttaaattttcttgcataaattagattaattcgcagatcactaattgtaatttgatctattattttatgcatgtgctgccggccgccttcgtataccgccgactggtgttctcgcctgcacggctggcgtattatgccgtcgttgttgggcatctacgtcttcaccaccggccgcctcgattgccgccgactggtgtttctgcctacacggttggatgatcacaccaccgttgttgggcgtctacaacttcaccaaccggccgcctccttcgctgccgactggtgttttcgcctgcacggctggcctattatgccgccgttgttgggtgtctacgtcttcaccgaccggccgcctcgtcgatccgccgccgattggtgtctccgcctacacggttcgatggtcacaccaccgttgttgggcgtctacgtcttcaccgaccggctgcctcgtttgctgccgactagtgtttttgcctgtacggctggcctattatgccgccgttgttaggcgtctacgtcttcaccaaccgaccgcctcgtcgatccgccgccgattggtgtctccgcctacacggttggatggtcacaccaccgttgtggggcgtctacgtcttcaccgaccgaacgcctcgtcgatccgccgccgactggtgtttccgccttccggctgcctcgtccgccgccgactggcgtttttgcctgcacggctggcctattatgccgttgttgttgggcgtctacgtcttcaccgaccggccgcctcgtccgccgccaactggtgtttttgcctgcacagctggcctattatgccgccgttgttgggcgtctacgtcttcaccgaccggccgcctcgtctgctgccgactggtgtttttgcctgcacggctagcctattatgccgccgttgttgggtgtctacgtcttcaccgaccgatcgcctcattgatctgccgccgactagtgtctccgcctacacggttggatggtcacaccaccgttgttgggcgtctacgtcttcatcgaccggctttccttcgccaccaccgattggtgtttccacctatacggttagttggtcacaccactattcatgggcgtccatgtcttcaccgaccggcttgccttcgccgccgccgactggtgtccccgccttcatggctgacctattatgccgtcgtcgttgggcgtctacgacttcaccgaccggcttgccttcgccgccgccgactggtgtccccaccttcatggctgacctaatatgccgccatcgttgggcgtctacgacttcaccgccggcctgccttcgccgccgccgactggtgtccccgccttcacggctgacctattatgccgccgtcgttgggcgtctacgacttcaccgccggcctgcctccgtcgccgctgactggtgtcctcgcctatgcggttggcgggctcctccaccgttgatgggcctcgttatctacatcaccggcttgcttccactgtcaccgactggtgtcttccttgttattgatggacgactttgttcctacattggttacctctgccattaccaaggggaatattacaaagctaaatcatcattaattttcttctttatatgatatttttctttttctctaagtcactacatcaattggttcgccattgactagtgagtcgggggctatagatgttatgtcatattttttgaacaattttcataatatttatattgattgctcacgacataatctgagtataaaagtgcctatcgagttatggagttctatcttcctatgcttcccgtttgatttgtcgatggacagttgcctttgggccgattcctaccacccgggggctcactggatggaccgagtaacgcaagatgctaagtgttattcggaataaatcaaaagcatagagataagataaatttattttctgctctttacaattgcaaaagtacccgagtagtaaattctgattcgtgaaactttgttccattaatgacgaactcatatcactcatatgcatgtttgggaagtgcctaggccgactcccgatgtttgggggctatgactagtcggacagagtgtttaaacgtacggagtcatctgctcggggaaatcaaaattgacaagaggagaaatacatatttataaatattttaaaatacttgaatttttctcgagtattatatttacatcagatactactcatcctatatgtttgttctgtaggatccatatccagatatgcataaaagggattcatggctttaagcttatctcctacgcttcaggaatggatcagtcagaacatcaccaccggcttgccttcgccgccgccgactggtgtctccgcctgcacggctggtctattatgccgctgttgtcgggcgtctacgtcttcaccgtcggcttgccttcgccgcagccgattggtgtctccgcttgcacggctggtctattatgccgctgttgtcgggcgtctacgtcttcaccgatcggcttgccttcgccactgccgactggtgtcttcgcctacacggctggcttattatgccgccgttgttgggcgtctacgtcttctccgaccggccacctcgtatgacaccaactggtgctatcgtcttcacggctggccacgtcgccgccaccgcaaataggcgtcattaccttcaacgcaagctgtctacgtctgctgccgactggtttcttcacttcgatggctgcatgattctgccagtgttaattggtcttatcgtctttaccgccggtcatctcgtctgctgttgactagtgccctcgcctctacggctggtttatactgctaccactactgatggacatcatcgttttcattgctggccgccttgtctgacgccgactggcttgttcacctccacggctgcgcgccttcgtcatcattgactggcgtcatcgtcatcatcagtttgccttcgccgccgcccatggtgtcttcgttttcatggttagtctattttgccgccgttcaaggacgtcttcattttcgtcatcattctacttcttccgtcgccgactggttatgccgccgtcgactgggtggagcaacttcatcttaattatcttcggaacaggcaagctctattgcctcaacttcgcaagttttgctacttcaccaaccacaacgtccacaagatcttcgacatctcagcatgcacttccagattcgacaccgcgctattccactacaacaagtggttcttcaattttcaagaattctagtcggacattttcaacatgtatcttcactcaagcaatgactactcgacgacaagaagctataattctcgactctatgttcagatgtttcccaactaaccaaagagtcgggggctacacaaatacaggactctcaaaattcgacaagctgaagcaatcaattaatcagccaacgagtcaactccaggagtcatcagttttgtcttcgcttcagagctggcgttctacttgagcaactccaattatttcactggaaattttggcttctccacgctgccacaatttactccaaaattttcaagtatcaagtttgagattttatctatatgtctgggcgtttggagttatcaaccaattaacacagattcaacgagttggacaacatcatctactttccttcaagtgaagcatctacaacagctacaattccaagttctactgccatctttacagatcaaggggtgttgcatcaatcttcgttatgcacacatcaaaaaaattacttgagcttcgatatcttctcaacagtttgatggattattgtcattgacttcatcaccagcacctctacttcatcggccctgacatctctgccgttgctaatggatgactatgtcttcgcctccggttgcttccgtcattgccgacttgttatttcgccttcacggttgacctactatgaaaacgctgatgagcgtcttcgtcattatcatcggttgctacactgctattgactggatcaccgacatcgtcatcttcatcaatatcctgtcaagcctcttcaacatagcatattctactgctgtttgatgggtaacttcgtcatcataatcgatcatctatgattgctgcttatcatcattactgtcggttgcgtttgtcgtcgccgactatttttttcatcttcatgattggtggatttcgtcatcgcctttgatgcgtgtctacatcttcaccgtcggcttgctttcgtcaccaccgactggtatcctcaccttcacggatggctaattatgtcgccgctaatgggcattttcatcttcttcaccagctgcctcgtctgtcatcgactgattatttcgctaccatggctacacaactttatcgctgggcaccttcatcttcattgctggttgacctgactgctgccgactggattcttcgcctccacggttgtgcaacttcatcacttttgattggtatcactatcttcactaccaccaatatttttgccacctctggtgagcaatattatctctatattggtcgccttgtttctatgccaactgcatcagctaccatcaatggaccattgcgactacggcagaaggacaagctatatgatcaggggcttactagctcaaacacaagtatcataccttcaatttggacttgttccggatacatgcaacatgaattcatgatcatgagtctattttctatgctcaaagactggactatttattattccccgtaagggttatcaatcgaatacttgcgcaagtcaggattcaattattatatctattttggagtatcccataagggataatcactctgatcagaagctattcatataagctacacttggtctatatcacccggaagatttattactcgggagcatgttacatgcgtcatcctttaaagggtgtcgaaggcatattttttagcctaggcctaatatgtctgcagcctatattttcaggtgtagcctgtcacgttcttttagggacttagatactttttgcttaggccaaagtgcacgtgatcaagtgcccaataccttaaaatccttttataccgcagttactcaactttttaggagttggtacaatgcatcttaaaaggtgtcaaacagtaaagctttatatagctgccccgctgacttttttatataagtgaaggtgctgtttgggtttttaagcaattgattgaatacaatattgttgctttttgccacgtaagtgtgcatttttatttgaccaatattatggcttaggctgattatatatcttggtcattttccaagcggttggtaaatcctttatgagtttatttactcggattttgcaccatatatgccgtatatttccgggtgtggtgaaaccatgtgtcttttagagagttaagtacatctgttaaagcagtgtgcgcatggcgtatgcccaatactttcaaaatttctttattcacagcattcaagttttttttatagctgttttgctatgtgaattttcaatgatgtagtcaactttaggttgctcacatcaatttttaccaagcagtcggtatatcacttggatcatgttatttgggggattcacaccgcatatgctatatattgatatcaagtcacttggttgattacaattatcaaaaccactcggttggttggattatttattcgttgactatatgcttagtttgttcagctaaccacgtagtcgggggtacacctattaggtgcatctagtcgatgcacctgactttatttttcagccctccacagtcttcatatttggtaaaagtactcgggagaccatggcaaaaatgattgaagaacttggctttggagtaatctggttcgagagaagattatctttttgactgtgaaggtctcaggggctactgtgcagattatgggtaccccatacccacacggcatggttatccgactagttataggggataacttatatctatggaatatgtaacagatcatgacttgggtattacgtttccttgtatattacggaatggcctaaagtcctggtttggtaatattgtaaagtagatttaggaaaccgataccgtattggttaaggtttctatcttgtaatcctgccccacgtcttatataaggtgggcaggaggccctctagggggcatgagcacatatgatcatcagatccgcctcagggaagccaccgacgccgccgttgggagggtgtagtcgccgagagggagggacaactgtcaaggtcgacggggagtggaagaagaagaggcggagggacggtcgtcactgccgttgggagggcgctgtcgccgagaaagagggatagccgtcaaggccgacggggagagatagatggagagggagagggggagggacggccgttgccgcgtcgtgccggcgagacggaagggagagggggagatggagagggagcagtgccactggaggggagagggtagaggaggggaagcgatgccgctggaggggagaggggataggaggggaagcggcgccgctagaggggagaggggagagacggcgcctgtggagggaggaggacggggagaggcggtgtcgggcagggggagggggctggtggtgggagaggggaggaggggtgaattaatctagggttagggttttgattgatttggaactaattcgaaccatccataaaatcaaaacgaatggctcagattgatagagcgtcgagctggcctgcatcaccgaaccgcaccacttaatctcacacgggccggcgacccaacacattttcggttacggcccacacgataagtaagatgaggagcatggggatgttaattaaactttggtcgcttacggcgtgagaaaagtgggccggctcagttgtaggctaaagaagaaaatgggctaaaaaatagcccatatagaaatgaggatttttatttaataaatactgaaatgatgtttgtattatcaaaattagcaattaagcactataaattccagaaaattttgaagagtataattaatatggagaatttaatacaaattaaattcaaccatatcattttatttctcacacttactttactagtaaattaatttaattatatacctacctacttagaaaatacccaaatatttcaaaaaattcgtatttcacttaattagaatttaacatgttttaattcaattttctcgttttttctttgcaactttccgttgcaatgcacggagtctagaaaatacccaaatatttcaaaaaattcgtatttcacttaattagaatttaacatgttttaattcaattttctcgttttttctttccgttgcaatgcacggactattttgctagtaatgaaataatccactagcaaataaccacattttaaaaatgtctttcctcaaaaattcacttcaatggtgtccaccaactataatcacaaaatttgtcgccctagagttatcagtaatgtttgtacaatgtttgatacgtcataagcgaacatgtcataagtgaaactagtcatagccatttctacttggctgacagatgttgaatcctagccacccaaattccaaatcatccacgaggctccatcagaaaaaacggtgcatacgcatttcaggctttcaacagtgtcatatttaccctaacatccagaaacgaatctcactatacacgatagacagcgtacctataattatttctgaggccgagaacgaaaacaccgcacatccctatactgaacaagcaaaacaaaaggtaaagaaacaatggagaattaattgggtagcgaccaacagaaactgctacgctttgtgcctccctcagattcagagggaaagatgcacctctcgagctcaactgcctcctcacctttacaaatgactagtcaccagcaaaaaagattaaaaaaaaaaaagaatgtgcaatgaattaacttgtctcaagtcagtcaatcgtcaatatcctgcacccattgcagacctgcaacaggacaaattaaaggtgtcaagcactcataaaa

SEQ ID NO: 48089 - DNA, 1416 bp, Oryza sativa
atccctcaactccaaaatcaggtaacctatccctcaactcttaaaaccggagagaattagtctattcaactgtttggcaattgtttcacgcacataagcacattgcacacaggatctgagggggtcaaaacctatttttagcaggatgagaatggaaccatgctaagagttgagggatgagagtgagactttttgtacagataatgatacaacagctttaaaaagagcaaactcatactggcacccaagtattgatgtatgacaaaacttatattcattgcactataaatggaatgccctcgggatgtctctctccttggatccagttttttattgaactattagatggtgaaaacttacttaaatgtcctggtagtctacacatccattcaacatagagcctcattctgatcaacattgaattaacttatttaatttcagtgttacctgcttggatgatgcatcatactcttcctgccaaccattgccaattttgtcaattgatgaaaccttcctgtacttgcttttaagttcaaccaaaggcatttcccttgagaaaaagagaaggatgaagtagttaaaaattgtcaaccaatcaccagtacataatgcatttaataacaagcaacaaataaaagctatgctttttgcataggatggatctctatgaagaaatgaaagtatttattgttccatccctagtcaaaagatgttttagaatgcttgccgagttgcagtcaaactcaataatatatgccaaaatactagatttttttaaccttcatataatatgtggaaatgacatcagtagacttgtcatccaaaataatttcacataggtaatatctttaatatattctatgaatttatgattacaaaaaggcaatgataaacatgttcattggacactgtggaaagggtaaaacgatgaatcaagtaccttaaagcttctccaacagcaggacggattactctgtacattccttctgttgagctggtgaagtaacaaagattcagatcatttatatatcgcaccaagcatccatgaatttttttatatttgttgtcaaccaaggaacaaatgaaaaacataatgaacaatatacaaggcctgtttattccaactaatatactaaactttagatattcagctaaaccactaaaacagatgaatttcatctttcatgaacatactctttccgacctatgatacgagggattttggctatgcaaatgaatagccaaaatgaattgttttatgggacagaggaagtaactattaactactacctctgtcccaaaatataagaactttcaaggttggacacaggtgttaaggaattagttggaatgaaataggggaaggttatgattggttgagaagaggaaataggtggagaaattaaatggggaaag

SEQ ID NO: 48090 - DNA, 19552 bp, Oryza sativa
  unsure (1)..(19552): unsure at all n locations
tccaaatgctagcgggtcatgtaaatagcctaaacccttagcactcagtgctgttcacactcatttactaatagtttatttgttttgctgtaggaaatgatcggaagtttcttgaaaaatggccccttgtgttatatggcttatcgcaatatattcccaatatgggctcttggagagtatcagaaattagtatttcagaactatcagacctctagcatcaagcaaacaaatatagctccatctgctggcaatgctgctctgaagaattcagcaagtacaacagcgccaacttgatttcttggcagaatcaagcaaacagtccagtgtattgtaggtcatgtgaaagagtacaaaactctaaatctagaatctgctgtattgttttggtcgattttatgagatccttatgaattttttgtacattctttagatctgtgcaagaacatgtacatcacatttcacatttaggtactttgaaaaaggataacaaactttgccccaacttcctggtccataaacctaattcataaactgttatagtgatgatactgttaacataaactttggtactaaatgtatgctaacacacctctttttgctccaacagcagaaaggcagcacagaatttaacagaaacccacaaactattctagtaataccaaaaatatgtgttcaatacaatgcatgaaagtgaattctgaaggtgaaaaaacacatataatgtgttgggcgtggcctgtggggttagaggaaagcaaagagtggtgcactccataatacatctcgcgttgctatggtgtagagggatcagggccagaccgtggcctctgacatggaaagtggagttggaggccacaaccataacagaaaccagacttctccggtgcatttaaagttttaaacagaaacaatttagggaaaattaaactcagatgcaattataacagaaactcatcatagatggcaaaataaatctctagcaggaatatagcttgacagtcacagatagacttttccttcggtgactaatcacacatttctgagaaatgaatgaaacttcattacaaggcaacaaatacaggtttaagataaatcaagaaatggacaggtaagtaaaacatttcccatctataatgaaatacgtaactaagtaattcaacttactgaagaacattctggatgtgatggagtaattttccgatatgttttcttgtcaattgttatttggggaacatgggaaatgagatggaagtcttcccctgatttaacagcacatcttctgctcaactcaggacagccattgatcacaattttcttgagagaagtgaaactttgaatgaaatctggcagtttcattaatccattgcaatttccaataccaaaatattgaagagaggtagcagcagaaataaagctccctggaaaacagactagcttcggaagcccaacaagctggagcacatcaaggcaagccaggccacccatggcttctgaaggttccaacaaatccagctcatggcaattattaatcgataatgtttgaagtgtggagagttgattcatggtcgagggtagagtagccaactttggacagttgaagatgtagagctttcggagggaagttagactaccaaatccatttgtcaatgatgataactcagcacatgaatttaagaacagaaatgtcagtgaagtcaaactacaaaatccatcatgttctgataaatacttattcttcagtgtgaggcacaagaatctaaggcttataagtctatgcacgtcctttggcatcttctctaattggtcgcaccgactaagttgcagtgtttgcaagttcaccaacttacatagggaattcggtaagaacttaattttcccattccattgtagatccaggtaccttaagtgcttaagatttccaattgaactcggtagctcatcaaaatcaacgtcagaaaaaataagaacacgcaggagtgtaaaggttgacaagaagttgtcaagaaaagctttagtcatggtcccattgttatcaatgcttgcaaatgtccttgccttgtttgcctttctcaggtgcttaggaaattcaatctctgttgagaagtccttgcgatcccacacaaggtgcctaaccttttcagataaatctttactttcacaattaacaatagcatgctccttatggcacacaaacatcgcaagattatgaacaagatcatgcattttacaactttgaattgagccattataaataacataatggtcttggaaaagagatctttgatccagttcattaaagtattgtcctccaatagtttctatttcatctccttctctggttttatgcaataaccctagtgccatccagaacataattaaaagctctctcaaaatcacgtagtcttttggaaaaacagataggcaagagaagcatgccttaagatgaggtggaagtgcatcataactcaattttaaggctggcaatatatcgcatttattttgctcaatattccacagatttgcatccttaatacgcaaccactccttaacatcctgtttaccaaacagtacagaccccaatgtcttagctgccaagggaacaccgtggcatttctccacaatacatttgccaatttctaacaagagtgtgtcctttttttcctcatctctgaatgcatagcgaataaatacctgcatacattcatcaaatgaaagctctggcacatagtatggctccaacgtcttcaccaccgacgcaacattcatattacgtgtggtaactacaacaacacttcctcttccaccactagataggaggtttttaagttgttcccagtcattaacattatcactccatatgtcatcgagaactagtaaatatttgttttcctgtaaaaacccacgaagcttgttttgtagcgtttgcaggctcagttgtttgttgctttcacctgtatctgactggattatgtcatccagtatcttctttagatcaaatacattagatacgcaagcccataagttcttctcaaacattttctttatcctcatatcattgtacactagtttggccagtgcagttttccctatgcctcctaaaccaacaataggaagcacagaaaaagcatatgcatccgcagcactcagtatgatttcaacaatcttgtttttcgcttcgtctctaccaacaatgtctaactcattgatgaaggaatgtgtttccctggtattgctactgaaaaattgcgtatctatgatctcctctgttaatgcaaactcccttctgttagctgctatctcatcaagcttttgacgaactactgttatcttatggctcaattcgaatgggtaaacaagctgccgactgaccccagcatagaaaccattatgaaccttttgctccaaatctttggtggccacatcatccagaacatcatcaatgtcgtagacgacatcctttaaatcttccagccacactttaagagcacaagaagtagactgcttgcgctctgcatctttaagaacaccacagatggacttcagagatctttccaacttcctcacttctttcttgaaattccacgctgatttaatctcgctggcagcacaaaaggccgcttttccaagaacggagattgcaaaactcgatagatgcacctcagccatattttgcttggcaactgcacgatagcaagagcatcaaaacaaacatccatgagaggaaatctgatgtcataatactattacttttttttaattaaaaagaaaagaaccccacattacaatacattaatcagtaaaacctagcatgatttaagatttaagatcctggtaaaatcagactcacggaactaatcacataaatggatgccagatgaagacggctgcaagccctacattgcaatcaatccaatccacctgtggggattggagtggatctaagctcaaaattaaccttaacaaacaagcaaagtccaggacacgcaccaaaacccaccgcttcctttgcccccctcccgttcaagacggacgcgtcagatcaccgagcaccgccgcgtggcaggaagacgacgagaggggcggcctgcagtgacgccctcgggtttttggctccgcacagcttcttcggcctcacgcggtgggtggggggtgcggtgggcggtgagcggcggcgacgtcagctaggtcaaaccgcagcggccagcggcggttttttttcctttcccctttggcttcgctggcgtagagcaccggcgtccggctggtcgccggcgaggttgccaatgccggtattcgtcttctccgagtgtgggtggtagcaaaatgggcaagattaactttgtttttcactttaaatatcttggttgagctacagttgaaagcttgaattattttaagaaaataaatagaacaaccaaaaataatttatagatgctgtaatttaaaaatccaaaattaacctaatacatttttgtttttgcaagacttagtttaaatttaatatttagactttggttgtggctaacaagccaacttatatagtaatcggagataaacctattgtacgagagggatatgagtgatggtctgagagtatgagccaagtagatttttttttctcccatcggatagcctattaagccaaagaaaaagccaaattttgaattttcaaaattaagattgattttaagatatttttttaacgtagtttctttttcagcattggcttttatatcaccgagaacacatatataaaagttttacctacaaattcatttttattttctaataaattgttttggcttattagaaaaaagccaaacaatggggccctttgtgaatggaagaaagaagagagatcgtttgacttaaatttggagttgattcttgctttaaaatttatttagttatttttttagggtgagtttagtttatttagcaccttactaatttgggcaataattttctcttgataatgtatgacctcgattagtaatgtatgaaacatcttcgtatgtccccacaaatagggcaacaaaattcatctaagtctttcaagctaaaatcttagtcatcttagacattattttttatttactaacaaggtataagaaacaaataaatacaaatgatgaaggtataaatacaaatgatgaaggtgaaaacaactgtaaaatatatatatatatatatataattttattattggagtatgtatcaaatatgttttcctttccagtaactcattgcatcaattgcttatatgtatatagccacattattgtaaaatgtacaacaactcttaaatatattatcggatgtgaactaggttttataaactcaaaaatataaaccatatagacataaaagtcttatatttgttgaatgtaaaaaaaattcctacataacgtgttaacataaaagtcgatgtagcattgtcattaaacttacatcaactagcacgtgaaaccaaacccgtcggtctcttcctcctcttattcctcagtcatcactatttgaagtcggcatttcgattctcatcctcagtctctccggtcatcatcatcggccgcacagcaaaaccaccgtatcatgaccttgcaggcgccatgtccaaccggtcagaagagagagggggttctcttccatcatagccgatatgggagacgattttgttcagattcttcaaggcatcctcgaacgcttcgcggatctcgtgttcgcttcctactcttctccgacgagctaccgattgtgctgggcttctttgccgatcatgatcgacactgctgctacaaaaattcaaaaaggtaaaattccattttctaaaaaaaatagtagatgaacacctattcttttatgagcattagctacaacttacacctatcacaaaacaactcgttgcaaaaaggggagagaccaaaacttgattgctcaatgcaagagggaaggattgcaatgctcccatttgtacgtaatcctaataaaaataagaaaacacaagaaaggaaattttcaagttctccttttctttttctttggagcaatataattctctctctctctctctctttttttggcaccgctttctacctcctctactcctcttctttttagcgaagcaaaccctcacctcttctctactctctctctctctctctctctctcaagctcggcggaggcggaggcaagcaaagccttctcccctcgcctcacctcgcaatccaccttgggcgggccgtccggcgagctgagcgcggcggcgccctccttactcctccctccccacgtgcggccccgtcggagcacggcggcgacgaagaaccaggggggtgggggggcgaggaggagggcatcattccaccggctgattcattcttcttggctcgagtcgaattggagaggtatatcggctcttctctcgtaccgccgcgccactggagatggatggatgggcgctttgcatggctcggattagggatccgttcggacatggcttcatttctttcccaaattgacccgtccagttaattccgtcccggtttccttcttttttttttctttttttctttttttgatgtgtgggtggtgggtgcagcagtggtagctgtttttgtttccaaaaggtgattttttttttgggtggggggtgttgttcagatgaacacccaaatgccccgcgtttgggcgagcgagttgtagtgcttgttggaaccaaatctgtgatctttgcggtttatgctggtactatgtttggtgtgatctcagaaaatcgaattttatttgggttgcttttatggttggtaccgatgattttggcgaagaatcgtggtgtgattgtaggaatgggaagctttgatccgttcggtttgctgtaggagcatgcatgcttatgatctctcttggggttcctcctttgcaggtaattgcttgccttctgaggaactgcgggagggagcgaggagtcgtggagcgactcttgaaggatggcggaaggtgccaaattccatgggatcgttggcgctgttggcgcgcatgatgttggcgggaacttctgtgacatggggtactaccagaagctaggggagggctccaacatgtcgatcgatagccttaacagcatgcagacaagcatatacggtggttcggttgcaatgtcagtggacaacagtagtgttgcatctagtgactctcgtaccgggatgcttaagcatcctggcctcaggggtccagtcattgtgtctagctattctgtcgggaacagcattttcggtccagggcgtgtgtcgcatgccttgagtgatgatgcattggcacaggctttgatggactctaggttccccactgagacactcaaggattacgaggagtggaccattgatttgggtaagctgcacatagggatgccatttgcacaaggtgcctttgggaagctctataggggaacctacaatggaggcgatgtcgcaattaagcttttggagaggccagaggctgaccctgagaaagctcagttgttggagcagcaatttgtgcaagaagtcatgatgctcgcaacgttgaggcactcaaatattgtcaagtttgttggtgcatgcaggaagccaatggtttggtgtattgtgactgagtatgcgaagggcggatccgttaggaattttttgaatagaaggcagaataggtctgtcccactgaagcttgcagtgaaacaggcattggatgttgcacgtggcatggcatatgttcatggccttggatttattcacagagatcttaagtcagacaacctattgatttctggagacaaatctatcaagattgctgactttggagtggctaggattgaagtgaagactgagggaatgacacctgaaacaggaacttaccgctggatggctccgtaagttggcatacatgctctttatcttgcttattttaatcagtaattatctcaaattcgtattaagacaatgctgttttatttttcttcactcggcattacccaaggccacagtatttctcaaatggtaaatgcaacacatttgcagtccttgtatgataaaatgcagtaacctattcatgtgaattagtagctaggtatgcacatgtgttctaattacatgcaatggcactgtgccagtcctgttatccataatttatccttttttttttgctaaggctggttattatcttgaatgattcatgcatcgaatacttgagttatgtgaaaatgcatggtcatttgcatgtaaaacttttctactggtgctgcccataactgtaatattttactttttttgttctctgtttttcttattctcctctgaaatctagtttggcagatcaaattttataatatgtgaaacaagcatatgctgtgacaggagatgtcttgtaaattcttgtgtgtagcttcatgggttgaaatatatgaatgctatttagacatagtccaagagatctcattctaaaattttcattacatacctatatacgcttataattggttcgtgggtgctaatatttaataaattattgctgtttaaggtattggattgcattaaccgtgccctatgaaagcatttatgcactaaaccctcattctttgctgatagatgcacaaggtgttcatcttaagagcattgaaattgcagcttgaatcttctagtttagatgcttgttcaagatatatttgttgctaattctcggctacaaagaaaagatggcagcatcggttaactcaggcctatccttggcattaggcacaccaactatttattaggtgaagatggatcaattatgaataggattatttggatagggtttctggatttaacagacaatcaatactcattcaatgttgactaaccgggtagtctggatatcagtgccacataaggataatttggacaaaaactattaaccgtacaacctagtaacgcaaaaaccctagcccttagaaataatatgtctcctggcttccgtagctaacctaaccttaggtaaggcatgctaccagctagaatgttgaagacctgttttgccgataaagggtgatttcatgggtaatgaaagcatctgcacccccaagagagccttgtgtaggtaggaaagctttagagcaagagcagcatgtcaacatgatacactccatgcgattatccacaatcatcaattcccgtccatgggatctatgagtaatcctatcaaagatcttgcccctgccagccagatgacctgcgttggtcagccattggtatgatttgactggaaaaattgaaatgtgctccatgattgtaccatcacgatctgtgctgcttggataattaactattttcagtttaaggacccctttggtttgtaggaataacatagcctaggaaagcttttgaaacaaaggattaagttctatcatcttcctatagaaattgaaccatgttgcttgattcctgtgttattagtttctgcgttccataggggggctgagtcctctgctgacccatcacagcaaagcccttggcagtttccacgttctctaggtcatgatgctgtccagtagctttgccttctttcttgttcctaatagaattgtttatgttctaagacaagattaactaaaaagttgtgtttgaagtgtttgcgcaaaacaaacttgtgctttaccctttttaagggtaagcaactgcacaaatagtttcacctctcttaactatagcttaaatgcacaagtgtgttcctagctaagctaaggtgcaaaagatcaaaatgttcatgtataatgtaatgttgcttaaacagtaaggtaattgcatgcatgtaactacctggcaaaatgtgttatttgaagcaaaaaagttcctatgatgaactttctgctgtgcatgatgcatgaatagcgagtgttttgtgttacaatattagcaaattagcacaaagtggtgggttttatttaaaactttgcagagaggaaaagtatgctatttggttcttggtgcaaaatgctgtttatatctggcagatttactaactacaattataactagcacttcaaaaaagtcaagcttgagcttttattcactagtcttggcctgttatggagcattttctctcatagaaatagagcatcaagtttattcctttcttatccattagattggaccagcatattttcttataaagtatgaattagtgtttgggattatagtgcctatcctggaacctggataggtggataaattattggatctctatgatgttcatgttcaaatatagtgcagtatgctagaattggatcaattattgctcattgtgtttttttttcattggttctagtcatgataactttttattttgacttgcagtgaggtgatccagcacagaccatatgaccaaaaagtcgatgtctacagttttggcatcgtcctgtgggagctagtaactgggaaccttccttttgcaaacatgacagcagtgcaagctgcatttgcggtggtgaacaagggtgtccgcccagccataccccatgactgcctccctgccctcgcagagatcatgaccaggtgctgggatgcaaatcctgatgcccgtcccccgttcaccgaggtggtcaggatgctggagcaagtggagatggaggtcgttaacactgtccggagggcccgcttccggtgttgcatctcccagccaatgaccctagactgagtcacagccaggatccagggtggaaaaaggcaacctggagaaaagttaagtcctgtgtacctatcatattaataggcctgttctgcagagaagatgaaagcccaagctgagtgtacttggcgtcgcgcgttctcttcgtttaccctagacaatacctagtatctatcgtcagactggaatgtattagcggtagctttttatctttgacaacaaaaaaacaccatgcagggctcttgttgcaacaaccgcatgttcctgctgtatgttatctgttgtaatcatcctgcttggaacatgtgcaaggctgcaaggcttgatgcctaatagtatatatagcatatgtataattacctggcatgtgtcatacctgtttttatagttctggcatgtgttttttaacctgcttccatagttctgaacttcttattgatgcagctttcatggttaatgttatataccatgtactattaactagcatgtgtttttccctgttcccatagttctgaatgatacacctacatgcttaatggtatatatagcatgtacagttatctggcatgtgtgtttcatagtttagaatgatgccaagtaaatctgtcatggcatcacgccaatttcctccttgtgggttcttgagcatatcatggtatatcctgtgatgtgttcactagtttgattgctataataaccgtaccaaatgctttcaggtttgttcagtggatcagctgggttttcagttctgaatgcttcccaattaggttccccttgtatcacaagttgaatatttcagtcatgaagtaccgcgtgaccaaaggagctttgctacagaattgtgctacatgagagcttaagaagctccaagttcacaagaaaagaatggcgctctgcaaatatacaaaggatggaaccagagagacatgagactggaaagctaccggcagcataattatgcagcttcttatggctaaacaccaccactcacattgaacagcattcatgacgcaacacaagtaaaagcgaaagggaacacattgagacaggaaagaagattgacagcaagaatttcggaactatgaaattggaattataacctaaagggaggtgaaacaaagcctataatgttgtacaactgaagcagcagcaacacctgacataaccaacctgctcttttaacccttctcacctccataagagcatcatatgatccaactgctgctccaaattagtaaatgatatgggggagaaaatcgactgctttactccacagggctagcgttcgtgctcgccgttccatcttcagccttggtggnnnnnnnnnnnnnnnnnnnnnnnnaagaaacaccctcaactgcaggcttgctttcgccattctcagtttcttttagctggacagtctgaccaaatgtgtctgagatgtgggccataagttctcctagggccttattctctgctggtttctgcagctctgggctggcaggctgctgctgacgtctattctcctgcaaggctttctcccgctgctcatagaagtcaaagtcttcaagaatgttcgtctccgattcatggttcttgaagatagttaacatctgcagaccatgttccagcttcacctgcatgttttgtctctcaagttagccattttcagaaaaagctacattcactagatgtttcagaaaagcagagatctctacggaaagattaggattaaatcaacagaagctggcaaaaagacagcttttttacctcctgggtgtccctgctattagttacaggtttgttgtcattgttctcaagaatgatgtgccgcagcaggttgttcgggacatccttaataatgtgccacttcacagggaactggccactccacttgtcctgctgccaataatcgacacttttgtcaaaatcgacgggtccaatcatctcagctacaccacagaactgaccactgccattaacctgcaaaaaacgaggttatggatcaatttaaataaaatctttaaaaaatcaggacatagatcaaaagtagtcttatagaaaatcagctttttgttacttgctttttcccgtagtacagagaataaaataataaaaaaagaggggcttgtcttaccgagaaaaatagaaaaatagggcaatagtcttctttttctttggccaagcgataagcagaatccagctttctattcccactagctgtactggcccaaacattgtacttaatgctcctatgtacatggtcctcagtgtaggactttattacaaaaaattttgcatccttgtattcagtgacaaaatcagggcgattatacagttcactatcaaccagaggaacatttttctcatttttgtcatctattgaagagttctctgtgtcttgtttctttggttttgtagcacgtggcccacggttttgctcattcaggaactcaagagcaccattctgaataccaaatggcatgctccctttctgttgattggcgcttaagtcaaaagtaccaaatctgcgaccagaactccaacttggagtagtgcctccaaacttaccaccttgttggcgtggcttataggatccaggggcatacattgacccatgatgctgcaaaaacatacaccgtcagtgctggacaatgaagagcacaataaacattaggactgacaattttagttcaaccagtatttgccaaagcccaattgcaagaaagcataccattccaaaagccagcggtgtgttcccttgaccaaacaaaccaggagtgctgcttggttgggtggatgctgcaaaagaaattcatgatatgttaagcattggcctaatcaattattacaacagaaataacttgcaatcatcaaaagttcgacttgaagaacagcaaagattgaaaaggagaaatattacctctgtcaaaagacccgaatggttgatgataacctggtgttggcgagtagagaaggccgtcaggaaggaagtactcctgctgcagcataggatctccttgagacattccagtggcggaattagagtatcccatgctaggagaggctggtggctggtagtaaggacttgagaagggaaagtgcaatgggaggtatggctggccatctccaacgccaggagaataagctccatacatcatttgagggttgtttgcatatccaggagataacatgattgactggttgtcgttgtaaattcccttcagcaaaacaagattaagaaaactaaactatgaaaaatggaaaataacttcagtagtcatagtacttacaggtgatacagaatggagtccttccatattgacataatgggggtattcttcccattggcccaaatggttcaggtatcctacaggggaaaaaaaagcaaagaatattaaataataacacttccaaaggagttaccttgttaaagaacaagatacgcagattgaataatatgttcgcctctctctctcaagatttcaatagaggcagttaaacaatagtgagatcaaaatagtaaggactgatgaacacttaaaactgatagcaacaatcaatcatgttagtacagagaaaaccaaatttagagttaaatatctgaaactttatcttctaataccatggttgtgtacatttggggattaaattgtccaacagagttcaatcgtcaataataacacataaaaatgaatgtaacctaacctccagaatagattgtttgtggctgaggtgcgtacacattgggttggtagaaaggttgttctccacctttacccaaaaaactagccttctcctgtgcaccctttggtgattttgaggagctagcaccctggggaacactagtagtcattttctcatttgtactagaaagaatctgatgcagagaaaatcaaccattagtaaatagcgcgacacctattgtagggaaaaaaaactgataagacaattacctgctctttagcagcactcttggatgcgttgttctcacctacaatttctgattgtggtggaatcatgcaatctacataacaagcagagttacaaagattgtaacatcctcatagcggttatcaaaacttaaaaaatgagcgaagtaactccacagatatataaatatatatagaaagtaactatatcctacaaaccataaatgcatattatggtttttactccaccaaaactatcaactcgttctacatgagcaagcatttaataaacgctttacaattgcacatgtcctttcatcaacactgcaaatcagccttttgcatacacagcgcataaccaacatgctcaaatcaacactgcagcagcagcagcagcgacctattcaaatacctcctccgattacccagagtcgagaggacgctttagtcctttttaaccgcactagaattagtgaattaccacctacccgctcgtactcctaccggcgtaaatttccaaactacggaattattacttaattctcccaacttttcccccctcgatagcaaactgtcctgtacgcgttagctcccaggggcggggaggggaggatcaaacatgtgacaatattagtaccaaatttaacgcaaactaagagagaaaaaaaaaccttcccagatctagaacagaagctagggttcacgcgaattcgaggggagaaaaacagaaagagcgcgtgggtagagagagagatgaggaagaggacgatggaagcttaccggcggaagcagccgggcggacggcggcgcctcgccggatggagatcggcgcaggcggcgggcgaactcgcgcgaggagacggagtttgggggggagtcgacgccgaggggaacgggaagactttggtttttgacaatctagccccttttagaaaacttattttgtaaatagaccctcctaaaagctcgttttcgtggataaggcctttcagcggtctatctatacattaagctttttctaaaagggccagattgtcaaaaatccaggaacagctatagaccatgtgggccgcccggcacggcacggcccaggcccggccgtgcctgggccgaggcttgtcgggccggcacggcccgaccgacgcaccgggccgtccgtgccagcccacgtgccgcactcacggcccaggcacggcccaacacgcctcgggccgtgccgggccggcccgaaggcacgatgggccgtcgtgcttttcctcagaataagtctaaatttactccctcctattgggctgtgacatatgtacagctacaaaaagtctattttttctccctcttctttgggctggggtatataaatagctaaaataagtctatttaaggtccctattctttagacagttacatttatatgtctatttttagtcccccatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactataggaacagcggaacgtggacgggagatacttgaccagtttgaccaggctaaacaatgattttggatacaattatgcttattactccgttcggttttttaattttctaacgtttgaggatgatcttactcctacttttctattttatctatactagcaaaagacccgtgcgttacaacgggaagtgtaaagatcagaaaatcaaggaaaagttaaaaaagacttatattatgtaattagttgaagtacaaatttccttaaaaatttggatattatttaagttggtaggtgtataattaaattaatttacaagtaaaataagtgtgaaaaaagttatatggttggatttaatttttcaaaattcttcataattaattacactctttgaaattttattgaaattttcaaaacttaattgctaattttgataatataaacataatttcagcatttattcttcaacccgcgaattgaaatttcccgttcgttctcttctgggtaaccgaaggtggagtgttatttgatgcggactctggatgatttgttgtgtgttggacttgggatattgcaggacaaaaattggttgaggacggacggaaatttcactggaaacctacattagattagagatagagaatatataaacgatgaaatcggatagaaattggaccttttttccggacttttttctgccctttttatatacaatcggacttttttcactctttttttcattttagacgaacaacggaaacattttcaaattttttaagtagtagagataaagattagccattttcgttttcttagggagtgctgtcacgaaaaacgtgttttttaaaacaacttttgtatagatattttttgcgaaaaaatgcatcgtttagtagtattagaaggaaagaactcaaccttaagggacctaaactgaacttattccatgcccatgaggcggcctgggaaccgcggcctgatgtgggagaagccgcagccgtccgatctgatcgacggtctagattgatccggatctatataaaagttcagcatcccaaccctaaccctgaaatcttttcccctccccctcactctctctctaaatgacggcgccaacggtgcctctccccctccgccatggcggcggcgccattccccctccccttcccccaccgccacgacgctgctcccctccccctcccaaggtggcgggcaggggcagcgccctcccctctatcggatccagcgggaggggaggaagcggcagcccgatgtccctgcgacgatggcaccctccccttccggcgtcggtgtttttgtgcttgtgatgttcttgtgttgtcgttgttgttgatgaaatatgttcttgtgttcttgtaacagtgttttctctaggatttggccaaatttgattcggactcgcattaagtgtcaaatcgaattggactttctttttttttatgttattttcgcccttttttttgttattacggacgatggaagcaaattgaatcggatttttttttaaaaaattttttttcaccctttttggttattaaggatgatgacacctcttattttttttaagtagtagagattagaaaaaatgcccgtgtgttgtaacgggtgaagtctatttttaatcttattattgttatatggtttagttaagatgaagttcactctggaagtttgcttggatatatatatatatatatatatatatatatatatatagaaaatcatgagctgcagttagcaatctgatcatctcaagttagcatgtaagtttttttaaacatatttcttatatggtttcttctatatcaccaaaagtgaacgatcttaaaaactgactcaaatatggatatgtatttccaaaagcaaacgaacttaaaaaccaatttatacacggatgacgtatcaaaatatcgacaaaaacatctttaatttttataatagtagagattaaatataatcttatcgtattttcaatcggtacttgtatgcagcttgtgtggttatagccatttatctcaaagcttgatatagccggttcaactcttggcacctcaatttatgcttcttttttttttattttttttggtgtgttgcgcgagctgcttggtgacgcctgtcatcacgtcgtcttctagcgcatggctcgacgtttatctcaccatgttgcacgagctgtttggtgatgctttgttttcacgtcatattctagcacaacctgacccggcccatggttatgacgctggcattctggcaatcacatcgtcctcctacgtgacgccatcacacaacttcttgggctccatgacgtcagcgagcggctagaggcaagccaaggtgagcatgcagccgcacttgcaattaaaatgcacacaggagtttatgcgttgttggctggttgtctaggaactcgttggagttgatgcactgttggagacgaaagcattcgagtgtatgcaagggtatagaagtccaaagtaatcattcaaatgccaaaacatcaagaattctcatgcaaaggacccaagcgtcaaacatcaagaaatatagtacctagggagtagatttttttgacagtatggtggtgtttgaaaatcctgaagataaagattaagtgtttcacgcaaaacgagatggtagtagcgtgtgattaattgagttttaattattagaaacttgaaaaatggattaatctggtattttagagcaactttcatatagaaagtttttacgggaaacacactgtttagcagtttgaaatgcgtgtcacgagaatctaaaatttcattcaacaattgttggacattcgaacgcagcctatggcttttcataacacgttgattatttgatcaagctgaaataagaacactcaattacatagtcactttcattttgcggtcaagcacggattggaataagcgccggtttgacatgaagttcttgaaaacacagggcatcgagataaaataaaaatttatatgcttgttattcatacatctggttaggttagagggtcaacctagattttcacgagcataagcagatcctagattgcacatcaagggtgctagccacatcctcgcgcgagagagagagagatcgaggtgctagcgcatagtgtaaccatcaccatgcgcaccttgcatctcagcacaatgaaatgtgtaacctatcttttatccaaaatcaatcatttcatttcgtttaattcgtagcacaccagagataaccatttctcaaattcctctttcttatatcgattaatgtgtatagctgttcttttca

SEQ ID NO: 48091 - DNA, 7590 bp, Oryza sativa
  unsure (1)..(7590): unsure at all n locations
cacatacatacaagattgttattaataataatgaataaacaatttaacttacaagctcttgatgtggtatgccacttggatgtcgacgctcaatttgctcgtagcagccctgaaacttgcttacttccttctgaatgttaccccaaagtgctcaagagagtttgcattcctatcagactcaaaatcacagttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttccttttgcaccatttgttgaagtatgaaggtcttcattttgcattggcaaggaatatgcctcaacatgggtctcttcggacatcatgcacataaaggaatcacattcatttgccatcacaatctagtcactgcaataagtagataaattgacaacttctccaatcaatctcaggaaaaatggcagatgctagctaatatatgttggtagaatgcataatggtagcaaatttttccaatcattagaatttagaacaggttatgctagagctctacaaaattgaattaaaaagaaaaccatatagcaccccaaagcagcttattttttttctcttttttaacagtctactcgaagaacctgcatataactaacatcggtacaaataaaattgtgtagctcaggaaattaagcagcactacacccataccctctagaatacgatcacaagatttcaactggcacagtgtctcaaagtcatgcatattgaaaatcacactgaaaaccatatagcactatccaaaacttacaattcccaaaaccatattagcttgatccaatttatctttccccctgctaatttcagttacagtttttttttgtgttgaccttattactaatgcaattgtttaactacttgaaatcaatcatcattacatgagctcacctgaccatattatacatggattcagattttcatttgtcaatgaaggagttactatccaaactatgtttcctatacgcgtatgcatggctatttttcatatttctgaaactacaagattaggaacctactttcaataaattagattattcaggaaaaaatcaatcagatcattccaaagaaagtataattacatatggattatgagattaattattgtattaattaacagtcaaacatttgaggaaaacaaaatcacataataaaacaacaaaaccatctcatcgtggaaggttagttcctacccatttcttctccaaatatacattttcgtactgacaacttttctctcaaacacgctaggtgctaccatataactcaatccacaaatccactagaaaaatgaaaacatgataccttcaactagcgcaactagcaccagggagaagggcgtcaggatccaggaggatattgccaggtgggcaggtggccggccaggaaggagggcaccagggaggacgcctgcaggggaggagggtgccgccgcgccagccaggaggaggatgttgggaaggaggaggcctaccggggaggagtgtgacgggcagggaggagggcgccacccgggatgagggcgtcggcaggggaggagggcgccggccaggaggagcggcgtagatccgtggaggcgcagctagcgggatatttcacgtgaaaaaagaagtgcccgcgtgtctctgccgcggatgggggctgcggagaaagcccctgggactgggggcctgaggggataatttggaggccttcctattttaggggctttagtaggggccttattggacctgattttttagtctcaactctcaaaattagtataggggctgtgtttagaacctctactggagatgctctaagggaaaatatatggaatggagcctctgcaaccctaattagtgtggatccatcttatatatattgtcatcacataatatttcatgataggaaaaactataagctatagaactttaacaccgctgaggtcgataacatagcacacctcaaagtttaggtggatcaaacacgttagccacttgccactaggtcatggctgatcagtgacagtacatggtggattggtgccgccctgatgcttagaccattgctaagattttcagcccgtgtcaaaagacaaaaaaagaggtttctatttaacaaatactaaataaacagagtacattttacttcaatctatataaatatagaaaaattgcatgaatttcatgtgatcaacgtcaactagagctataccaaaggaacttactaactgacaacgatggtgatgatcatgactaagtaggaactaagaagaattatcatatcataaagcagtgattcagttctccttactaagcgaacaaatatagtggaacctttactgcctggaatgcacattcacatcatcatcatgagctttagttctttgaggtagctgtagccgagaaaaaacaagcttgttctagctaaataagtgaaagagaaaaagagactttaaaaaatagaacaagaagatcttaaaattatattaaaagtgcatttggctttgactggattataaaataagaggttattttttgaagggaagatgttgggttctggacagcaaagttgggtcacgtgttccactatgtcatataggacgctccgtctttggttgaggtagtgcactatgattaaatttacaatttttgtaacctgttattgaatttaggtttcgtagaactcccatccggttaatgaaatggtcgacaattttgtcgacaagagtttttttctttaagaattttgtgtaacacaatatataatatatgttttgagataggagatacagtaggtagcaaggccctcgtagcgatgtcgcaaacttacaatagaaggtcaggccaaagttataaaatttgataatttgattgtattaacacttgtggcaatgaccacgtgggaccttctcgagtctacgacggtaagtcaggatgtcaaataatcaaagtactccctccgtctcaaaaaaagtaaacctaggaggggatgtgacattttctggtacaacaaatctagataaagggctgtccagatttattgtattaggagatgtcacatatttgcttgagtttttttttttgacggagtacagtttatataggatgttaaaaaaagaagagagagagagagaaagatatctctgggccaaaggtagggtcggacaaatgggcccaacagccaatacggtactagttacgtagcccagcaacatggcgccatccgtggaacggaacgggcgtccccttcccgtgtcttatccactcccaacgttccattctgtggatgcttccgccaccgccaccgcccaacgaccagcagcaagcagctcagccaaggggctccccatcgtatcgatccccattcgcgccgtcctcttcttcttcttcttcttctcgattcataggtgtggtttccatttcttgctgtggttgctggttgaactagcttttgctttgcttggattgtgttttgattgaggggtttgttagtgttagcaatctaacccaagatatctttgcaattatatgctccagttaatccgtcaggcttttgttgcttgctgctgctgctgcggtggcgggtggggaggaaggatgctgattgcggctgatttcccgggagattcgacggtgtcccgatgcgcattccccggtttgttctgagtgatgatgcggtctccgtttcgtgatctttgattgatgagccgttccgcggtaagctctgaaggcggcattgcgctccggctcttcgtggactggaggatccggcgccggagggtctgcgcatgcaagatgttcgacactggttcccaaaggggtagggtgaagcagctggtggcttttgccaagaagaggaggcggcccaagaagcagccgtcgcggcggccatggtggaaggcgtggttctcggactggaacgacgaggaggagagcttgtctggctggagggaggatgaggagctgctcgaggaggttggcggcgaggaagggctgtcggacgacgagaagtttgagacgtggaagaggaaggccgaggctattgtcgagctgcgggaggcgcggcaggatgccatgaacgcggaagggcgctcgtgggaggattggattggcgggggcagtagcacagcgggggatggcggcggtgactggggtggggatttggatgtgtcagacctgataacggatgatcctacagagatagtgagggataaaggtttgattgaaactttcagagactctgtagatgaagattacaatgacatgctgtttgaagaccgggtttttctgtatgcttcaacgaattcggtgagctctttacctatcttgttttctgtcaccaaatgttataacccactgtccagtgataaccatgagatacttgtaatgctttttgaatatgatgaactacttcctccgtttcatattttaagtcgttttgacttttttcttcatcaaacttctttaaatttgaccaaatttgtagaaaaaattagcaacacctatcacaccaaattagtttcattaaatatagcattgaatatattttgatagtacgtttgttttatgttggaaatgttaccatatttttctataaacttggtcaaactaaaaaaagtttgactggtaaaaaagccaaaacgacgtataatatgaaatagaggtagtactatataatattggagtgcataatatagcaacaaactttaatctttacaccttacaatattatcgaacgctgagggtccattttgatggtaatgattttgcatctggtggctggtgtattttgaccattttgatgattaaaaattaaaaatgttaaaaagtgtagcagcattatattgttatattaagaccctagcaaattggatctaacaaaagaaagtttgcactttcaggccaaatttctagcattattgattgtgattccatgggtgttggattttctggttcatgactatgttctgatgccatttttggaaaggtaaatcctctcacagtgttccatttttactttcttaactttttcccctcacttcttaatgtaagaaaatgcattccatgtacacccaatctgatgtttaggaatttataaggtgaagtttcaagcactgatgatattctcagtttctcactctctgtgcttctgaaattacatgcgatcaataatcatctatgctaaatgcagaattgattacatggaacattacacaataacaggtacgtccagaaggtaccacttgctgctgagctgcttgatgtaaggcgcagccagaaactcctgatggtaaaggacataaatactgagaaagcaagatatcgttttgaagtagagattggtaaatctcctccactttctgatgatgagctctggtcagagttacgggaaaaagcgtgagaaacactctaactattatactttcttgccttgttgtaacttctgttgatgcactagcattgtctgacatgagcaatggaccttctatcctgcaatttcatatgttcaatcttaacagatctgctctgctacttgatcaggatagagttgagagatgaatggagattagaaaaccgaaaagcgtttgcaaatatctggtctgacatggtttatggaatttccctattccttcttatgtacttcaaccagagtaaagtatgttttatcagataagcagctttgttttttttttccatctttgattgtgttccaataaatttttcagctttctgagtgtgcatgtgagctaagtgattggttataaataaacaccccacaagttgacaaatttctgcactattaggcctctctcagagttatccgatttctgctgttaatacatagtacatgatgattttgtgccaaaagaactgcagtgatgaactgaccagagtattcccccattctatttgtacctggttatacatcatacttttctgacctagtgcagtagtaagaccacctcagtttctgcaatatgtttgannnnnnnnnnnnnnnnnnnnnnnnnnnnnnnagtccatgatttatgtacaatgaattcatcaatctatcttatccatcatcgtagcctatttttctctcccattgaatgcttagtgttatcctgcgtacaacttattcttattgcctgctaagctttcaggttgcgatgctgaaattcacaggatataagttactaaataatatttcagacagtgggaaagcattccttataattctagtttcagacatccttctagggtgagttacaattcatttttcttgagttcatatatacatgtggttttagtgtgaacctagtttgtaacaaagcatacactaaacaattgtgctatttcttttgctggataatggatgtcagcaacctaactaaaggcaaataacatgagttctaacctacctctctcatgtgttacctgcttatctaaaaaatcatacatttaaataagtaattcttgttaaaagaagattcgtccaaaatgttcaaagaagttaaagaggaggccagagctccctccaggggagagtgccttttcttttcagaaactaatatcagggggatactcagcagcatgttttagaaagcaattcattatatcttgtcatcatgattcatgagcgattttttaaatattctctcataagtatggataagtttgtaaaaatgcatggaagaaatattatagctattttttttgtcaggaatgaggcagatggttctgtgtttcttcttcgttcgcacttcaaatatgatcttaatatttcttcatttttctctctcttcaaagatgtttgtagcattcgtgtggcagaatcttatttatcatctagttagaaacttagaatagtgaacctaagtggtacagtatcccgttagaagttaattcacacaaatgcatatgaactgctttgcgaataatggaattcttcctgttcatgcttatgttatacatcatgacatcttttctgtttcaaacaaactatggatagtttgtaattttgtttctgctttttttcttgttttcatgtaaacgtaacacaaggttaacattgttttggtttgtctgtgatcttgttgactatattaacatcatttagctgcattttcacaggtaccattcagagtcaggttggcattctttggtagaagtcattctcgagcactacggccttgaagccgatcaagctgcaatcaccttctttgtttgtctggttcctgttgccttggatgtatttataaaattttgggtcagtccacttcttgccttcacacaatcaagctaatagggctatgaacatttattttattctttaaaaaacatttatttcattttatctttttttaaaaaagaatataagtgtttgttaaggcctcataatttatgactagtttcacccaaagttgataacattatagattcacgtttggctactcagcgctaacatttcagataatattaactgaaagttttatagtctttctacaaagtgat

SEQ ID NO: 48092 - DNA, 11264 bp, Oryza sativa
ctacacaaattcaagaatttcagaagggctgcctcgttttctgatgttaactgatcgatggccattcaaattgaactcatgatttaacatccccagtcaaataactccaaagtaaaaatctgcccttcaataatcaatacacaccttgctaatttatatgatcaaatgttctatggtgttttgacactgaaattattgccatacccttcagtcacccccaaaaaaaaccctacaaccttacccctattttgagcaattgtttttccctttcaaaagggcttacatgaaacacagctgaaaatctgaggaggttgcacatatgcagcactaaagctgtgttggttgctggtggttaccatccggaacagtgcgcgttagtgcgtgtggaaaacggaacagtccattagtgcgtgattaattaaggattagttaattttttttcaaaaatggatcaatataatttttttaagcaactttcatatagaaactttttgtaaaaaaaagcatcgtttaacagtttaaaaaacgtgcgcgcgaaaaacgagaggggagtgttgggaacttgctcttgcaaacacagcctaaggcttcatcctttctttttccttttcatatatatagttttatactagtaacagacccacattacaattagggatgagctagagggtgattgaagataaagcattggatcatcacgcgatgggaggaggagatggaaggaggcgactgagcttttaccatagtagagatatcatgccaaactcctttgtatgattgtgtgatctctgcggctctgccacacgttgctccactgtggatacaacttcatctcctcttagagcaagtataatagtaggctataagccggctaaatactgaggtggaggagagaagaaaggagagagaggagaagccggctgtaaacttacagtcggcttggacacaagaaccaagaagctctgtgagagagacaagtggaccatgtattaattgtaaagagctaactattatatgggtagcctaagggcacccacaatggttatctataggctctctacaagagatccatgtcagcatattttcctacttggaatgtattaaatgaagagagagagcaaagctatctactaacttagagatagtctatagagaaaaacgaggcaatgcatgagagagctatagataccaatgtagacatactattaaggtggtttactattaatcgagtctattgctgagatgtacatgttttatagatagcaccttactttaccattgcgggtgctctaagagaaggctactaataaccttaccaacaggtcggttgtattattagccttgctcttaagctatccatacttccatagccttttttttttgttttgtttctcctacacctggcaagcctctcctcctggaaatgctggtgatgagtcaactgtccattacttattgctgtgatcttcctgtaggttactactacctactaacctggcactcacctgatctcaacctagggcatgtaagtacacccctgctgttcatctctgcaatttttaatactagtagtcacctggtttcccccttttttgaggattcttgcttgcagcacaacctccacttgtggtgacctattaatgcctcctcctcctcctgtccctgtcatgtcatgctcttgttcctgtgaggctgtgatcagtgcagacagcttcttctgctaccccccacaagcttcctcaaagaagagatcggccaccattttgtggtctcatttctgagctccctttttgtttcctgattgctggtgtttgattcctgtttttttttggcacaaggaaattttctctgaatttcagttagtttgaggtctctgaatttgcctgctgattgctgtgtattttcctcacttctcttgttccatttcagctgttcttggtacacttggcacttggctgtgtaccaagaacaaatcagattccacatatatataagttctttcttgatcgatcaatctttcctctaaccttttggtgtgtcacaaggtttgaggctgttgatgatcatctccaagaatcaaacatacccactctcccagccttttctgaccgattcctgatccaagattaacaccacacacaatccacaaaatccccaaaagtatcccaagaaacacctcatttcttgatcagaactacactctgcagaagcaaaatggcgccggcgccgctcgccggcggcaggctggtgctggtggtggtggtggcggcggcgtgcatggcgcggtggtcggaggggatcggcgtgaactggggcacgcagctgagccacccgctgccggcgagcacggtggtgcagctgctcaaggacaacgggttcgacagggtgaagctgttcgacgccgaggacggcatcctggcggcgctcaaggggtcgggcatacaggtgatggtcggcatccccaacgacatgctcgccgacctcgccgccggcgccaaggccgccgacgactgggtcgccacgaacgtctccaaccacgtcaacaacggcgtcgacatcaggtcagacactcgatcagtaccccagctcgccaaaaaaatatatatatatatatatctcgttttcgtgatgccaattgcaaggtgtttcgatgaaacgcttggccgttggattggaaacggacgctccagatggcttctacgaacagtaaagataggctcttaggctgtgttccttcgggttgggaacccaactcctcctcacgaaaaacggagcagttcattagcgtgtgattaattaagtattaatattttttttaaaaaatagattaatttaatttttaagcaacttttgtatagaaaatttttgcaaaaaaacggaccatttagcagcttgaaaaacgtgcgatgtgagttgggaaagtgggggaaataactcggcctagtttgtatccgaaaatatagcaacctatagcgttcaaaatctatctcgaaatataacaatttccctataaactcacttatctgaaccaataacaccatacatattttctcattttaaccaatcataacgaacttttatttagtttaacctatttttttaatacccaagtagaactacataaatctttgtatttttttggaaggagagattatcatttttttagacaacatattttctaagagtatcatatatattgtggtgcaaacatatttttggtggaatcttggtgtttgttgtagaagttaaaaaaacaaaggttaactaatttgagaaactgaacactacaaataaaaactttaacatcacatttaggctaaggcattagtactttacttcactctcaagacactgcaagcctgcaatagcaactagcaaagtgttactgtcacactgtagagttcctgaaaccaaaaccaaaatgagcatgtcttctttgacatcactggtgtagaagcttcacaggacatctagcagtcacaaaaagttaaggttcccttctctttattggcaagaccatagccacaagcaactgaaaattctttctgttgttccaacagttcaattgcaataatcctgcatggcatatcaaaatcaaagtcagggatgcatgcctttttttgttttttttttcctttttgctctttctcttttgctcagtgctactgcacacacacatcacacatagctttgagaaaaccattatctctggtgttcatgatttgccacttctgtgattgggacatgtatgggcagtgatgaaatcagattcaggggaaaaaggctaaagctcaagaaaccgaaggacacagcaactattttgagaggttttgacacgttttggtttaggaatagtctctcacaaatcacaatctctcttgtgcctttctagaccatcttgtccagccatccagaaagatcatgcagctgctgccagtagccacatctgcattaatcttgtcttgaaatttcatccacactgtttcttattactgaaagtaatctcttttcaccttatctttaaaaaaatatattttatagccctgaaattttgggttgcttggaacctagaagcctctaaattctgaccaattccaacaaaagaatttcataggttattaaaacctgatatgtttcaatcattcaactttattactagagccaatttgtttgaagatttaacaaaattattgtggggctataattaattgtgatggtcacaagaacttgggaccatgccacaatttttctcgttctagcgtcatgaatttcagtggaaaatgcctggcacagaggcattcatatggtatatggagattttcagttcttcgcagcatggtcatgcttccctgtctgatgcagatgtctaaccgtgctgaagtgatccttgcctcaaataatcttccacctcttcatcttaaaatctcttttagttctctgaaaatttaactgtgtatatccatgaatagatatagaaaccggatttctatcaattaccttcaaaaaaaattctctgaaaatattctgctgtaataatgttttttttgtttgatgaaaatgaatacgatactagtaaaaagctttactagaatctttaaaaaaattgaacttttatagctaccagctaattaaattcaacgcttgagatcttgttcgtaagagtagaattttaagtacttacggtagtgtttggatgtcctaaagatgaagatgaaaataaagattaagtgtttcacgcaaaacgaggttgtaataacgtgtgattaattgagttttaattattacaaatttgaaaaatggattaatatgatattttagaacaactttcatgtagtttttgcacaaaacgcaccgtttagcagtttgaaaagcgtttcacgagtatccaaaatttaatctaagttttgttggagaaaagaatagggccatatatagagagaatttactcgatgaaaaaatgatgctttttttttaattttcctgacggattgtggttggcaggtacgtagccgtcgggaacgagccgttcctggagacgttcaacgggacgtacctgaacacgacgttcccggcgatgcagagcgtgcaggcagcgctgaagaaggccgggctcgccgacaaggtgaaggtgacggtgccgctcaacgccgacgtgtaccagtcgccgacggggaagccctccgacggcgacttccgcgccgacatccacggcctgatgctcaccatcgtccagttcctcgccgacaccggcgcgccgttcgtcgccaacgtgtacccgttcatcagcctctacaaggaccccaacttcccgctcgactacgccttctttcaggtaggggtgaaaatagtatgaaaatttttcgatcgtactaacgttagcattcttaaaatatagttttttcagtatcgatttgacgttgatacactaaatagttaaattcataaatatagtaattattcttatcattttcaagaaaaaactaatagaaatttgatatagttcttttaagaactaatagaaaaatggtaccgtttccgaccatttctgaaccgttttcatccctactttgattcagggctcgtcggcgccggtggtggatggtggcgtgacgtaccagaacacgttcgacgccaaccacgacacgctggtggcggcgctgcggcggaacgggtacccgaacgtgtccatcatcgtcggcgaggtcgggtggccgaccgacggcgacgccaacgcgaacccgcagtacgcacgacagttcaaccaggggttcctcacccacatcgcctccggccagggcacgccactccggcctggccccgtcgacgcctacctcttcagcctcatcgacgaggaccagaagagcatcgagccgggcaacttcgagcgccactggggcgtcttctactacgacggccagcccaagtaccctctcagccttcgcggcggcggcaacggcaatggcaatggcagcacgctgatgccggcgaagggtgtgacctacctgcagcggcggtggtgcgtgatgaagccgtcggcgagcctcgtcgaccagaaggtcggcgacggcgtgagctacgcgtgcgggctcgccgactgcacaagcctcgggtacaagacgtcgtgcggcggcctcgacgccaaggggaacgtgtcgtacgcgttcaacagctactaccaggtgaacgaccaggacgaccgtgcctgcgacttcaagggcatcgccaccaccaccactgtcgacccctctgccgggtcatgccgcttcatcatcgagattgcgcccaccgccaacggcgtcgccatggcggcaacagttagggtcgccggcgtcatggctgccatcctcgccgtgttcatacacttggtggtgcccgtgttctgaatggctccaacatccttagcttatcctcttaatcatcatgtatttatctcttgtttaatttaatttaaacacgaaaaatagttgtttttgtttatcttgtttatcgcctcgcatcctgcattcaaatattatcggacgtgctccccgcgtaccaatcacagtagttagatttgttttaaaatttttacaagtgaggaagaaaaaaaatcacagcacatgtacatgagagaggattcggtcctatgacttttttttttacctggagtcccatgatctctttttatgaaaatagcatgttgcattgagatttttgaaaagttacaacaagttgtagttacgtgcaagttataaaataattatattatgattgtattataattatatttgttaaatttccgaaggtaaatttatcaacaagggactagataacagccggctgaaaaaaaaattatctcagccaaattttctggtcgtccgatgaaccacacgttgccatctcatgcctggactccgtgcgcgcctcccacgcatgttgcacgcacaaataacgaaatgaggatttttaattaaaatgccattatcatgacaaatgaaattggctctgccctttcctctaattatcatgataggttatcgtttttcccattcaaatcattcatgataattaattttataactaagtgggagaagaaatagaaagcaattaattcatatacttctagtatgcactcaattcctaatttacatatactagtatacaatcgtgtggccaataccccctaatagtgtcctcctggtacttcgaaagaccactccgggttgccgagttctttacaacaacctgttatggtcgtccaaccggggctgaaaacggagtactcttgacggtccttaaatcataatatttgaccgtcaatacctgcatataatgaaataaaacatgatatccattatttaattacttagtctgagtaagatagatttccatctttgtgggttcattatttagtatttcgtactaagtgctataggactaggactctgaataaagaaggaagttcctgcgcaagtattagagtaataattaataacttagacgtggtgcctaggttagagactacatttgtttgttgtgtatcccatagatttgtcaaatgtaggcggcaggtggtgatagccctgaatcccgtcctagtaatcctccacgttggctttagacttttcgacttataaattggcttataagtctaaacaaagagcgcctaaaggaataagttcactttgactcccttaaaagtgacccaaatctaattcatgaccctgaactgcaaaaccagatatcttgacccctaaactgttaaaaccggtgcaatttgactccctcaacggttttgctgacgtggcgcctacgtggcgatattgaccgagtcttcgttccatgtggcgttgacgtggcacttacgtggcattagaattaaaaattatgcgtgggatccattagtcattcacacaaaaagaaatgtgggcccactgccatgtggggctcacatgttagtcctccctgtctcattccttcttcctccatgtctcccttctctctctctctttccccttcttctttctcttcggccggtggcggcggtggtagaggaagcggcggcatcaagcagcgagtggggaaggaggtgggtggcgcggctcaccgcgaggagcagggtgggcgacatcagggtggtgccggcagagcgatgtggttgtggcggggggatcctggcgaaccgcaacaaccttgcgcgcattgcggggatctgaccgataagtgcttcgagtttttcccctcgccggagttcatttctcgccgccgcggccgcatcccgaagcctccgtcggtttcacggccgcgaaggcgaagccgcggagggcgggaggagagcgggaggaggaagaacagtcggcctggcttgcggttccgcttccgctgggagtcaccaatccaatccctaatcccgcgcttcttactctccgccatctccatgctacgctcgctatgttccaagtgattgtcgatggggctatctatgatttttgggtggttgggaacagaagcctcaagtatagttccctatgtatttcagttggattcatgttgcaagttacagataaatttttggcctgtactagttttacttgtttgttaatctgtatgttacttgttcggctgtgatatccatctcttttgcaaattataccgctatatcatgtaacgcttaatcacattcgtgagctaacttacacctcacggtggtaatatggattgtgcatctcctcatataaattgttcttctactcattgagcttgcttcttccacttcaggtgtgtagagaaggggcaagcaacatctgcacaaaatctgctggaggcatcgtctatgattgctgattcctcatcctcttctcagccaaaggcagtagcggtagctcacgataccattgagttctccgaaccatcagggcactgcgccactgcctttctttgtctcctgtctcacgcatttggtcccgactgatgcgtcaatggggatggcggcgggcaggagcaggccgacgtcggcatcaagtagcgagcgggggaggaggtggtcggcgcggctcactgcgaggagcagggtgggcgacatcagggcggcgccggcagaacgatgtggtcgcggcggcaaggatcctggtgagccgccacgcccttgcgcatgtccggcttggaaggggagagagagaagggagagaaggaggaggaaggaaggagacacggaggactgacatgtgggcccgcatgtcagtgggcccacatttctttgtgtgaatgactaatgggtcccacgcatattttttaattctaatgccacgtcaacaccacgtgaaacgaatactcggtcaatgtcgccacttaggcgccacagcagcaaaatcgtcctccaaaaccgttgagggagtcaaattgcaccggttttaacagtttagggggttaagatatctggttttggggttcagggccatgaattagattcgggtcacttttgagggagtcaaagtgaacttattctgcgcctaaatgcacgggtgaaaacggtagggcattgggcctttggttttgctctggacaatgggccgaggcctgagtacgaacagtactccaccaaatacggagtgcatcgtatccgtatacgtatccgggtgccaattcaatcattggttttcccgatccaaaaaaaaatcggagaaatacgccctactcggatttcaccattgagcccctccaaaacctgctatatttacatctccgcccctcccatcgaaggcgagagctcttcttcttcccctcctccaagcaaaaggcaaaaaaagccgaagcagcgccgacgagacgagcatccaaatcgtcgaatccagcggcggcggaggcgggagatggcggcggcggcggtgatggtgagctcggcgagcgggctgctggcgatgctgcaggagccggcggcggagctcaagctgcacgcgctcgccaacctcaactccctcgtccacgtcttctggcccgagatctccaccagcgtccccgccatgtgagttgctccacccccacccaccttcagctgtagttttccctccccgccggcccgctgcgcccgatgcggcgtttcgcgcgattcggttcgattcgtggagtggggggttggggtttggtgctctatgtatgtgatgatgatgatttggatgagaggtggggttcggctaggaaggtgccgtgtggagggaggattcatgcgattagtgtcgtttggcctggttagattcgatctggcgatttttttggatgaaccctaggttggtttgatctgttaggctggagatttcgggaggggattataatgggcggttagtttcactggtactagaaaacctaggctttgtgtatggattatagataactcaaacttccctaactgttgtggttcattcatgtattattcttcgaggagttgctgtggtcgagaaaaaatattaattttttaaaaataatttgcgtttaggctcggattgccaaggcttttgtttgaagggttctaatgaagcataattttaatctgaaaacgagcaggtggagcctaggttgagacttctttttttctgtttattatggttggtttgaggaatatgcataatccttgactttgaagtgtctgaattgcaagactatacgcaggaacattttgtttgatctttagcgcttgtcctgtcaagtaaaaacattgagctaagacatgtgtcgtctcgtttcttgtttatgatttgttcatgggatttaatgggagctagatacattggaagaggcatgtccattaaatgttttggcagttgcaatttggtattatagtttctggaaattatgttctttattcattgtcacttaataacttggtagaacttaatattttcaaggacttctctattaagcatgaagtgtttctggttacttattttataatgttatatacttgttacagtgagagcttatatgaagatgaggaattcgaccagaggcagttggcagcattggttgtttccaaggtgttttactaccttggtgaattagatgattctctgtcttacgcactcggtgctggaccactatttgatccctccgagggttcagactatgctcaaacacttttaggtgaggaattgactaaattcattgcaatcttcttattttcatgttccaaagaaacaatattgacatagttttaaaatttgtttgttcctttcttcagcaaaagctttagatgaatatgccagcatccgatcgaagtccttgaaagcagcagg

SEQ ID NO: 48093 - DNA, 7043 bp, Oryza sativa
cctgcagcccctctccttgcattccaaattgcttttgatcttgttgaaaatgaaaaccaggccttcctcctgaatgtgaaaaatcaccttgacacgctgagtttgcagacttctgcccagactttacctagcgatcaaactgctgctacagaaccatctggagatgcccaaatgacggatgatgctatcacaccaaatggaaatgcgcacactgtagatccaaatgaagtagcgcacgctgataggctgaccaaaattaaggggatactgtcaggggagacgtctattcagttgacattgcagtttttatacagtcataataggtactacctctgtcccaaaatatagccatttctagaatagtaccttgtctcaaaataaagttatttctccaactacctcctctcaaccaatcacacattttctccatcattcccacctactttcttaatatccgtgccaacctcaaaaatgctttacactttggcacggaggaagtaatgtgataatatctgacaaaattattgcagctggtcatgcatttaagttttgaatcttatgttgattttggtaattgatttgacaggtctgatcttctgattttgaagactataaaacaagctctggaaatgaggaatagtgtttgtcatagtgcaactatatgttccaatgcaatcatgcatgcaggaacaacagttgataccttcctaagagaaaacttggtacatttcatagtttacctatttgttaatgcagttctatgctcatgcatttttctccctttctgatcttcatttgcatataaccatctgttacaggaatggctaagtagggcaaccaactgggctaagttcagtgcaactgctggattaggtgtcattcatagaggccatctcacacaaggcagagctttaatggccccataccttcctcagagtggtgctgcaagtggtggtagtccatattctgaaggtggtgccctttatgctctgggtctgatccatgcaaaccatggtgaaggaatcaaacaatttcttcgtgagagccttcgcaacactagttctgaggtattttttcagggtcatggtctcttattttgtttagacagtccctatcactgtcatgaaaaaatattctaaactttcaaatattattgtacaggtcgttcagcatggtgcttgtctgggacttggacttgcagctttaggcacagccgacgaggaaatatttgaggatgtaaagaatattctttacactgacagtgctgtggctggtgaggctgctggcattggcatgggcttgcttatggctggaacagccagtgagaaggctggagagatgcttgcctatgcacatgatacacagcatgagaaaattattcggtaactattttttaaactcttggcaagcaagttcccactgtaatctagtactaggaatttgtttctcaagacggtaaatatgttcatgttctgatacactgactcctcttttctccaggggcttgtcacttggaattgcattgacagtttatggcagggaagaggaagctgacaccttgattgaacaaatgactagagatcaagatcccatactccgttatggtggtatgtacgcattggctctagcgtacaggggaactgcaaataacaaagctatccaccagcttcttcattttgcggtgtcagatgtgagcgacgatgtccggaggactgcagtattggctcttggttttgtcctgtacaatgagcctgagcaggttagctttaccttattgattctttttattgtcaagattcttgtttgatttgagtcacttaatttgagcctgacttgcctagaattattttcaatgcagactccaagaattgtgtctctgctctctgaatcatataatccgcatgtccgttatggtgccgctttagctgttggaatatcctgtgcaggaacaggattaagtgatgccatctccttgttggagcctcttacatctgatgttgttgacttcgtgcggcaaggtgctctcattgcaatggcaatggtcatgatccaaactaatgaatcatatgactctcgtgttggaacattcaggcgtcagttggaaaagatcattctcgacaagcatgaggacaccatgagcaaaatgggtgccataatggctactggtatccttgatgctggtggtaggaacgttaccatcaggcttcagtccaggtcaaagcatgacaagctgactgctgttgttggccttgccgtcttcacccagttctggtattggtacccgctgacatatttcatcagcctggccttctctccgacggcttttattggcctcaactctgacttgaaagtgccgaagtttgagttcctgtcaaacactaaaccatcgctctttgattacccaaagccgacaacccaacaaaccacgactgcttcagttaagctgcctacggccatcctatcaacatatgccaaggcaaaatctagggcaaagaaggaagccgaaagcaaagctcaggagaaagcagaagcaccaccaagtgaagatgcttctacttcaatgcaggtaagagctacagtgctaactacctaccttgttccttttttgccaccttgttcatgtctttgctacacaatgacatgttatagtctccaaattactcatgctggtctcaatccatgaattcaggtcgatggtgtggcggagaagaaagcccctgagcccgaaccgaccttccagatcctgactaacccggcccgggttgtcccggcccaggagaagttcataaaattcctggagggcggcaggtacgagcctgtgaagctggcgccctccggatttgtcctcctacgggacctcaagcccaccgagacggaggaactagtcctcaccgacgccccggcaactcaggcgacgaacgccgcagccgccaccgctggccagcaaggctcaggcgccgccgccatggccgtcgacgaggagcccctgccaccccagccatttgagtacacctcgtgatcccttgatgatcccagggctaaacacttgtactgtttgtttctaacttggtagccatgatggaatcaaatgtttctttcacaaagcttatgaattgattctttccattgatttactggtttagtgtgtggaaaaattgttggtattagtcaccagagtaaaatatttcacctgcaaaagaggagttcgatcaagatttgtattggagtctggaattggatgcgtgtcatcgcgaattttcgtttcaatttggggggtccttgtcacgcccagaaatttaacccaaatttccagactattttacgtattaaatccctgtccaggaccagctagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccacaggcaaaactcaactggggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaagacggttgtaaaacattttatttagcaaacagtaaaactgttgaataattaagaaaaattagatctccactgatcaacgctacaccacgttgaacaggcccaaccaacccacctgtactacagtgcattgagtcgatttattaagggtgagactaatcacggtgaatctggtcgatcgcccataaccgcgggcatggctattcgaatagttttactctggccagaggtgcacaactgtacccacaagacacaacccaccgacatgtcaccgcgtcatcatgtgcccatgatgcacacgtcaccatgtcgagtgattgtgacaagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccgatgcctaggaaagggtcgagctatacttcagatcaagcagttacccactcccgcttgtggcaagcgctgtaagtcttccagggtttctcgtgaaccggtccttaattgccataggtgcgactcacaaaaccatgcacccacagcccaccattcagtcgcattttagttggataattacgactatgaaacatggccagatgtctcgagcacgcagctcaacaagatactagaatgtctaatactgtaattatcccatcgactgagctagtggtaattaagcatggctaagcatatagttctagctaggtcatcaaagtaacacaagctaagcgatttatcacccatggttgacaaaggacagatatcaagtaaacatggcacaagcgagcagataggtaaaccctgatcccatgtaattagcaaaacatgcatatttatttgcaaacggtaaaacatttataaattgggaacaacatgctcaaggggaatgtgtgacttgccttgcttcttcacttggattttctgaactcttttcctcgcaaccgcgatcttccgaaacgacggattctacacgctggcacgcaaaacgaggaaaaaccctaataaaaaccaagcaaacagtacataaaaaagtaaacaaacatgtagaactcaattttagatgaattttgcaatttgaatggcccaattcggagttcgaatgaattagatatgaattttagaagttttgagccatttaaatggatttctataattattaatgatttattgcgcaattatcaattattttctcaaaggaaaaggcattcgctgacgtcagcaaggggcgccggcgccgacacgcaggccccgcacgtcagcggcacaagggggcgggcgcacggtggactcggtccaccgcggcctggcggcaccgtggacccggaccacgggagtggtccacgggcggcgaacagagcggcaaggggcgggctcgccggccagcccgacaaggcggcggcacacgcgcggacggccgccggcgatggcagcacgacgcggcgccggacaagggaggcagaagggaaaagagaggaaggaggcctcaccgtgcgccgggcggcgaggggcgatgagcgcggcggcgagctcctcgggacgactgcgggatggcgctcccgcggtgactccacgggcgggaaacggcggacggaggccgggatgacctcgacgggaaggagaggactccggcggtgaatggcgagggcgaaggggcggcaccagacggagaagccgatggaggcgacaacgcatattaaggtggtctgggacggcagcaggaggcggccggaggcggcaaatgcagcgtcggcctcaggttagcggtgggggtggttttttggtggtggaggggataaacggatcggtggccgggcttgcccgcgcggcggcgaagccggctgcggtggtggcagggcgcgggagcggctcaggcggcgacgacatgcggctggaggcggtttagggtggtggcgactcggctgcatggtggaaggggagtttcggcggaggtttgtgcaaatggagcggtggccagtgtgcggcgaggcatggtgaagccggcggtgtaagcggcgcagcgcggcggtggctacggcgacggcggcgtgcagccggagctcgtcggaaagcggcggagcgcgggctcgcgcgggaaacacgggagaggtaacgaggagcttggggaggagagggaaacggaagaggagagcacgagggtgctttttataggctcggggaggagaaatcgtggccggacgtggcgaatttgaagcggcaacggccggcgacgtgggcgacatcgtgggcgaagtggggctcgatttggcgccaaaaattggggaaaagtgggggatttggtggaggaggtggaggggaaccgattttatgcggtttgggcgcgagggcgcgagcgggaggagtcggaatcggcggcgacgtgggtggcaatggcggtttcggctctggaggccgaaggtagaggaaggacctgacaggtggggtcgtcgggcccacctgtcggggagggagtgagggaggagagccagggggttatttagactttgcgcgaggggaaattgatcgggccgagaagggaggggtcggcccgagagggagaagggaaggagagaggggcgagcgggccaaggagggggaaaagatcttgggccgaaagcggcccaaagacaaagaggggaaattttatttgttttctttttattttaattgatttaaatgaaatttgtgctattaaaattatttcttgagctccgaaaattcacgggaaatttcagagagtattttagggcacaaagaatattgcaaaatattcccggccaatgatttttaagggaaaattttaattctcccattaattcacttgaataaattgatttaacttttaatataatttcttgaaatgcattattaattgatttttaatcccgaacgaaaatcggaacgttacagtcccatcattgctttatttattcgctaagacgctgctaactcgcagtgtctcgtgtgcagcacgtgggtatccgtttgtaatgtttcgtgtcgctctcgaacgcgacctgatgtgaatggaataacagcaaattacacgatttttgtcacaatttatagtttgtgccgtacagtgtcgggtatccaagccgtcgcaaatagcaatattggctgatgagctgccctgattttaaatataaatcccagattaaaactttgaactagtttgcgttttctttttcactttttatcatttaacttgcttttcaaccgcaataaatagaagtatgaaagtttcacactagaaccttttttttttcatttttggtca

SEQ ID NO: 48094 - DNA, 1924 bp, Oryza sativa
tccagaatggggctggttagcgtgtggtttcatcacgcatgatttgttttgggttgtcacagccacaaaatgatgctagtgcgtcacctgggaaccaacttatatgtcaaaataaacgagtttgtgggttagtttagtctataagtgggttttcacggatagccgcttgaaccctcagccacaagcatgtaaatccggtctttacttaaagaaactacagccaacatatttattttatacttttacatatcttcgatgtaataattattttaaaataaacgataaaagaaaaaaataaacatattctaagatggagaggacagaactgaacaacaaataagcacgctaataaactaaacgaaagcctttcgaaaaggaaagggtgttgggggagtattggaaaagatgatcatgccatctgcaccaccatggttttgtttttttgtttttcttttttttttaaaaaaaaacaccatggctttggttggtagcactgttcacttcaccatcaagtcatctgtgagaatccttggacactttctcccacatgtgagtgcgattccaagcaaaatttggctaataagggcacgtaccgaggcctggttttgatcagatgaagatataagataattaatccattcggttggaaatatttagtactcgttccatcccaaaatataatactccctccatccacaaaagttacacatatttcacatttgagtttttctaaataagttgttcctatttgtagtttttgtgtattcaagacttaaataaagagataaattaaatgtttgattagaaccaagaagtcatctaaatgctcattggttgcatgcttacattcacttcttgattttgtaccatccaagacgatttaatttctccttgaccttgatgaaaaaagtaatatgtgtaacttttgtggatggagggagtaacaaccttacaggtttgtcccagaatatacaacttcttcaccaacattctcttctcaactaattataaccttccatcattcaattttctcacatacctccacttctcaatcaatcacaacattctctcatttaattccacctactttctgtgaaagggcctgtagcctagtggttacgagagcctcgttagcacatgaggttttgggttcgactcccattgggagcaaattttccaggatttaacggcgttatgcttttagtggtaggcgacgtacccgtcgacagcgaggcgcctgtggtgtcttcgtcaatctctctagaatttgccggcccagtcttcgaagatgctcataggggtgagtgcgcgtgcgttgtgagtgtctgcgttgtactgtgtaattttcaaaaaaaaaattccacctactttcttaatatatgtgtccaacactaaaaatcattatattctagaatttgccggcccagtcttcgaagatgctcataggggtgagtgcgcgtgcgttgtgagtgtctgcgttgtactgtgtaattttcaaaaaaaaaattccacctactttcttaatatatgtgtccaacactaaaaatcattatattctattctgtcatggaggaagtaatactgacatttaagatatgatgattcgataaaatctttgaccgcatataatttcttaaattagttttttctcgaagaaaaagtgtgccaaatttgtcttcaaaagtattatcataaacttaccggattatataaatttgttctaaaaaaagttatattacgtgttaaataagttcaggagaagcatatcatttttttttgttttcaagatagttattacccctttatcttaaaatataaaaattttggttgaatcagatatatcataatattacgaatctggacatcggatgtagtgcatcgaaccaaaggccccggttcttttttccaacaaagttggaagaaa

SEQ ID NO: 48095 - DNA, 1825 bp, Oryza sativa
agttgagggacggaatcgcaaaaaatacatctcgtgtgtgggacccggagaaagcggttggtggagaagtccagccgagctcccccaaaacgaggagagagagagagaggagaagagaaaacgaggagagagaagagaagagaagagaagagagaagcgcacgcacgcgcgcgcggagaggagaggaggagaagcgcgcgcccgccgccgccgccgccgccgccgacgggaatctcgccggggccgtcgttccgccccgatctcggtccgtctctccatctttaccttccgtcctcgtgtgatgtatgtgcttcggtttcgccggcgctttgcattgctcgaacgagggagaatccgtaatttatttatttatttattttttttgggttgggggagcggcggcgcctctcattgaatctcgcgccttttgttcttgggagcacgcggaatttgtgctattatgaatatatgcctttttttaaagaaaaaatgattttgattctctttgatagatagtataggtttggtggttggttcgcgggcggatgggacggcgtttgatgtctcaattgtttgcggggattccgatggggggagggatttgaaacatgtctcccaaaatttgtgcttgttttgtttgtttggattgccagttcactcttttagaatctgtttcgttgttaagttggttgctcatagttgactggtgtgcaaaaaaaaaaaaagttgagctttggcgtgagcaatcggaaccgatttcttctctcgttttgttaattttttttactagtaactagtacttgtctaaactatgctatggcatgaagaacgaaagataaattcgtttgtcaaggctagtgttgccacctttggaatggtggatcatggttccgtttgtcgtcagatttcctttatttggcttaaaataatacatgttccagtggctatcctgtttgatttgtgatgcctggtgatatagaaggaacatttcgcatcgtgctttgtattgtatattgaagttgttgttatgagatgacctgatggggaaaggtagaacacggttcatgcaatcagcgtgcattgtttggctagcattggctgtcgttatgtggcttcctgcaaacgcaacatgagtctgttgtgtattcctaacatatttttcttctcgcgctgtagcttgatgaaatatctggtggttaggatttgtccagcttgacttggtagctaaccacattagtaaatgttagctatttcttgtgcttatgcgtctaatatctgtcaaacctttcgcaataaattatttttaaaaaaggcactttccttctatccaatcactttcttttgtttataaaataataaagaaattaggatgaatcttcattggttggacaacgacacgatttccatctctgtgtataccactatcctttcgtgtcacaattctgtcaactgtgggatctcattttggttgtttattctctgttttttcagatatagtaccaagataatacacctgcttgtcaaatgatgatgggtttgctagcgtttgagagcaaccaagggctctggaatagtggatattattcccagctgtttgggattggaggagttatggtcactgttgccattctttggttatcgacaggctactttggaggaattggtgctccttttgccccatatttttggccatatctagcacaacttccaaagaagaaggaacggaaaaggcctgtgagagtgtacatggatggatgctttgacctcatgcattatggccatgcaaatgcattacggcaggccaagttgttgggagatcaacttg

SEQ ID NO: 48096 - DNA, 1039 bp, Oryza sativa
agattatggacaatccttctggtgacttcagcagaaagtaccgtcacatatctaaaggaggatgggccttccagttgcagatcaggggtggcaggtttcagattgcacagcagaagctcttaaggtgcagatcaaaatttaaatattaagtgaagaacaaattagcgctacctgatgcagacatgggtcaagcagggttgattttccatttctattcatctgtctaggtttaattgattctgattgattattctcgaaagtaaaatgaaaactgaaaacaagaaaaaggcatgggttgatttttccatttctattcatctgtctgggtttaattgattctgatcgattatgctcgaaagtaaaacgaaaactgaaaacaagaaaaaggcatgggttgattttccaagtctatattcatctgtctaggtttaattgattctgactgatagctcgaaagtaaaaccaaaactgaaaacaagaaaatggagcatggcacatatgcacctaaattccccccaaatctggtgttaatgtctttaagtttacgataccatctgatatcattataccatacatggaagatggagcacacaaatctacaacaaagtaatacagtttattgtttcaggctttgctactgctgtcaaagtgtttgtcagatggtgcagattatcaaatggaaacctactgctactttgacgcggtgaatgtattactctcgttacaggtgattattctgcagcgcagacagtaccacatactatagcatatgatttggacagagttcaccttaaaaaaaaatctactgcccaaataattctctagttccctagaacattaatcatttattttgctatcctatctgttactccctctgtcccaaaaaaaaagtagctatttttggttatgaagccagaaatagctacatttttaggcacagggagtagctaggaaagtaagggccctattcttgaggtcaagtactattcatgtcatcacgtgaacggtgaacagcacccatgggtactgtagaagtcca

SEQ ID NO: 48097 - DNA, 1522 bp, Oryza sativa
gctaaatgtagtgcaaaatgggcatacttgctgcatcggtctcatatttaaggaagataaatggagaacgctggaaggtacaaaccttcagaacaccagcatggcctccacatagtacaccttcttccataacatctaggcaggcctggtgctgtggcaagtttgctgcaaccttcttcgcttgctgtcttgcactatttaatacagaacgagcttcagacagtgaaccaagcctatctgttctggcaagagatcttatccaaggtttacggtaattagctatctccagagcccaaaggcgtgacatctttatcaactcatcaggggagcacagggcatcaacaagaccaccttctttcccttcctttgctgtgatgaactttgattgctgtgaacaaaacatcatgaatcccatgttgaaaaatatgaaattgtgttcgacatgaattattacaaccataacccaaaagtatgatagtaaatcagatagaaggtagagagtacaaggcatcaaccatttaaaatggagaatgctttttcagtttttgattttgttcctcggaaatgttaaaactgtatgaggtgaatataactcattttgccaaagaaaaaatatttgcaaaaacatggccaattgtctagttggaacattttttagcttttgaccaaaaactgtattagatagaaagaatgctactacgatagtgcgaccaattaattaacttaggcaaatgatatattagactcaccagcatcatttctattgctttgggcagacctacaagccttggcagacgctgggttccttcataataagcaaacttaatcagatcatgatatgaactaatacaaagcaagggatgtagaatagtggagcactagttcaatctgacatagaaagaaacactaatacctccaaatccaggaattatgcccagagtcaactctggtagtccaagttgagcttcaggggtagatatccgagcatggcaaccctgaagaatttgtcatttatgtaataaacataatttagattaaacccttgagcaaggttagggatcaactgataaatattctgcataacaattcacataccatggtcaactccaaaccgccaccaagagcaaggccttgaatggcagcaactgaaggctttttgcccgctgcacatataaatagctctatagtcagatccaggcataataatcttggtaagaactaaacacatatacacaaaggatgccagcgctcatgttggtgatataagagggagtgagaaactatgacaaaaataggaagtagagatggccaaccttccatcaaattcgacacaagctcaacagatacatcaggcataagagatacatttcctgcaagccaatgtcatgtttgtaatgaaagtgagcaatatgctataagaagcaagctcggagcaaaacattaatcacatgtacatatgacaggaccatttaccagtcttgtgaacttctgtgaacacattgatatcaaagcctccacaaaa

SEQ ID NO: 48098 - DNA, 6558 bp, Oryza sativa
agggttatatataacttgccattgctgcagtttctactttggtgaggttaccggattagcatccaacattcatcatttacagttcagcagctccactagagttccagaccaccaggaaagcaaatcttgtacagctggagcagcacactcattaacccagttgaccaagatcagctcaaatgataggatagggactactccacaaccactcagaacaacagaccaaagatagcttgatccagttaaaccatacacatctaacaaaatcacgagcaagacaacaaaacaaatcgccgctcgtattacgtcaacccgtacacacagcaatcgatcagtaaagtaaaaaaatcagcagagattcgacgaccgccacaccagaaaaatcagatatttcagttgttgtatacaggtggttaattctctgataaatttttcgcaggaaggtgggtgggggtgaaacgattagcaggaggcctcaccggtgagcacgatggccttgacgtcgtcgcgatccatcgcctccgcgtacttctccttcaatccctggatgactgcagggagcagcaaaaacccccaatcggagcacacggaatcagaaacaaaacgagtaaaccaaaaaaaaaaagaagaagaaatcgaaattaagaaacgaggaggcctactgatgggatgcagcgcattgacgggcgggttgcagatggtgacgaccgcgacgccgtcggcgcccacctccatggtgacgcggatcgcccccgccatggatgacctagggttcttcgttcgttcgatctcgagagagagagggagagggggagaagaggagatggatggaaggtggaggaagtaatctctcggagtcgggagggggagcgtggggaggcaggagttggggtatttatccgggaggctctgaaagaggaagacgaaataggctagttagtagtagtagaagcggctgattgggaagaagttgatgtctctgagaggaagagtccaaatacccagtagcaactactaggaccacgtgttatgtattttaagccctaatcttttattattattcacgtcatcaatgatgtttatcacgattttcactactaatattgtactcataataattaggggtagtgaccaactatcgtaccaataaaaccgagccttatcatttattatgcaggtataatatgtacttatatcttataatattttgtcatcttttttattcgaatgtttttgttgaagtgtcatgatgaaacaagtccctaatgtaaaaaaacatagaaaataatgtagatcattttaacatattgttatcctatattactataaaattgatgttaactaaatctcaccatgtaaatgtgtcatatcatcactcactacaaattatgtaaatatcaatatgttaatatcatgccaatataacttttttttatttttagaactcaatatacaaacaatgtaaatcattatctccacattgtttaaatatatgtatctatcatttctataatttataacgttcgttcatctacatatcccatagtaaaagcacgggatatcaactggggtgatgaagtgttttgttgtactcccttgatcccttcaatcttttctatgacgttggttagctcaaacgagcaatatataaggaaatgaaggcgtattttgtttatttagttgatcgtgaagactgttagctaaaaacggtatttaatcaagccaatccgacctagctaatcacccgaataatgcatgtgactctccctatccaaccaaaatggcctttaaccatcggagaaacatttaggaagattaaaaaaatgaccctattgccaactctcctcatatgcttagcgtatgcaatgacgcaagacgcgcgtaattagacaccacccttcaattctcactatttaaccaggtacagcaaagaaaaaactttttaactccagcatcacagtacccattttttttctcctcgatttaacacaatatatgcatagtactgttccggaaaagacgacttttgctccatacggcaataattcaacggaattgtggaaaaaatacagagaatttcttttttaaaaaaagaaaaaaaaatactagcaggtacttcctccgttctataaaaaaacaaagtaagtattggatgcgacacatcataatactattaatttggatctatctctgttcagatttattgtactagaatatataacatttattctatattcgtttttcgtgggacagagacactatgtgcggtcagacagtcagactaccacgcaagcaaaagcaagtaacaaaaacgataagatgagatgagaagcgagagctcccgtgttttgtttcgtccggaaactcgaacgagccgtcacaggcacgcttcctccaatgcgatctcttctactactacgacctatcccccgccgtccaaagtggatcggacggcccatgttcgacgcaggccgagccaaatacgtaccacgcggtggtgttgcgtacggggcaccgctatatatgtctcctcgtatacgtcgtggcggtagcggtgcagccctggccgtcggatcggagcccccggacggccgcgattttatcgacataggtacataaatgaacatgaaatatcttggttgtcggatgagtatatttgattaggagtgtgacgtggactggttgtgttgctgaaccgtcggaagtctcaatccacgaagatgacatttttcgtgtctttctgacagcaaccttgaggggatcacttgtacaaattttcttccaaaaaattataattatagtataatcatgatataattatattgtacgtaacttttaaaaatctctccgtaaaacgctatttccgtgaaaacgaatcctctcacatgtgtgcgcgttgtgacttttttctttcttcacttgcaaaaaattttgaaacaaatataatatttcaaaattatgtgaaagttacgtacaagttacatataagttatagtgtaattatatcacgattgtattgtaattatatatgtcaaatttttaagagaaaatttatcgctatatatatagcaaaattgtatgttaatcatgtctacaattaccgaattaaaaacagccaggctagtcctataagatacacaaacaaatcgctttccagtcatataatcagtcaggaatacaatatgctcaacccgacaagccaattaagcgatccaactcctaccgtaccctacataaggggggtgtttagatgagaggcgtaaagttttagtgtgtcacatcgaatattatatagggtatcgtatgaggtattttttataatggattaaaccggcctctacacccaaaaaaggatgtatttgggcactaataaaaaaactaattacataatctgtcggtaatccgcgagacgaatttattaagcttaattaattcgtcattagcaaatatttactgtagcaacatattgtcaaatcattgagcaattaggcttaaaagattcgtctagcaaattagtcgcaatatgtataattagtttttttttgtctatatttaatactttatgcaaatattaaacgttcgatgtgacaggataaaaaattttaaggtggaatctaaatagggcggaaaatggttcgacttcggggttcagacctgtccatgaactgcctgagtgacagactcacagatgttgaacacaacaggaacttctgacaagatgttaatttctcgtcacaccctaatttgtgtgcttgactacaaatctacaataaagactgttttttttctaatctaaagactgcacgtttttgtgacaaacatgctgggtccaaaaaaaaaaaagaagattagaaaagaacatcatagcaacttccttcaaaaaaggacgagacgagaccaacaagcaagtcgagtcttcgtcaagtctgaggaattcatatgggaagttgtcataaaaccccagagaagttgtcatgaaaccccggcgaaaccacgcactccgcccacatgtgtgctttcagatcatcacatggcgcacgccatggtccaggcagtcatgttgagggctttcagattccaaaagttttcagactccatctgagaaattcagtgtgaaatccgtccactgactagcatatttccaacatttgagttattttaactttaccaagggaaaacagccgtccaaaagggtcaatttgcgattcaacattccaaaaagcattccaatttcaacacctgcaataatacggtccatttggatgtaccacagcactgaactcacatttccagtagctgtgtccagtgcatctgagcttcctctcggtgaggtcaagccatgatttactacgggtaatgtgaacgaaataaacatgcacggcaggaattcttgtagagttttacagatcaacagatagggtagtgctaacaagttaaacaattattgttggaacatatcattgtttgcatcatatccagcgcgttgccttcgagcaatcaggtttttctcaaactccttcaggtaatctaggagcaacacacaagtgaagagaaggaatccaccgaagtagttgctgccacctccaccacctccgccgccaccaccacctttgccgaaacggaatggaggaaaaccaccgctcccatcatccaattttggcccctgagtttttcctgaaagtcacaggacagaaagtgaaattaagcgattgcgttcctgccacctatagaataaaattcaattagaggcagatctacctttggggtcagatcgtttgacggttgcagttgaagatttccgctgagcactttgggtctgagtggcattgcatcttacgctctgttgtcaatagcgttcgcacaaaaaagcagtcaatgagaagatctgacagtgaagtatgcagataagcaagctagcattttccctttcatcagttttgaagttcagtaactggaggtaaagcatcatgaataattcagaacatatattaatcattgagattgaccatgtaccagggataatattgcttcttttagtactactattaagaaaaaactgcatctataccaccagagtttcagtgatcccaataaataacatcagaacattacatcccctgtcatgctttgttcctatttcggttttgaccccttttttttaccacgcagaatgactgcaatacccactgcttgctgtcttcatcatggaggtgacactacttggcttggctgctcaatctaccgtgctaagagggaagcaagaaaccaggaaaagcatgttcttatgatcttgatctcattaggctccacctaggacctgtgtcaacatctgaggccacctggcagtgcagtcctcagcctggttgtatgcatccacagccaatgctctcagcccagccacactgctcacactgaccctcatggtgaggccgctcagaggtgggggtctcggccaggctgcagacgctctgatgccttgaccgcccacgtctctttgctccattaacttgttgcccacctccagcgacactaatgatgccgccggccactactactggctgctggagagatgtgagatttggtagtgcaacaatttaatattcacgtaaggacaaaatcaataaatcacccttatctaacaccgttgccttcaaatgtaacagaagaggtatttcgaatttttagaccaacttgctggtatatattagaggtgaaatactgaaatgttttgttgataccatcaaaattgtagtggtactgatgcagttttatctactaattaacaattcaaagcaccttatctttaaatgtatgcagcatgcacatgccatggcccatgagatatgcacctattgagcactacgattagtactagctaggaagggtataaccaataaaccaatcaagtatggtaaaatccttatctactgtattttgaactaaaccattttaacatgaatatttcatagttcatactcctcagtcccaaaatatagcaactaggacagaattggacatatcctagtactacgaatttggacaggggtgtccaatctggtcctaagttgtcatattttgggtcggagggagtaacagtaactcctaattcaatttttctatagaatctatatataatcatatataataaaaagagggtgatacatgccaatttggttattgatcaaatgccttattgtcatgaactcacaataagctaaccaaacagaaaatagtaaatttgtttgcaggaattgaacacttaattttgtttataggaagattgaggtagatatgaatctatgatatattccaacttactcttaatactgctttagcagacacttcccttttaaatgagatgcagctagcttgagatgtctgaaattgtgaacctgcccagagaaggtataatgaaaaattagtacataatgaaacattgtttggcaaaagaggatcaacaagatcacaaggtgcctgatcaggagactaagggcctgtttggtacagctccaactcctaaatattactccaggagttgagtctagagtggagttgggg

SEQ ID NO: 48099 - DNA, 12214 bp, Oryza sativa
  unsure (1)..(12214): unsure at all n locations
gagcaagtcaacaaacacagatgaatttaagaagtaatgaggtattacatattctcaatccgtggaatttttttaactgtcacgatgcaaagagaagagggccaaagacacttaacaacgagtaagggagagacaaacattgtgaaatcatgaaacaatgttgaggacagcaattcatgaattactctataaagcaaacaaatataaatgttaaagccaattatttacctccaaatctcctggttgatgcatgagtggttacagcccctggcagtgagcacgtgacaagtgttgacatggaggacacttttaagatctacaatcaagcaacataacattgtcacatatgaaaagaaatgaaatgccatgccaaatgattgcaaaatgaaataactatttactacagagtgcataaatacatggcatctcaaacctgatttgactgcttgagaaacaacacagtatgctcagggataatgttatcatgcatataaaaataatacttcctccgtttcatattataagactttctagcattacccacattcatatagatgttaatgaatctagacacatcattaacatctatatgaacgtgggtaatgctggaaagtcttataatatggaacggagggattaagtcacaacacaggtttgaaaagtatgatacttgtcatacaactccgatatcaccatagtgcttttaaaagtgtagtcgagatcccaccccatatgctcaacacctcaatcgtcccgacacccattagttttaaacaattgggcagctaacaatcatcaagatgatggattttatccaacagatagtgttacccccataagtaaaaaacaaaaaaaaatctataacagtaaccatgatccccaatttttaacaatgctaaccactgccgtcaacacgatcctgtttttgcagggttctacagggagcacggttcaggaaaatttcccaataaccaaaaaaaaatgatcatgaaggggattagcatgatctttgtacaggttacctcccaaaaacaaagaaccgctgcggcagattaaaccctattctccaaactaaaatcacaaattattccccccccccccaactaagtatcgaaaccacgtctttatcaaactctccaacaggcaggatgacatgcccacgggatgaaatcatgaaatctctaataacccttgaccccctcactcacctaggaaccaaccaaccacgcgacgattcggcggccacctttccgcgcctcgccccccacaagatcgcgttggggatcggatcggccggcctggggtggcgcgagggtggatcctgctgctgagggcgccgccgccgcctgggaggaaagggaggagaggaggaaggcgatgggagagaggaggaaagcctcgtcgtaggcggcggcgaaggaggaggcgtgccgtgcgtctcgcggggaagaagaagaaggggaaaaattatgcagtccttcaccgatctgtgggacccctctcctctggcggacacgtggcggaactagagagaattcaatattcaatcctactgtaatggtgaaacaaaatggtgaaacgggatgaggtttttcagatatactgggaacgagaaaaaaacaattatataataaataacataaaaatccatattgttccataaacgattggctgcgttctagaaaatattcctcgtttttcatatacacgaaacggttaaacggtgtgtttttattaaaaaaagtctataaaaaaattgattaaaaaattatactaatctgttttccaactgacaacctcaatattttttttctccttctcatatatacccttaatactactacgtccgttccaaattagtagtcgctttgacctttttttaaacatttgaccattcgttttattttaaaaatttttgcaaatataaaaggataagtcatacttacttttgataataaagtaaatcacaaacaaaataaataataattccatattttttttaataagacgaatgatcaaaagttatagacaaaaactcaaagagacaagtattttgagacggaggtagtactacatagataagtcctcccaactaggggtgcaggtgggtttgtccgcgaacccgcttataggcaaaattagtacataacccataggtttgaccagcgggttacctattaatttgatctataaatagatttatggatcgacccacttacatatctagatacagcaaaccagaccacgacgcgaaaacccatgaattatcatttatttgacctatgagtgaacttgctggtcggcccgcttgcatccctactcccaacatgtaaacgtgagggtaaaaagtcacgccaggaaaaaaaagggaaatgcagagagttccgaactccttaggggctgtttggatcggagactaaaattttaagtccatgtcacatcggatgtttggatactaattagaagtattaaatatagactaatgataaaaacccattccataactctggactaattcacgagaatctaatgtgcctaattaatccataattagccactgtaatgctacaataaacatgtgctaattatgaattaattaggtttaaaaaatttgtcttgcgaattagtttatacagttagttttataattaatttataatactctaaattagcgtccaaatattcgatggatccaaacaccaccttaatgaatcacaatgagaaaaatagtataagtagatcgaaagaagaaaatgaagaagaatagaaacggctagatccgggcggcctgtttggaggttgggggcgagtggatctaataaggcgacgaagctctgggactcatctccaggctccagctatataggtcttcgggggcgagaacggcactcatctcccggaagctactgccgcacaagcacagcctactcgcccgcccgccggagcatgcggaaggatgttgacgaccggctgcgttggttcgagaatgagcacgcatcaaaactagccaaatactccctctccaaaataagtgcagccttgagtttccgtgtataaatttgaccgtccgtcttatttgaatttttttttatgattactccctccggtcttgaatttgttatgttttggagctgggttgtttcgcttcaaaagcttgacgttttggcctccccacgctcactttagactagtatacccctacgcatgcttacaaaccgcattaatagatgttgatgcattgtaattaatatgggtaaaacaaaaaataaataccttaattaatcacttatttgtatctgaaatcatgtccaaaacatcaacaaatagagtaccgagggagtagtatttttattgttattatattataaaacatgaatagtacttgatgtgtgacttatgttttttagatttttcaaaaataattcaaataagacgaacggtcaaagttcgacacggaactcatggctgcgcttattttgggacggaggtagtattaggttttttaggatggaaccaaccaacctaaattaatatcctaaattaaactcatggctacccaatatttttcaccctgtcacatcaaacgttagaacacctgtatgaaagtattaaatataggctaaaaaataactaattgcacagatggcgactaatttgcgaggcgaattttttaagcctaattgctccatgatttaacaatgtggtgctacaataaacatttgctaatgacggattaactatgcttaataaattcatctcactatttactgacggattttgtaattagttttttattaatacctgaatacccccatgcgacaccctatataatctaatgtgacacactaaaactttacacccttagatctaaataccccttaattattcttctagtatgtgtattcatagcgataagcgtgcacgtgttatgagcgtctacgtttgtattgtggtactaaaaaaatcataatactaacatgttatgtacgggaaactctcaccaataattttctagtgtgtccataacgcactaattttctaaccttaaatcatcctggccgttctcaccgtgggacggcttgagcccacaatgcagttgtcctcggcggccaccacttacctatcttcgacaagcagtgctatttacactgggaccaaactgtatatgtaattttaatataattataaattttgatgtcatatttactttatgaaaaaaaaatcccgatgctacaaaatatttctgtcttaaaaactttgcacaaatcttttaaaagctactgttccatccatccaaaatatttaaagctaaacatttttaactttaattgctaaaaatgaaaaaaaataaaatatatcaataacaataagaataatatcacaatttcattagatttattatttaacaaactactctacctgtcccaaaatataatatttaaaatctagacaggaatgtcaagattcgtaacactagcatatattatccaattctaaattattatattttagtacggagatagtatcataaattcataatagctctttgtatttatagcaatttatttttataaatattattcgttaaaataacatctcaaagatcctgctaaaataaaaaaaaatcttatattttaggatgaagtgatagcagaaaatttaaaattttaaacgatcaattaatttaagggaaatggtagtataatttggaaaaataatttgtaagtataatttggaaacggaggcaaagggtggacggctaaacccccaaacccccgaacagccaaacccttccccaccttgtaaccctcgtccaaccttggtgagaaaaaaaatggcggtctcagccgtcgccgcccgatctagggccatagcccgcgccgcctcctcctccctcctcgcccgcggcctcctccccacctcccgccgcgccacctgcatcaacaggtaccgcacgcgcgccaaccctcgccgcgctctgaaccaatcccccttttttcctcacgctgttagtgttacctgctgcgcctcgggtgggtttcgcaggttgcctttggtgtccgggggcctcctctccacgctgccgctccacagcgccgtcgcgtcggcgcggttacggtccgcgatcgcgcccgagtcacagagctggggtttagtcccccaaggtgaggttcttggtcactgcacgttctaagtgcattagtgtactttgggcccctgatttcaccatgtttacttcatccaggaacggaatcggttatggtttgtaactttccagtttagtttattgtaattgatgatgttagatgaacgtaaatgacgattttttttgttataaaaaattgaccaaaataggcatcagttttgttgcgatttgttggaaatctcggtctctttattctcatgggaggcagcttgtacatcttataattgcattgtgtttttagtactcggaaatgatatgagcttgtggtttgaaagaaagtctattgagattggtcactagacccgaagcacattgtggtgttatcaggttgctgctaggggaacttctatggttgctcatctgtttgtgaccaaggttatttgtactcgatattgttttgcatccatacacaatagggagctttatgggcatattgactttttatgcttttcatatgtactacctccatcccaacttatatgtactacctccatcctaacttgtccagctgcatagccagaaataaagtatttttgatatttttgggatgtaggtagtatgttttatacactaagcttgggttgactagtccaaattcctaaatggcaatgacttgagggttttgcttaaccccaaaggattcatagtatcgtagatggatattaagttgcaagttatagatccattgattgccgagtatataagcacagtataatagctttactgattggtgatttggtgcacgtggggctttacacatcatggaagttgatgccgtccagtatgtggctcatgcatccaactgattttttagaggaagtcactttgttgcaacactggtgttaatgctgcaagcagggtgctttcctaaccattcataagaagataaagcacttctgataaatcacaagacatagatgtaaaaactagtttcattgctcacatatttggatgtcctatgtttattgatagttatgagtgtatactggttgttatgttatcccaggtcaggtcaacaaaatcggtctgtttgcttttggacagcatttgctttcccttgcaggtttgcacaaacaataatgtgtgacactccctcctcttcttttgcagggaactccatgcctttatgagagcaaagcttaccttttccgttgtaactgcctaaacaaattgtgaatgctttgaattttcataatgttcatttcgctatcagaactatgaatgagcttacgagaacttatttttctgtggtaagaatggtttggtgggtaaaagtttggttgttttctgctatactagctatttttctgtgataagaatgcttatttgacttggctgatttggaattttggatacatttgttaccaagtgaacatatttctccatctattggctctacttcctgaggtgcagtttctggtgcaatgttctcaatcgatcatatggcggcagttcagtatcattatttctttttcagcggcaacaattattgaggcgattaatggggcatccgattcttgtgatctgtcatcttactgtttgggttggtaatggattctgatcatgagactgatggattcatggttttgttctgtgaacttgagtttcctgaaactatcaattttattttctttagtcttctggcttgttctgctctatatttgcatgcgagctaagtgtataatcttgtctagcagttgttctatttccctagagggaatggtgtacatgtctagaaaatagcaatatgacaagtttacaactacttgagttgagatttttacaacgataatatgtgggtttcaaattttcaactatatagtgtatgttcattggtggtgaattatattttgaagattttggttgttcaaaacaatatagtagatgaccaaattgagtaacaagaaaatgtagccctttttggggagcttctattgactgcaacttcttctaaaatcttttcctctggaaatctagcttttttagattatcattagctgcttcttataatatcgagctccccaaacatgccctgtatcacatgagatggctgttgcgcgaacgttcgcgggaaggagtttgcacgaatggacacgtgggctgggctcattctagaagagtgcatgcaagtctatctgatctgaaaaagtatgatgtatacatgttcctttctttcaagctggaaaaacatgcatgtttaagtatataaaataattttgcatgcgcatgtagtcataattataatttctacttattgagtgattttatcatataataaaatggtgcattttgtgtataatttttaaagtcctatattaacaaatatttaattgttgtagaaagtttcctaatagaatatttttcatgtataaagtttatgaatataaacattttccgtagaaagtttgtgaatggattttttttaatcttacattttttatttttttaatcccatgagttgattttttttaattaccgaagaaagtttcctaatagaatttttttgccatgtaaagtttatgaatataaagaattatttttgtacaaagtttataagcagagattattttaaaaacttttgaataggctttaatctgaatggcatgtttaaaatttaggatataaattattgaatataatgtgttgctattaaatactgaaaaaaattaccacgctaattatgctgggctttctacttttgtatgcatatggagctgaaatttcttaataacacctacgtatgctaatttcacggtactaactgatgagtgttaattacacgctaattaggtgacgggatccgtcggatcggagacattcgtgacaggcgaatgcttgcgagctagactcacccctcctattaagtatcaacttaggctgtgtttagttccttttaaagttaaaagtttatgttgaaattggtacgatataactgaaaagttgtgtgtgtatgatatgttgatgtgatgaaaaaaagttagaagtttagatctaaacacagccttatacatactcccaattaacattaagaactcgtctggaacatacgaatcttacaggagcttgacttgtccttttgcagcatttgctaccatgaattgcggtaggcttcaagggaaacagattacttactttggaaggttcattcggcgtctttggggcctcgtttgtaatgttgcaattttacgtgaattttgaagggaaaaaactgtttcccatgaaagtcacgtagaatttcttattagttcaaaagtatggtctctgaagtttttcctacgctggatgataatttgtatgaagtaaaaaaaataatttgagcaaataggtatgctgtagcggtaggtgagaatgaactagaactatcaagggcggtctacacaacttatgatggaaaatccacccgacattgtacaaatactagatcattagatttactttgagatttgttccatctccttctagtcagcctccccccctcccctctcccctcaagacatcgatgtcgaggtgccctgccccatcgtcttctctgtctgacggcgaggagccctcggatccgctacctctagtttgttgcttctaaattagtcactctgatttgcccttgccaccaaagtatacgacatagttggagggacaagatcttataagttggttctacccttgttaaactagtaaggtggtactccctgcgtttcagactataagtagttttgactttaattaaaatcaaactttttcaaatttaatcaaatttgtagaaaataataataatatttttaatcccaagataaatatattataaaaatatattcaattacagatttaatgaaactaatttgatgttgtaaatattactatatttgtctacaagcttaatcaaatttgaagtagcttaattttgaccaaagtcaaaacaagttataatttgaaattggagggagtattaaatatgagcacacatctctcataggccgcacatgtcaaattctaattgggtaaggatgtcacacccctctagacccttaggaaaacccttcttttcgtgcttcccaaacccaaacacaaacactaatctatgtcctcttttgttcgtcggcactggagaaagggtggaggtcaccaaagttagagaaggagcacaaacacgaatcacggtttagaatctgtaaagattttgttcctaaattatccgccgaatgtcatttagcaaatccgtgaattaactggcacgcgtgtatattagttcatgtgatagaatttaaattttaaaacttagaaataaagctgagaaataaataggattagacggtaaacccggccgctcatgcatcacagaaccttatcctgttcgctcctgaccttcgttaaaacctcacccgctgctctcccgctgcgatggcagcgcgccatggccatggcgcccctcttcgttcctcctcctcatctcctcttcctcctcccagccaccacctcatcatcccccgctgcttccctcaggcgactcctcctcccgccgctctcgtgccacgcgcgccaggtgctcgacgtaatgccccagggagaccgcgtcgccggcccgagagccgccgagggagctggcgctaaaggcgcgacggcgcaggtcggcgtggccacacgggaggccggcacggcggggcggcatgggcggggccgtcatggcggcggcgcgaggccgtggaggagaggggaggacaggcccgcgcgcggaggacaacatgccgccgacgacggggaggttcagggaacgaggaggggtggggatctcaaacaacgcagggagggcaggcgctggacgagaggcgaaacgcaagcgcgggaatctggaaaggctggaaattcggggagatgccagagtaacggtagtggtggcaatgccagcaggaaggggaagaagaaagccaagggtggtgagaacgaagtcaagctgagagtcgagctggacatgtgctcgaagaggggagacgtgattggagccatcaacctgtatgattctgcggtgaaggaagggatcaaaatggggcagcatcactacagcgtgctcctttacctgtgttcttctgcggcgcttgggtttgtgcaaccggcgaaaagtggcaatgccggtagtgggattgctagtattgggcagttacattcatcgtctactcaaagcgtgggaaatttggagggagacgatgtacaatctgaaggccactctgaagatcaggagggaaacaagaccgatttgtttgcttcggatgatgggacggagaaaccgagtcgaattccagtgagtgatgagctgagggagtatgcaagaactcgagggtttgagatatttgagaagatgcgctcggaggaagagaaagttcccatgaatgagtctgctctgactgcagtggctcgtatggcgatgtccatgggcaacggtgacatggcctttgatgttgtgaagcaaatgaaggatcaaggtattgcgccaaagttgcggtcatatggtcctgctttgacggcattctgcaatagcggcaatgttgagaaagcatttgaggtggaagcacatatgttggagtctggtgtcagacctgaagagcctgagttggagacacttctcaaggctagtgtggccgcacaacaaggagacaaggtttattatttgttgcataagttcaggactactgtcagacaagcatcttcaaccacagctaaactacttgaggattggtttcagagcccaacagcatctaaagtggggaagagaaaatgggattcaggtgctataacaaaagctattgagaacaatggtgggggttggcatgggttaggatggttaggaagggggaaatggaccatatcacactcgcacatcgacaggaatggtgcatgccttgcttgtggagaaaaattgactattatagatcttgatccaaaagaaacagaagattttgccacattggtggcaaaattagctatcaaaagagagaggagatcaaactttgataactttcaggtcatctatctctgaacaccgtaaatgctatttttactaggctgtgcatttaccaatacatgtcatcaatattatgccttgattaaattacactaaatatttccgtaagtgtagattgaagccaaggtttacagcatgaaaggatacaaaattagatgggttttcaatattgagtaaattatgtatgctcagaattatatccaattgtaaactaaatataaatataacaattctccatctcattttgtatatttaatgaatactgtgcattattttattaagcagtgtgcaaactagaaaatttcatatgccacaatatcttagtttctctttattgcaattaatttttagccaacttgcagcctctttgttggaaaaagaattatcatctttaaatcataaatagttcttacagcgtgtgaatcatgatcaatagagctttccagtggtgtgtgtagtccatatcctttctcttaattaaccatttagcttgactttttcgctgtatttttctatattcagaaatggttggaaaagcatggcccttttgatgcagttgtggatggtgccaacgttggcctttttagccataagcatatttccttgagtaaggcatgtatattgtgataaatattttcttcttcttgtataacatatatctaaaatactaggcctctatctttttttaactggacagattaatattgttgctgatgttatacggcaaagatttcaatcaagaaagctccctttgatagttgtgcataaccgacatctcactggagagcgcatgcaaaagccttctaatcgtaagttggtggaaaagtggaagctttctaatgctatttatgcaacccctactggctcaaatgatgattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48100 - DNA, 36117 bp, Oryza sativa
  unsure (1)..(36117): unsure at all n locations
cttctgatcttgatattgcttctatccttgggatgggttttcccaagttcaggtaaacaactgttgcttaagcttaagttgtgtggtatgttattagcaggtgacaatttacgttcacttgcataatcgtcttatgtaactaaatgctaataattagcatgcacttgaagtatgccttagttgtatcaatatttagatacttggattgagatgcatgtttggtttgtgcacaaatataacatatggacttaaaattttatcagaacacttctgatatctaaacatgaaccttatttaatccttatgtagggtagggctgcatggcgtatatatcaaaataaatttatgttgctttataacgtggtgtttaactttagcacttggaattccaccataaggtattccaaatgagtgtttattgctaagttctgttacatcattgtctaataccaaacaactctcaagttttatattattatgcattcgtgtgaagctgtataattttgtcaatccatgatactgttagccgtcagtcctcacatgtatattttgctttcctttttctttttgtcgcgcataaagtgttgtggttattctgagtgttagtttaacctttgatgttttttatgaaggggtggtcttgtcttttgggctgacactattggagcaccttatatacattcaaagcttagcaagtggactgaaatttatggcgatttcttcaaaccatcatcctatttggaagatagagctaaaagaagcctaccattggtactctctctcttcctctctcactcacacacaaagacacaacgcagtctgtttctgatggatagtacccgatccttgccttcctaattttagtatatgttgagtatagcggttgcaattatgaattagtatgctataggcaaatattatagatctgcatgtgtatcgagtgcatatgattattacaaacatttgagtagtttgatgttctcactagaaagtataaataatcctattagtacatgcaacgaacgaagcctctgtgtcagcactgaccgccttggttcaaaattggttacatggtgggacgaccatgggccctgatcatacagttcgattttgatattattactgcacctgctcatacgctcattcattgtgcttctcgctttagtgttctgtgatgctctatcagcttgttcgataattaatcatgttacaatctctgcagagcgcaccaaacgcaacccagcaggcttcgtcgaggtcacgcatgtgagatgctatttcagctgatggcagaataattgcttgatgtgcatcggcaccctagttgaccctcatatctgggacctgaaaaaggaggtcagagcagtgttcaccatgtaatctcttttggatattttggcctttccggttttccgaactgggttgctatggcaatcggagtaataaatgttggcttcggatgccacaaaactgtaactttatggccgatagccttttactccagtgttacattaaaatgtatatggtacagtgtttttttaacttgtagtaaaataatatgcatgctctccgaatagtcatctcagcttcccagtttatttcacttaaaacgtaagggggaaggcagtaatctgactcacccaagttcgaacgtcttgctttgattatcaatgtaaggtgtaaagtctatcatgtaatgtgttcgttgtggtgatgtgtgtgcccatctactactatgaacaaatggaattttggaaccaagtcagagcattttactcactcactcactcactctgataagtttgatgtattcaaatgttagaaagcaatgaataatacacaaacagaccatgagagataacacagttaaactttcatttgtggcctatattattgtctcttgactgatctacctagcttgtactccctccgtcttaaagtgtagttttgcactattcacgttcaacgtttaaccgttcgtcttatttgaaatttttttatgattagtatttttattgctattagatgataaaatatgaatagtactttatgtgtgattaaatatttttaattttttcacaaatttttcaaataagacggacggtcaaacgttgggcacggatatccacggctgcacttattttgggacggatgtagtagttgttttgtctaccctgaattttgcccatctgacaccgataaacacatacagagtgtcatatgccttgttgatagcttgaaagtaaacaatcctccatgtcttcacaaacagcaagctgcagaacaccatccaaagcccaacaacaaatcccaaagcaagaccaaggtaaaacgacattgtgtcagataaacctttgccttcgtgaagatcaggctggctagttctgttcttttcggatgaacaatttttttgcagaggagggccacaaagtccagcattgccaatgtagatgtacgctggattagcaagagcctgaagctggttccctgaaggtattcttcctgatagattattgtaggacaagttcagttgactcaatgaagttaaatctgacaaacttgaagggatttcaccagaaagcacgttaatcgacaagtcgagagattccagcttttgtaaagctccaattttccgaggaattgtcccggtaagacggttcatggacaggttcaggttgactagcccagttagagatgacagctcatcagggatacttccatcaagaacattgtcagacaaatcaaggctcaccatgtagatgactccactggtgtagctacgatcttgcccctttgtcaccattggcagactatccacgatccgatcgttgcctgatgcgccgtagcctgtaagaggattcagagcaagaggaaggtgattctgtgtcattcctgtcatatttgctagagaagggggtatggagcctgatagcctgttgtcagcaaggtccaagaactgcagatcaggaagctctgttagctgagttgggatgctaccactgaacctgtttgatttcattctcagatgtgtcaaagatggcaacttcctcccaatccactcaggaacgatccccgaaaacatgttttgagccagatcaagaaatgtcatggatttgcagtgcttcaagaacaccggaaattctccggtaaaattgtttctgtacaagatgagagtgatgagcccaaggccatctgatgatatgttcctgcaccttgggaggtgtcctgtaagattgttatttgaaagatccagatgcaacaaatttggaaaccggcaaagagtctctggcactattccacttatcatattggaggagacatctagctcaactagctctggggcaccaaattcctgtggaaatggccctgacaaggagttcctggagagatccaggacaagcaatttctctggcaacaatggcacactgccagtgaggttgttcgatccgagatatatcgcgagcgcagacctcatgaacttcagagaaggtggcagcactccactgatctgatttacagatatgttcaggtagactgcatctgaataggatttccagaaccatggtggcaattcatccactattcctgcatttgagatatcaaggtacttgatgcttggctggtgcttgatccatgcagggaaatggggacccatctgaacatctggaaaataagcatagaccaatttgcaaggaggcttccagcttggcttgatctccattgacagattgttcagagacaaatctatccactccagactcaccaaatcagcaaaatgctcttcagacaagcttccattcaggagattgttatgcagaaacaaccttgtcaggtttgatagactaccaatccccaacggtatctcccctgaaagcttattgaaagacagatcaagaattgtgagttcagacatctccccaatccatttgggtagatggccagacatgttcaccgccgacagctgcagcacctgcagcttcccgaacacgcagcgcggcagccgccgcatgaactccgccatgtcgccattgacgctgttcaccgtcaagtcgacgacctgcaggccgcacagccgctgcaaggttgcagggatcatgcctaccatgtcatttccctgaaggttaagcacacggagatttgtcatattcccgagcgcgtcaggaaatacaccggacagcgcgtttcccgacaggtcaaggtacgtcagcgtcggcacgtcccagaaccacgagttcgccgacgacgtgttgatgacgttggtggacaggtcgagcttctgcagccgtgtcaggttcgcgcgtgctggcggcgacggcgccgccgtcaggccgcagtccgacaaggcgaggactcgcagggaagggaggttgctgacgacgccggcccagccgacggaggcgttgaggttgacgacgctcatgtcgaggtactccagcgacgacatgccggacagccacgagatgtcaccggagtagagcccgccgacgttggagctcaggtcgagctgccgcagcctcgtgaggttgccgagctgcggcggtatctcgccggcgagccccgtgaaggagaggttgaggtaccggaggtcgcagagcgagcccaagaaccgcgggagaggagacggcgacacgccgtcgccgccgatgaggttgttctggctgaggtcgaggtaggcgagccgcgggaggccgagcagcgaacggctgatctccccgccgaggccggcgccgccgtcgatgtcggcgcgcgcgttgtggagcctcagctccgtgacgtggccggtggcgttgtcgcagacgacgccgtcccaccggcagcagtcggcggcggcgccccacgacgcgaggcggccgtcggggtcgctggtgaagccagctttgatggcgagaagcgccgcccgctcgctcgggacgcaggcggcggcggcggcggcggcggcgacaccgagcgcggacgccgccgacgacagcgccgtcagaaagatgatcgccgccgcaccacctgcgcacatcatcatcatggcgccaatgcaccggagcttctaggaattaattaagatctcgggctctcagcttaattagctcggtgattaatcgagcaatgttactacaacatatatagatgatgattctgaaataatctggattattgttgaagtctacgtgaagtcgtcggcgtctattcgcgtcgaatcatgcagtaaaaatcggcgttggtagagcaagtgatagatggtgacccaattcgatcgaacagatcgagtattgatccggtcgatctcggccatatagttagcctccgttggatgttgcgatggatgatggtgcaaccattttcttggatagatatttcggtgtttgacaaattaaacccggaaatgcctcaaatcgggcgcccgccccttcgcgcggggcgacgcgcatccgcgccgtccccaccacacgcaccaccacacgcgccgttgcaacaaatcacccacatattacgaaaacgtcctattaagagaatccatttctttttttattccactaacaatgtttcagcaagtatactcgtaatgtttcactatgcattgatgaaatgttgcagtggatttttatactgtttaatattttctatcttgatggacacatggtttgttgatgtatatggaatttaagtgctacaatggcttcaaatcgtttgttgtatacgttgaactaaattatttcatctagcgatctgaccgtgtttcaatttttttaagaattgaaacattattttgctatttgctgaaatattatttttatataaggtgaaacaacgtctgattttttgaaaaccgttgtttcatacgttgtaacaaaatgttttatgagatgatttgattgtgtttcagctttttgaaagactaaaatattttcgatctatttagtaaaacatatccgatctacttggtaaaacagtcaggcgcccaattgataggtgccttgaattaaactgctttaactctatatataccttaaatgatacgggatagtattattatattattaaataaatgaagcaggtgaaagagatatgatatgtaacaaccgtaattcgattggtaaaacagattataacgattatgtgttttcatttgtatcataattttaaaaaatatgtacaccacaatataatacaataataaggtcagtatagctagctcaatcttctgctatgaagtaaaggtaggtcggtcccaccaagtaaaaataacagtctcgtgaactccatcgctcgagataaatctatgttccatactaaaatctctactactataaatattatttaagatgtttttgttagggattttgtacgtcgtcccgtgtgcggcatgcgcgcaatgatttcgtccaagacgcgcgtgccgttcaaccgtcgattgcgtccgagtccatttcagccgcgcgcgatttgttttccttgccgggcgccgtgatttgtgcacgcccactctgattcgggagtggattttgatccattgagagagaggatgtccacttatttttttacatgtcacttaaatagttataaaataattttaaaaaattgagaagatgtattagcataggatatatcattccacaaacatacgagttcaaatttaacttatattgttctacatctcgaaatgaaaaaaacaaatttgactgtgaatatacattaatagctgtagtttaatttgtttttttcattgcgagatatagaagttgaatttaaacttgcatgcttgtggagtgatatatcacatgttaatacattttttattttttttaaaaaagttataactatttgagtaacatgcaaacaacgaggggcatcccctcgagggatcaaaacagtttcccctctgattcagccagagtccattcgatgccacatgcactgcccgctcgcggctgcctcgcacaccgcctcgcatgagcacgctgcacaagaccgtttccaattatgtataatactacacactttttacatatcgacaagattcttgttttttttaatatccgtactaaacagttagcttggacctaactttgaaacaccaaatccttcgcgtttccagatatatcatatatgaaacaccaaatcttttcttttctcattcacagtgtatgttgcacatgtcatgtcatgtccattcatacatgtccacatataattttttttactcatctacacccttttctccgcctttaaatgttttttctcctaaaataattatccaatctacatatgattacatcattgtattcacacgattatattttgataaaaaatcaaacgatgtttagaaatacaacatttaaaaatttgggctgcaacactagcaaccacttatatgaaacactgagtcctaatgagtaaaacaaaaaaaatcatatcagagatacaatatatttataaaacatgatgttgttgaaatatttttatatcacatatgaacactaaactataattattaaaaaaatataaaatacttgctaaaacattccaagaacaccatgtgcaacatttgcaaatcaaatagtgaaacatcgtatgaatactagctgaaagatttaaatataataggtgcaaaatttgcaaattaaatagtgaaacatcttatgaatactagctgaaacatttaaatgtaataggtgcaacatttaaaaaaattcatgaataaagctaaatattttttcattggatcatagccatgtttggtcgtgttttaaaattttaattgcaatgaatttagtggtgcaatcgaatcatgaattagaaaagtaatttaagaaaaaaaaagtttaaagtttgctcaaagaaacttaaaccaacctaacttttattttctagtatggatgcatggcttccgatacttgcagtgggctgcacctagtcctggtgtgtctgcatgtgttggcggagattgagatgggcgtccgatttttagctaaaagatcagacatccgatctgtagtcacctttgcatgtgaaactctcaggtatttttttagaacgatcactcatctctttcataccaacacctcactccatctgtcgagaaccatgtttatcttctcaactcaggtcccgttcttttctccgacaagagttggataaagattaagattttcgtggcacgcttttcaaactgctaaatggtgcgtttcgtgcgaaaactttctatatgaaagttgctttaaaatatcatattaatttattttttaagtttgtaataattaaaactcaatcaatcatacgttaataccacctcgctttgcgtaaaaaacttaatcttcaagcattctttttttgtcccgttgcaatgcacgagtatatgtgctagtaataaaaaaatatttattgccttgtgatcacgtcttatggttccacaatagtaaatatgttgtattaattgttgcaacatttattgtttaatgttagcttcttcttcttttttttacaaatgtagatgctctaagctcaagccttaatggcacagacaaagccttcattttctgatgctgccttcattttgattattactattcacgagcatgactttagcatctgacctcgcctcatccactaatccttgcgcttggcttctttccatatggacccaggaaaatagcagatgtgtctaaacaactagttgagtcagatgttagtcgtaagaatagctatttcggtgtaagcaaaggtctattgtgcaatatcaagttgttgtacctttattctgaaaagaaaaaaaaatcctaagatatgtgcggtcaaacctcaataatattaatagatttctttgaagaactccttcacaggttacattcttcacattttatgttcttctcgtgaagatttagattttatctcgttttccattagcacattttttaaagtactaaatgatgtgttccatacgaaaactttttctagagaagttattttgaaatatcagataaatctattattcaagattataacaattaaaactcaattaattttgcgctaatgactttcttgtttttttttcctagcttcatcttcatctttagcagaaacgaacaccatagcttgtgaaaaaaagagataaaacatgcctgatagagattgagggattgtatcgatgtctagaatattattctttggagaatgaaggtactagtatttaggctgtgtttagttccacgggaaaattttttttgccgggacacataagatatactgacatatatttgaagtattaaacgtagactaataacaaaacaaattatataatccgcctgtaaaccgcgagatgaatntattaagcctaattaatctgtcattagcaaatatttactggagcaccacattgtcagatcatggcgcaattaggtttaaaagattcgtctcgcaatttacacgcaaactgtgtaattagttttttttttatcaatatttaatactctgtacatgtattcaaacgttcgatgtgacgagacaaaaaaaattgccggtggatctaaacacccccttattttccgttgacttggcgtctatcccttttatatccgagacttagggactgttcagattgatgtcattttcaaccatatcattttttggtaaaattgctaaaaaaaatgtctacgtttagtttgttgccaaatttggtaaatacatagccaaaattttgatgaggtttattttggctacaatctgaacatgccattaattcgttgtgcaagaatatgttattgcttctaattagtaaaactgtttttactaatactccctccatttcaaaatataaggctcaaccaccctcaatttaaaaactaagaaataattattatcatcttatagtttgaatcaccctaattataaatataatgtatgcatctaatagaatttaagatattgaggatggatgactaaaataataataatttagtgggaaagaagtgctaattaatggtatgcattcatgtatgcattatattatgaaacatttttaaaaaatagttgtgccttatgttatggaacagagggagtaatacaattagcaagatgccctcatttccaactctatctcatctccgtcaagcagagcagccagatcttacatctcaaagtattgtgtaacacgaaagaattacacaggcaattcgaaattaatttcttttaggctataaacatgataagttttctaaaagcattaaaagttatttctttgaaatggacgtgagtacatgaccaaacagcacggcaagtgagaacatgctgcagaattcttcttgggtgcttccacacgtcttgcagcaataattttgatgcaatggtggacagagacaaaaacattcggatcaaatttgctcataaccttccaagttccaacaaatgcatgtcatgcatttgcacaaagaccacacaaggcaccggcgactccactgcagtgctcctgtgtcttctggtatgcatgaacagatctgtaataaagaaagaacagagaaattgcatacgctcttaatagtatttctttttgtgtgtgtgtgtagataataaaagtaattgatgaaatggttatgtgggcataccaagtttatttttcttttacaaaagactagatatttttcaaccttgtcatgccacggcattgttaggttgcagcaaagttgacatgcattaatgacaacagtaatgccgccatctacatagtgtgtagccgtaggactaaatcactagaacctatagaatcgttgcgacaatttttgtaagcaagtactatactctaattaatatcaacaagtattctactttgaccacctctctaacataaattgcacatggcaaatgaacatgccgtaactaaaaaaaaggacttcattttaaaattaaatcatcatggtagagcagaaaaacagagatggagtaacaattatatgcaagtactcatatgtacggacattagttccatcattttcacaatcacttacacttgctgactaattcgctgaactggtctccacggcattgcaaaacgacacgcacattcttgaaaaatgtagcagtactcctacatctgtgctgtacatgatttcgacgtgaaattccattgtaggcgacgactccggatagactaaaatcaccagccacggccagatggtcaccaatgaaactatgaaagacgtatagtatggtttatctgttgggttatcgattgaatcggcagcgctaactgtgagatttgggtcaccgacttgttcaatgacataattttgttgttccatcataagaacgaagatgatggccgatccgccgatatgtgttcttctgtttttacgcgtgtcggagttgatcaatgtggctgtgcacatttgctcgtaggcattttaaagatatggagccccttaggataatgctgggtgtcggacgttcgacggaaggggagaaaaatcgatatgcatgtgtctgtcattacattcaaagaatcttttacccatatgctcacatctcttatttcttcaaaagatttttttcttgtaaactatttatctaatctacgatctgattgcagcactaaattcgttacaattaaatctttaaaacaagaccacacatgattatattttgaaaaaaatattttagtttttttattgatttttttaatgttgcatatggtctcttttgatgtttcaaccagtagttttataatgtttcagctagtgtacttatgatgtttcactatgtacggattaaatgttgtagtggattttgatattatgaaacgcgccgcattgcaacaaatcacccacatatttcagaaaccatctattaagcgatttcgttttattttttgtttcacaaaaaatgtttcatctagtgtacttacaatgtttcactatgtatagtctaatattgtagttaattagaacattcttttgcaacaaatcacccacatattttggaaaccctctatgacggagcttggggctcctcaccgggagaccgcgcagggccccctttgccggttcggccgggggcgctatgtgaggttcttcgccctcgatctaaggaatgtcagcgagaagaatcgcacaagacacgggcgacgtagacaggttcgggccgctgagaagcgtaacaccctactcctgtgttctgatggatctgtgtgtgaaggaatacagagagccggagagcgagagaccgttcaggctctagaacccctccctcctcttctcctttttctctttttttcctctctcttctctctctccttctcttaggcctgggcctcctttttatctggtcaggggtcaccacatgggcctcaagctgcctaagaaaagaaacattttttttacaatgagggctagtctacagccggaagtgacccctgacaagcacagcacacgccttctgctccgctcgtcagctctcccggtggacgcccgtttcaaccttcattcaatggccagcgactttcttgccatgcttgcgctgaagcctagaatggatctgaccgggactgacataccaactccaggagtcagcacgccagctccggctagagacgagagccaggaagctctcatcattccgacgggacggggcgaggcgtgcgacaggccgcctgttgccacctaacccgcgatctgaccagtctgtgaccggtcacataccgcgactggtcacggaccggataagcatgcgctgcgccgcattgaatacggcgtggcgcgcttgtctaacccgctataaatgcggttaggtgagcgccgctgtgctcacctaacccacacacgtggcgccaacaccacagggggtcggggcgccccaaccctcggggctgaaacgggagcggcccgacccctcggggagacagagggaggggtggccacgtgggtgatcgcggctacccaagcctctagtcacgatacccccggccccatgtcaccgacagtagcccccggcgttacgccagggcgaccgcccccctcgagggaggcgctcgggcgtgacgccactccttaggcccggtgacaggtggggccggtctccacaggcgggcagaaacccaacggtcgcaaatcgcgcgcatcggcaagggaaaaaccgaccgacaataatgagcggcatcttcaagaccgctacattactcgagcagcgcgcgaatcgggacgagccggtttgtttcacctggggacatgatgatggcgctttttgcggttggcgagcgcagttaatgcgcgcacgatctgccccatctcaaccgccacggccgcacatctgccgcgtgcgccgcaaacgggcgagtggggttagtggaggcgtgggcgcgagaaacgagggggcgaggtagtgggcgcgggaaacgaggagccgggcatagcgttggcaagggtgtaaagacgccgacgaagggattcgtttccttcctctcgccactcttccccttgcctttgccacttgcgctctaacttttcgtttcctgtgccctacccttgccgcactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggccgggaagtggtcgcgctgggcgagggacgcccggcgccacactacccggggcggtccgtcttcttcctctctttcgcaatggcggggctggtcccgccattctctacttttttcatggatattctggagttttatgatctccagatggcgcacctcacccccaacgcgataatgacgttggccatcttcgcgcacctgtgcgagatgtttatcggggtgcgcccatttcttcggctgttctggtggttcttcaccgtacagccggtgtcgccgccaacggtagtcggtggctgctacttccagccgcgggggcaggtgctgaaccgctacattccctgcgtccttcgcaaaaagtgggacgactggaagagcgattggttctacacccccctcgccgacgaagcgcgcctccgacttccgagccagcccccggcgcaggcctccagctggcgggcggcggtagatctgggagacggctacgacgccgttcttgaccgcctggtgggtctgtgatcccaggggctcacgggggccatggtgtttggcgacttccttcgtcgccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctttgttgcgatccagagcgcgccaacatcctgaccatcatgcaggtggtcggggcgtcgggggagcgggccccccgaggccacgatggcgcgggcgggagccgcaggggggaacaatctaccccgggagggggtcgtgcttctgggccccgtgacgggggcccggggggcagccgccctgccgacgcccgggggaagaggaagcaggagggtacccctcccccatctcctccccaagggggcgtggcggtgcgtgccagcagcaggcgcccggaaggtgccgtgccgacgccgcagcccgagggggagcgaaagaagaaacggctccgcaagatgagggggaccgagccatgccgggggaacctcatctcgcccccgaggtggtcgtttagccgacctccccgcaggttcgtccccgcgcccaccgcggccgtattcattctcccatctcccaaggcgagttttcactcacccgtttctttttgtcttctggtttttcttctgcctcagcgagatcccgtcgcgccctcccccgccattccaaatccggccggtctgaggccgaggagacggcgaccgcggaggcccggaggcgggaagccgaccggcgagaagccgcggaccgcctccgggaagccgaggaggcagcccaggaggccgtccgggtccgccaggctgaggaggccgctcgggaggaggccagactccgccgggccggggagtccgtccgggaggcagaggcggcgcgcgcacgccaggcggcctgccaagcccccgacccgactccgcccgaggcgacgacgacttccgaggccacccacgacgaggccgcgggcgcgccgctcgggcccgacccctcgggcgacgcttgggacgagccagcttcgggggacgcccccgagtccggcacgtcgatcggtgggccgagccgcgcggcacccacaccgaggcggctctcctctctgccttccgctgccccactgagcgtggagcccctcctgcaggccttggccgccgcgaacagcacggtactggacgggttaagtgcccagatggaggtcctgcaggcggagcgggcggagctcgacgcggcgtgggcgcgcgtcgaggaggggcggcgctcagtggaggccatggtggaggcgggccgcaaggcacaccgccggcacgcctcacagctcgaggcccgtcgtagagacctggcggagatcgccagggaggtggaggaggagcgggagactgccctcatcgccaccgccgtgctcgacgaggcgcgggacgacctccgcctccaatacgggaggcgggcggcggagctagaggagaagctcgacgccgcccggggagtccttgacgccgccgctgcccgggaatggcgggcggcggagaacgaggcggcgtcccggcagcgcgaagaggcccttgaggctcgcgccacggcgctggaggagcgcgcccgcgccctcgatgcgaaggagagagacctggcggaccgcgaggccgccgtcgccacccgggaggcaacactggcggcgcacgaggccgcctgcgccgtagaggagtccgcactccgcctccgcgaggacgcgctcactgagtgggagcgagctctcgaggaggccaaggccgcggcgcagcggctggtggacagcctgttcctccgcgaggcagcgcgggaggagcaggcgcgccgcaatctggaaggcgcccgcgccgagagggccgcactggatcagcgggccgctgagctcgaggcgcgggcgaaggagctggacgagagcgcacagcggcggggcggctgcgggccacggcgacctagccgcccgcctcgcagccaccggacacaccatcgccgagctgcagggcgcgctggactcgtccgccggggaggtcgaggcccttcgcttggcgaacgaggtagggcccggcatgctttgggacgccgtctcccgtctagaccgcgccgggcggcaggcaggcctctggggcgggcggtacacgaagtacgccgccaaccaggggggcctcgcccagcgcctctcagagatggccggggccctcgagcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggacggcgcgcgcgcgcaggtccgggatgccgccgaccacatcgtccacagcttcgagggtacggcccctcggctcgcgttcgccctcgactccgacgaggagggcggtgacgacggtgcggacgacagcgacgacgaggccggcgacccgggcgcatcggagtgagcccccaggccctcgccaatcttaataacttttccttcttcttgcgaggccttcgagcccccttcttgtatagactgatttaatctgcaatcaagtaaagaggaaatttctgcgtcagttctgtttgttgtgtgtatgagacgaggatggtctgtgccgcggtccttctgtgtcttggcttgaacaagggctcgtgcccaggtcccagcctcaagcggcgcgggtcggggctagtgcctggggagatcctcgtgtcgagactggccaggccgagagcgcggtgaccgagggttatgatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaaggtaagtatatgcatgtggtagcccccggccaaccctgcacacccggggggggggggggggtgcggggttggctcgagcccgagacacgacccccgacccccactaggggtagaagcgacgaatgtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggatgaggttgtcgacgcagagtgatcaggcccggacgtggcgctgatggtagcgccgcaggctctgctggtagcgcgcggctcggagggacgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcactccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctaggccggctgatgggtttgcctggcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggccccgaggcctggactccgacgggcctcgggggccgttcaggcgcgtccgtcccccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatctcatcgaaatggcgctccatacgccgcacctggcgcacgtaagcgtccatctgcgggtcagagcactggtactccttacagacctggttaacgaccaactgggagtcgcctaacaccaggaggcggcggatccccagtccagctgccactctgagtcccgcaaggagtccctcgtactctgccatattgttggtcgcccgaaagtcgaggcggaccaggtatctgaggacatctccgctcggcgaggtcaacgtgacccccgcaccggcgccctgaagagacagggagccgtcgaactgcatcacccagtaggcggtgtgaggcagctgcgaggggcccgagctggcctcgggggtggagacaggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgactcgatgcgcctggaaataatggcgcaacttcctcgaagccatcagaatagcgtaaagcatcttctgggcctgaaggtatcgggtcttggcgtcccggagggcctcgctaacgaagtagacgggccgctacacctttcggcggggccgatcctcttcgccaggggccgcatctccagggcgctcttcgtccgagaggccgcgcggggcgcactcggcttctgtgccgacgacctcggggtccgagggcgacaggcgcggccttcccgcagtggccccggggccatcctaggggtcgggggcgcctggcaccgtcggacaagcaggcggagggccagctccggccgtcgggggccttgggccgccgttcggctcgggggcctctccttcctgctctctcccgggtcgagtcgacacagggtggggatgcgcggagcgagggttgtcctcgtcgcgctccacgaccaacgccgcgctgaccacctgtggggttgccgccaggtagagtagcaacggctcatctggctccggggcgaccaggactgggggagaactgaggtacgccttcaactgagtgaaggcccgctcagcctcctccgtctaggtaaacggcccggagcgtttgaggagcttaaataggggtagtgccttctctcccagcctcgatatgaaccgacttatggcggctatgcagccggtgacgcactgcacatccctaagcttgctggggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaacaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcatggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcacccagggcaacctccttgaccgggacttcgtcgcacgtgaccatccgctgccttggggcggccgggacggaggtgctgagcctctcgtcgccacccgcaggcttggacgccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccccaggaccgcgttgtagggcagactgagatccgccacatcgaagtccacccgttccgtgcggaagttggcggaaccaccgaaggtgaccgggaggtcgatatgacccagcggccaggtgtgccccggcgtcacaccgatgatcggctgggacggccggagcaccatccccggggccttgatggcatcaaaggctgcgggggagaggatgttgagagctgcacccccgtctatgaggacacgccccaacttcacattgcaaacggtgggggaaaccaccatcgcgatctgtcctccccgggcaacgcacggcgggtggtcggtctggtcgaaggtgaggggaacctctgaccaccgcgcccgccgcatcgcctcatgggtaggggccgcggccagaagctctcgcttcatggccttgaggcttcggcgagaagcatgagcgcacgctcccccatcgacggtggcgacggtggcctcaggctcctggaaccccaggtcatcgtcgccattgtcgatgtcttcggcggtggccttctgcttggcctcacctcgccggttgctggcgggagccgccggggtcttgccctcacggcgctcctgcctcttctcctcctcccacttcctcgtccgctcagccaaacttttgaccgcgcggcagtccgcgaggtcgtggagggaggtgttgtgcacggtacaccacttgccggttgggcgctccctgttgggagcgccggcctccttctttttgtcgttcgcaggcctcccctttcggggggaccgcgaagcgccctcggcggcgaggacatgaccctcgtcgtcggaacgggccgacctcttcttcctcctcctgtcccaccgccctgaccgagcggctgactcgggggcggccggagctgccacgccagagccggaggagttccaggtccaggcctcctctttgcgagccacacggtccgcgagctcaaaaagctgcgcggtggtttggggctccttggaggcgatcttctcgagcatgcggttgtgccgcacgccccccctgaatgcgtagatcaccgcgtgtgcggggatgcatggtatggtgttgcggacttgacagaaccgctgaacgtacgagcgaagagactcatcgtcccttcgctgtaccgcatgcaagtccgcttcttcgcctgggcgcgaatatgtgccctgaaagttcgtggtgaactgctggcacaaatcctcccaagagtggaccgacgcgggtggcaagttcattagccatgaccctgtcgtcacccccggcggcctcgatcccggttgtgtagatctggagaaactcggcggggttgacgcttccgtcgtatttttcggtgatggtgggccggaaccttgggggccaacggacgttcctaaggctcgccacaaaggctcgacagccggcaccgccaaccggggacacggggggccggcccccgtgcccggaccgaagtggcgctccggacgaggaagcgccctccgttgcgtgggcggcgcgacgatcgtcgcgccggcgctcgatatcgagccgggcatccggccccccacgcacatcttcttgggtcggaggcgttgacgagggaatggcggacgaacagcgggtaacggccgccgctcaccgcgccctccgcctcgacgacatggagccggcggcggcagcgccagaggtcccggtggcggaggaccgcctgccggcgcctaggcgctgctgtgccgtcatgaccaaatcggccacgtcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtctcgccgtcctcccccgttgcccgcgggcggcgaagtcgcggatccttcgacctccccgagcgcctccccccgcccaagatttcggcgagagggggatggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttagaaagacacgcgcgccccctacctggcgcgccagatgacggagcttggggctcctcaccgggagaccgcgcaggccctcctttgccggttcggccgggggcgctatgtgaggttcttcgccctcgatctaaggaatgtcagcgagaagaatcgcacaagacacgggcgacgtagacaggttcgggccgctgagaagcgtaacaccctactcctgtgttctgatggatctgtgtgtgaaggaatacagagagccggagagcgagagaccgttcaggctctagaacccctccctcctcttctcctttttctctttttttcctctctcttctctctctccttctcttaggcctgggcctcctttttatctggtcaggggtcaccacatgggcctcaagctgcctaagaaaagaaacattctttttacaatgagggctagtctacagccagaagtgacccctgacaagcacagcacacgccttctgctccgctcgtcagctctcccggtggacgcccgtttcaaccttcattcaatggccagcgactttcttgccatgcttgcgctgaagcctagaatggatctgaccgggactgacataccaactccaggagtcagcacgccagctccggctagagacgagagccaggaagctctcatcattccgacgggacggggcgaggcgtgcgacaggccgcctgttgccacctaacccgcgatctgaccagtctatgaccggtcacataccgcgactggtcacggaccggataagcatgcgctgcaccgcattgaatacggcgtggcgcgcttgtctaacccgctataaatgcggttaggtgagcgccgctgtgctcacctaacccacacacgtggcgccaacaccacagggggtcggggcgccccagccctcggggccgaaacgggagcggcccgacccctcggggagacagaaggaggggtggccacgtcaccctcgggcccaacccccccgagggggtcgggccacgtgggtgatcgcggctacccaagcctctagtcacgatacccccggccccatgtcaccgacactctattaagggaattcgttttattttttttccaaaaaaaatgtttcacctagtgtagtcacaatgtttcactatgtatggatcaaatgttgcagtgaactgaaatattctttcgctatttgctgaaatattgtttttataaaagatgaaacaacacccaatttaaacgattgaaacattttcgatctacttagtaaaacaattccgatatacttagtgaaacatcgtgcaacatttaaacataattctataataagctaaaaaaaatttcgtcggaatatatccatgtgtggtcttgttttaaaattttaattacaatgaatttaatggtgcaatcggatcatgatttggatatataatttaggagaaaaaatagtttaaagtttgcttaaaaactttaaccaccctaacagttactagtatacatgcattctgtgcgagcaggctgaattagtttgcatgcatgcaggctgcgtctgcatgcgctgacggagactggggtgggcgtccgatttctcctaaaagatcggacgtccgatccgtagacgccccccccccccttaggtttcggttgacaatttcaagcacaagagggataaagtcctcgttttccacgctcacgttttctatactgctaaatgatgtattttttaaatagtctattgcttttaaataattatattaatatatttttcaagtttaaaataattaatagtcattactcaataaatcataacctaatggtttacatggttttacagtctacttatttcccctccttgcaaacacacccagtctactttgacattttttttcctatttgtggctgtaaacttgtaactatgtttttttttctcgaataacgtaatctatgttattatttaatataatctacctgtttcaaataaaaagtataatgataatatcatttgaacgcattgcccacgatgcctggaagcatacttaggtgaatgatgatacaccgtacattgcatcttacatctgtttgttgctctaatatatagcttggcatcattgtaacacaaaacgctatctgatccaaatccttctctgctccacttgacttggtgtcaatatgtaaacgatacgtttacttgtacacatataatagcagtttctctgctccgctgatgtttccatggcagtagatcagtacaatgttttcatgattattatggacagaaaaaaaaactagtctcaactctaggtgtcgttctggcaaggcctatgagaaacctaagagaacttcggctggggacgcctagagcagataaggcattgtcggatcatgcagagacaaacgaccatataagatctggtcatataagagttctcaccgtgtgtattaaccaagccgtgtaatcggaaattgagttttccaacttcacggctgggggctagggtcagtactttttcaaccaaggcaggtcaagggtccaagagccttatcctctgagaacgattttctgatgacaaggctaggggctagggagagtgtatggctcaggtgactgatcgaagtcgcaaagtgagaaaacactcatacacaacatacccagagtaagaaaacttagatagattccttttctattttataagtatttcttacaagtcataaatacttcaaagtatattacatgcttccttaagatgtttttctacaggatacaaatactaccaggacggccaacgccaatccatggagcgaaaaaccttctcggcgagcggcgccatcgactgtgcaaggccgtcgatctccgcgggtgtcctccgagaacgcaagaacccttcacgcaggaactcgaggtacagctgcgggcggtgatctcggatgcaggccagcacatgtcctccggcgtagcggcttgcttgacgacacttctgcttcagggcctcgtcgatgcgcttgccaatcccttcgagctgtgcgcaggcccattcaactacgagatataaccagccgccgactcctcgggatctccgcggggaactcggagctccttgcaaaccctcgccatcgtcgtgcagcaactcttgagatacgagttgaaccacacctcgcgacctcggagagcctccacggcctggtccttcttcacctccaccatggttttctcgagttcggccacctcgagcttcgtcttccaatattggattcgacgatctcggtcagccaacatgttctcgaagtctgcccgccacggaaaggactgagtcaagctactcttctcttccgagaacacggctaattaagtcaatccaaacacaaggagtgaaggagaccaagacacaaaccttgggacatcattgccatattcgcctccgcggacgggctttgactgatctcctcccgcggcacgaacggctcgagcgtaagcgccggaacaatcaccggcatatcgggctgcccgtgctgctggatatcctcgatatcaacatctctacaatgacaacaaagtactcggaatcacatgctaaggaaacaagggaaacagctgtttagataagagcaatttggatccacaaatagttttacagcatgaagatatcctactcttcaaaaagggggaggacggactcccccaagtcaccgacttcttccgtcataatcttgcgcgcgtcatcggcggccccccgatccaaagctctcttaaggtctagatcgggatgcgccagcctcatgcacgcaaggacgtggcatgctccggtatagatgccgttagacgtctcctcgccgatcctggtcacgtgcttggaggggatctcctccatcgccgtagtcagttccgcgagcgacgacgtcagcgagaactcatcggggtacgccgggatagtagtcatgacaccgcactccccgacaagttagtgcaggctggtgaacgacgtccgcagagaaccgcggatgtcgatcatgtggccctcgagctccgacatccggtgctcaagtccacgccactgcatctcattgccggccaccagctccctcatcttttggaggtcctcgtgagcctccgccaggtcgcgcgccagctggtcggcacgctggtttgccgacaacgccgccgccctggcctcctcgatctcgcaacctacgccgcaagcaccggcctggaggaggcgctccatctccgcttggagttctccccaggtgagggcgtcggtggacaggctccgggtaggcacgaggctgacgacagggctactcggcgtcacctcctggtccttagcggtaaccacgaatcctgtcgaggttgccgtaggggacgcgctggaagcagcatcagtcctgccttgcgccaccttcgcccgcgccatcctgcgaatatttgccttctcttcatgaggctaggcgatcaaaacttcgagaatgaaaagacttcaagaacgtttacttacttctcgccgatcgtcacgaacctctgccttcgctgaggcagaggggacgcgtccgagtcctgagtaagatgaaatggggtgaggtcaagtcgttccgactacgcgctaaagaacgagagagaggcttaccgcagagttcgtcgctttccgatgggtcctgagtacgaaggagaatttccttcccctctttggaacattgctgccactcgtggtggcagcaacaacaatgtcagacgcctccttggcgacgctttccttcaacgacgctgccgcctggtggtccacgagtggcccgatgacgtccgtcagagggagagcctgcacaacttgaagtcacaacgcgatctcgagaagaaagatgtaaaggaatcatcgagtacactcacattaattgcagcgatgcgttcggccgggttcttctcgcaaagagagacggggatgtcgtccgccgctgagggggcgctcatcatcacctgtccgacacggcgttccacggtgtcactgtccagacctgtaaatcgagaacgagaactcgataagtcaggagaaacggatgcactcggaacaaaattagaaatacgagaaaaaaataccccgaggagagacccgggtcgtgtcctctggcctagagtaatcaaaggccggatgggcgcgggcctgcagcggttgaatccgcctatctacgaagtcggcagcgacttcgtacaccgacaacccccgttttcggagatcatcaatgatgtcgatgaaagattagagggagggagtcagggcgggtttggtggtccactctgggattttgtttggctgttctttagggacaacaaggacgggatccgagttctctatctaaagatagaaccatctcgctcgccacttgctgcgagaagaggggcattggaaggggatgtaacgcgacttcagacaatcccgaagtcggaatccaacgcatctagataccctgttgggttccatccaacgcaactcatagtaaaagcagaagagatcaaggaagggctctactgttggtatttgatacgattacagataaaatccgcaagcgcacggatataccgatgtagcacttcccctacggagtattccaagggtatggaatccaagagaacgtgtgtgatcagagcttcctccggttcatccaaagacaccaagcaaatgataggccaggatagagaggattgactagtgagaaacagtgtctagggaaagcttaattttaatcctaacgcaatacttcaggcattggtaacccgttgttcccagatgtcgctctactacgtagccggacagggaggactcttataattcagctcaagcttggaagtgtatgtgtaaagtgaggaagtgaagccttaatatagaggtaggtatgacggttagcgaaggggaaatgtccgaactgccccgcaaccgtcattgggagagcatctggagcgtccacgccaaaccccaggatcaacggtgattaggggggttcggccgaaccagggggttcggccgaacctaggggtttagccgaacctgggctgggccctcctggcctggccttctgtcacgcctagaaattcactaaccagaatttctaggctgaatgtgcattaaatccctgtccaggaccagccagggtacacaaacgacaattgttgacatacagatccacgtcttacaaaaatataaaagattacaaatgcagcggaaaagataaaacgagctaaacttggaaacttgacttctacagtggggcgactctattccacaggcaatccttgacggcagcgacgaaaccaacttcaacaggacagctcccactaggaagatcttcagctctagtgtgggggaaaagagagcaagactgagtactacccactgtactccgcaagtcataccggaaaaggaggtaagatgcatgatataaccaaaggaggttaggggttcatttgcacaaagctagcatttaaaagcagtagttgaaagcagtaaaacaattgtagtaattaatcaatattaaccaatcactgtccaacgctacaccacgttgcaataggcccaaccaaccacttgaactacaccagttcattaagctaaacaaggggtgagactaatcacggtgaatctggttgatcgcccataaccgcgggcatggctattcgaatagttttactctggccagaggtgtacaactatacccacaagacacgattccacacatgtcgccatgccccgaagtatcaccatgatactgcgaagggggaaatcgtgacaagaccctccgcataaccctcccctaaccatccacaccacgctaaggtttcacccccacccctcaaaaggcagtggacggtcccctcttgagtcgcggtgaatccggcagctagacaaccggacaccccgaccgacccaactccatcacgcccaccctcgccaccgatgcctaggaaagggtcgagctatattttagatcaagcagttacccactcccgcttgtggtaaacacggtaagtctcccagggtttcccgtgaaccggtccttaattgccatggtgcgaccagcaaaaccatgcacccacagcccaccattcagtgtattttaattaactaacaccattgcggtggcaccaatccaaagctatgctaatagtcaaagtctatgcaataatgtgatccccatttgtatactagttgaactaagcatggctaagcatttcctaaaccaacatctagtcattttgatacccatgttatcaatggcataaggtaaacaatatatggctgagtaaggggacccatcccacatgacattgtaaaagaatgtaacatttaacagaaatgcgggatatttgtaaattgggtacaatatgatcaattgtaatgcatgacttgccttgctctcgcacttatgagaccttagcaacgtcttcgagaaaccgcggatcgacgaaacggccgagatctatgcgacaaacaaagcacacaagcaaaacatgctataagactactgaaacaggaaacaaaaccatttttaatggattctagggatttttatgaatttactgagacttgaatggacttaaacggagctcggatgaattacttatgaattttagaagataatctatgtttttactaacaaagaaaagtccttaatcaatttattgcgcaataaatccccagggctgacgtcagcaaggggggcggcaccggcaagcaggccccgcatgtcagcggctcaagagagagggagggggcgccggcacgcgggccccacgggcagcggcacaaggcggaaaggaggcgcggctggcgggtcggcacagctcaagccggccggccatggtgcggcagcggcggcgcgcggccaccgacggcgaccggcgaacggccggagcggcggcgcggccaacggcggcggcgcacgcgggaagggagagaggaggggagggagtcctcactagagggggcagcggcaaccgacgcggaaaacgagggtggcggcgacgaccggcaatgccgaggcgcggacgagcggcggtggcaccctaggagagagcagagatgggttaggggtggggtaagtgaccacggcggccaccattgttgaccggagacggagggggatggatatctcaccggctcgcgagggagatagggttccggtggggttccggcgacgcgaggcggtggccgagatgacccgcgcaacgacgaagctagcggcggcggcggctctagcggcggcggtgcgcggctgaaatgcggcggtgagcggcggagctcgggagagcggcgcggcgacgataggaagcacgggagggcgcggcgagtgagggaaatgggagaggaggtttgggggagtgtttttatgggtgaggaaggggtggacgtggccggggatggcccctattgcgccagcgacgtgggggagtggggaggaaaagagagataggagagacgggattcaaaccgaatcccggcctctaaacgggcgcgcgcgcacgggagaggtggaggaggtgggcggcgacgtgggcgcgagcgcggggcacggagtgggcacggagtgggcggacgacgtgggcggctggagcaggcggcggcggcgggaggttagggatgacccgacaggtagggcccacctgtcggcgcttgagagagagagggagggagagagaacttcagggaggagaggggaggagcgggccggcccagcaaggacggcgcgtgggagggaggttgggccgacggcccaacaaagaaaaagaaagaaaagaaaaaggaggaaatggaaaaaggatttcctgagggttaaatattgcacttgctcatttttaattggttaaaattatttccaaggctctgaaaattccactaaaaatcctgttaatatattgcaacatggggaactcaagaaaaattccaccacgccatttccgattattaattgcattgattaattagggattcaactctaggttaattaaacaatttcttcgagcaatttatttaaccaatttttttagcaagaaaagggggaaacttcagggcgtgacaccttcagtcggtggactccctgggctctcctctgtccatttctcggagttttgggttgattcactaatgttttgataaagttcacaacccctccttgtaaggatgcataattctcctcactttagtccgatttttctcccaacaccggggtttatcatctgcatacaaatatacaccaacacttgtggaatatgtgagattaagcacctatcactatgttggatgttttattatctgatctttatgcaaatgttggcggtatagaattgacatttaacacccgccaacatctaccccaatgtaggcctcgcaaagatgagaaaagatgctaaagaatgcgatggagttgaggttcaagtgaagcaaagaaagaccatagaagttcaagacaagaagaagaaactcggaaggcggaggaataaaaccgcaagaaatataatcttcgaccacaaccatgcggcccaagatgggttcaggttcttacctcctgcctccctctgcatggtcccccgaccagggagggcaccgtcgtcttgcagcttcttcatggacgcgatggtggaggtagacttttcaagatccattgccgccggaggatcaccgaagaacaagacggaggaaatgagctagggttttctttgcgggaagcggagaagacgaagagcgctaggaagcaggagagtttttggcaaacagacttcaaatggattcccaaaatccctttaaataggtacacttccgacagtgcgtatcccaaggaaaggagagagattgccattggaaaatcctgggtccattgcgcgcggcagtttttagacttcaatttaaattcactcatgaccgttgaacttcatgcggtgttgtcgatggctcttcgtctctacggttttcacaccgagatcgaccagatgagaacgacaacaattccgacatcagaagtcgcgatcgatgacatgagctcatttaagcagaagtcgggggctactgtcagggttacggataaggtataccctctatccttggatgtacattgtatacagatacggtatacccgcacgtatacggatagtttccgtatacattaaggaaatctatcatgtgatatatatggtatctacggatggaaagagttctactcggacaatactaggtctttatcatatcgtgaggggtccgatatctccgagtcctacttggagatcaactgacccgcggtataaaagggaccccctaggcaggacctaaagcatcgaatatcaccgccaacatacccactacagcctacggagtcggagcctacaggacccaagtcactaggagatctagtcggaccaactcgactacggtctcgtcggtattatcaagttctgttattccctttgtaatctgtggtttccatcatataatcccataccaactggattagaactattacctatcaaggggcctgaaccagtataatcctcgccttttgtttgttttatgtcgtattacgtaaattctcgttccaacggaccccaataccctctgtatccggtctacgggtatcccccatcgacactagtgacatcggcttttcacaattcccagaaagacaatttcgaagaccaaaaaaatcaattgactttttattgaattgatcaacacatcagtgaaagtgttgctttgctacactcaatgaacaatgatcgattctacaaaggccggttgcccaaattaggcaacgaggattatactatctatcttatccatccatgtacagaggtgatcatttacagtgcagtgtgtatctaatactactacttaacctccacttttttccttttgttcatcatttgacatagatgtttgattatttccaagggtttcacgacaactggaagacatagatttgtcttgggaaaaaacagttgttgctccatgatgcctccgggaatccaattccattgctgtctctaacgagaatttggttgctgtggcaccgaccattaggttctcagatttattggaaaggcaatcaaattaaagatattgcaggtctaataaccaacacattccaataataaaggtaaaagcagaaaaaaaaatcactagagaattagaaatgctattttctagtaatatactgatatgtgaggactatacgaaaacgacaaaagaagatacaatcatggaaaattattaaccttatataattttcagatggagctattttataacaatatttctgcgtttcatcataaacatccatagtgatcaatgaaattttgaagtcaatgtccatatattctaactgtccaggaaagctttgcttattttttcaaagatttgatagtctttaaatttatcataatatttgatctcttatgccatggcaaagtatgtgtgaaattaacattttagcaaaccgaacacgatgtgctatctaggatcacaaattcacaataacagtgtaagcaagttgcactcaccgtttatatttccacgtgtgataagcacacgaagataatctcgcagccctgtcaatactattctttcttgatcagcatttagctcagaaatatcctgatcacgtgaaggcaccacaaatggacttctataatcctcatttccgaatgtagtatccatttcatcacacattagtgcttgtgttcctggtgatgcaggcctagaatctttaaaagagttagctagatggggctctgttccattaatgttctgacgatctatacaggccttgttttggatgtcctttagagaagcttccttcaagttttgctctttggtcttatcattgtttatttcatcatttgtctgatattgcttctctgcttgcatctccactttattgcctgcaaatatgagcaataatatttggatttgagcacaaaattacagtgaacctaatcacacacaacttacaaaataaggttttcctttacaagtggtatacaaaatttagtatgaggtacagttgcttatgagacaacaatcaccatatcaatgtcgaaagtcatgtccattcatgagtcatgagtgtgatagacgtatgccatacattccattttgtctctaataaagatatagtactatatataataagttttatacatcgacttctatttatcctgaagctcatagtgctggcacagccttgctccattttctgttgtacggaaattttacgctatctttttttttttttgcctctttatggccagttggatgtttgctttgatatgtgcatgtgcctgattttcgtctgcgttcttattcaagtagactggcgtagaagcaaaatgtagttcaaagcccacaacaattagcaaactatttgcaaatttttaggcgctatgtcctagaaaaatacaaaaatatatatatgaatttgtggttaaaaaaacaagttttatgtttttcttctattaacatgatgtattgatgtccatgatctgctataccaaaacaatgttttgatacagatgaaccactttgttggtcgagaatctggagctgccagtattcaaccaattaccatggaagcatggcttactgcatggttgagccaactattttttcacatgttacatggatatctttgctctgacaaaaataaccgatggaacatcttttttcatggttgatcagcttatttccatgaagcacttgatatacaaaagttcattcaatggtagg

SEQ ID NO: 48101 - DNA, 2657 bp, Oryza sativa
acttcaataagagggatagtgtttgctagtggagacctgagaaaatattatatttcatcaaaagaagagacagtaagcggtagagtatacctcttatataacatattttagtataactaaatgatgctgccatataacctttgagataaacccatgaagactttcaaaaatattaaagtactaggctgagccatctgaaatggcactagttacaggaagctcatgacacactgaaactagattacacattggcatagtagaactatctaaaaggccagaagggacacttgtaacctatgttaactaaagaattaagaacctcaaaatggcttatctgagtacatagacctttttttttctgttcttgagttattccctttgagaaaatataaatatagttccgcttacctatagatcatttcagatgatttgctttggtaattgatagcaatatcccctccaaatcctgtgcaagaggatgcaagctgtgaaacatctgcatggtcagtctagcacataacagtaacaacaaattctagtccacaaaaacttgcagctggccataccaattagaacataccggttgaaattgtgcttctgacaaaatttgttctccaagggaattttcttgatatttcttcctacgcactggagaatttttgtatcctaaagatccagtggcaccattcagagcaaagttagctgcttcttgaatgtgatttctatcagatgcatttttcatttgaactaaagcttttcgctcttcgcttccttcaaaattcttacagtcctgacatctacagttcttagagcataggatgtttgcttggaagcattcacagtacttttttaagcactctgacttcctgcagtgacagcccttattgtgctttggtatcggaggtattgcttcagaattatcctgaaagtcacataagactgtataaacacatgtagctcaaggtaaaaaaaaaatggacttggcattttaatggggaaataacaaattattcctaaacattggagttagaatcatttttagtgtttaatttccagaatcctgctaaaagatgggacaagaggacattaaaaaaaatgaatggattaattagtactaatggaacattaagaattataaaacattacccacaaatccaagatcactttggtattttatattttacttaaaccatgtaaacaaatattttagtattgcagtgtaaatgaaatgaagagcataattacattgtgcctgcgtagaaatgtacattcaattcaaggacaaaataaagtgcgtgaattcaaaataaaaatgaaaaactataaaaagcagggaataatgtcaatatgacatgaaagctctggatgctgactgtattgagcaatcaggggtaggtgtatgagattatgcataaaaccataccagtaaaccacattgaaacttacattgcaaactcatttatcaaaataaaaatggaatagagggacactatcatggccatttttaagtccttgtcacaaccgaagcaagataatgaaaggtgtgtaccaaaaaaataaagcagagctgttggtgaatttgtttcatttcatctatataaaattcattcagctcatgcatgttttggaattatatttctggatttgatcaggataactactgaaggggaaaacgagcactggtttaaggttacaacatggtatagatgtagatagtatgtcatattaaagagttatattggcgaatagtagtacctttcgaacagttacagtatttggactattttcaattttgggctgaaatgcaagtggattacggaggagaattgtttcaatagcttccttccttatgttttcattctcaatcttgtttccacatggtgaacaatggcatccatcacaatatacacgtgctgcaaaacactcacaatacctaacaaacaaatatcaagctagtgagcttgttataagcataatgggcatgatggtgtttcatcatcataaagtcagctgacaacaaacatcagtacgttgcacttattgtttgctagcagtctgcctagggagaatgtgccttaaaaaaagcaatcaggaagaattgaatattataaaacacagagacgggacaattataattagaatagcagacaagtgcatcaaactcaaactgcaaaggaaataagattaccacaagagaaaaaggaaacattaatcccctactatgaacacaacgcaacagttatactcttatctttccactgactacacacactaatgtacatggcataccatttaggaagctatttaggtaccgttaatgatgttgtatgaaggaaaatcaaacgtaactcctaccggtattgaccatcataactgacctgtttcgagattcttaagatggtactaaacatttacctgagaatacatattgataatagttgcttggaagcctaccttttgcaaataacatgtaaaagttatccagtactctatttcaaaacactatattttcccttgctgtaaacatgacactgcatttacagttttacacccaaaagaaaaaagaagatactcacagcttcaaacatcgtgagtttttacagttacagtgtttccttttctttggactggcattttttacttcaacagctggcttc

SEQ ID NO: 48102 - DNA, 9757 bp, Oryza sativa
taatttgttatcaattaactagttgatctacaattaacattatttcactacagttctgaaacgaaaataaatagacaatgaatcagttgtttaggataagttaagagcaaaagagcagaacggctaagaactctcttctgaaaggcaaaaaaggaagagcatccatgtattgtagtggagcaagatctagctctcagaaatagatttctttcaatcttgatcgcatatgtaagttaccattaggcattttgatagatttattcattaagcacatgaaacaatggagacacatgaaataacatggtctatgttaggtcttaaaatatccccaaattttcaacacgatgtatcgaacttcaccccagaaatgcttaggcatcaatcctcacttagggcaaagtgtgataacccattaccaatacaatcacatttgttttttcacaagcaccaacatgcttatgtgcatgcacatttatagacattggcatatagtcaccatatcagacactaatggtcgatctgagctcaactactcatttctaacattcttagataaaggaatgaacgccgggcaatcttaccaatgaaaatgacacggagttaggtaaatcttattagaaaaaaaaaagacagagttagcacatatgagtcgaacaactggctgcttacaataacattcgaatcatgagacttaaagattcaatgtaaccaacacgtttaaacagaacatatttcagcatcaccccattccttcggaaaaggacacacacaccacaagctacaagaattcaaagcacctaaactgatctcctataccaaaagtagaaacaaaccaacatgcaaaaccacaaaatcccaattccagagggagatttctcacggcggtggcggtggtggtggtgggtgcggtgtgaaggacatcggccacggcctcgacaccgggaccgccggcttcttctgctgcggcggcggcggaggcggaggaggagccactggtgcggacctaacgggcggcatggatggagcctcagctgaacaaatttcgttcgaaacaaagctgctgtttaagccaaaaaggagagaagctctcagatctaccggagaagctgagtttgaggcaggaagaggaaaggaatggtgaggaggaggatgcgcgtgcgcgcgctcaccggcgaggatgcggcgggcgaggacggcggcgccggtggctctcgcgtcgcggggaagcgggaggtggagacctgggcgctggtcgacgcgggcagagagagcaggagagtggaggccgaggggaagggggggaactagtaggtggcgaggaatcagaggcctattccggtgggctatttggtggtatgggccaactttagtgggccaaattattacgtgggcctaattcgtagactaaaataggtgggccaaatccacttgtgtggtaatacgtggaaataagtccacttccgccgcttaactttgcgtcgagtctatatgatatccctaatccctaatactagaaatcttttactgcccaagtgttcaaaactgtgtagtctgtgtaaagtaggtcccatggtaatatgcattggtagttttgctgatgtgacatcctagtcaacaaggagagaataaaaaaaaatatgtggggtccacatgtcagtggcatctccttcttcctcctctctccctcacttccccatttgttctccatgtctcctccatatcaatgggctgccaccgaccaccccatccacgtcgtcccctccccgtgccaacaaagccaccccctctttcgcgtcgccagttgtgcccctcaacaccccctcctacgcatgcatctaaccctatagccctcgtcagctagtggggaaaaatccccactgtcatccaggggagtggcttgctcggaaggagacaaggtcgccgtctatgatccagaactgctcagagcatccgaacgtagtacctgcatcgcaagagatctagaacatgacaaagtggtgatctagaacccggagctggcacttgacggtggactagtggagatgagcggcgagcgatagaagatggcaccaatgagctcttcaagcgcacgcgacatgcgttttgtcgggcacaatggcgtggaagcacgcaacacagatgcactcattgctagcacctaaccaggacttcacgaggcgggtagcacgattgacgcatacgatgaggttaccggtgaccttagggtcaagggtcccgttgtggctagtcttctcgatgtggaggaggttcttgttccaagtgatgacctcgtgcgacaagaggttggatggcttgttgaggtttatgacaccgtagcaaaggtgcttagcgatgggctgcttgagcggggagtggggtgtagtggccagtgcggacattgaggtgggaggagttgagggcatcgcgatgccgcggcagcctcggtgtgggtgatcaggaggagcaccggcatgaggcaatatgttgggtgcggcttggcaatgaaatctcctgtggctaggccacttacatgtgggccccacatgttatttgtattctctgcatgctgaccaggatgccatgttagcgaaaccacccatgctttacagccatgggatctactttgcatggttttgaacagttgaggggaagagattcccagtattgaggattaagaatgtcatacgtactcgtaaagttgagggatgacaggtggacttatttgttgatggaactatgttacgtggatttcactagtggaccgaattcttcgtcaagaattggtaagcgggctgattagctttaattgaacagagtgggccaaattcatgtacggattttctcacggctgttaagtggactgtattattagtgggcttactttttcgtgagaaactaaatgggctgaattctgctttaggccgagtttttttcatcggaagtaggagggatacatttgctcgtgagttggattttcgggccgaattaatttatccacataaactaaaaccgaattcgtttgttggtccaattcaaaaatccaaaagcagaatactccaaaacgaaaaaaataaaaataaaaatcaaacaggccattcaaaatgaggaaaacccacggggttgaccggcttgacccaaccaccgtatgtatagtcgggcgactcggaccaagtcgtcccgacgaccacccgacacccacacagctatgcggccccgccgcagagacgcctccgcctccgactccgacgacgccgacgcgcgctcctcctcccctcgcccgcgccgccgccccgaccccgcgccgccgcgcgcgcccctcctcagcagcctcgtggtcaagctgcagccgcgggggccggaggaggagcacggcgcggccgaccggctggagcgccggcgcgatcccccgcccgccgcacgccgccccccgcgggagccctcgcctccagggttcatgcgccgccgggagtcgcgccagacgccgccgccgcagcagccgcacgcggcgccgaggcgccgcggcggcagcgcgtcccctcctccccctcgccgccgcgggagccccctggggtttcggcctaggtatccccagccccgtgaggagccacaaggtatgaaaaaaaaatggaaaagaaaagaaaaaccctcttgttcttacccactcttctgttatcatttacttcgaggattgattggccggttggtacacctatcttttccttgttagtggcaatgatttcttccttgttgccttctggatttagactacatgctacagaaggattaaggatagttagttcttgatttgcaatagaacaaaaccgttgacttgctacggtcttgtaccattctgtgtttgatcgatcccgttgtagtagtactatagtatttctcaaggtaggtttcctggaaatctcatttgggagtttgattttgttgcatcagttgtgcgaacaagcatactgtgaagctggcacgccaagcattgcatgccaaatcctggctgaagttactgaaaataaaattgtagtatcctgagtatttcaattcataacaacgacccaaaaaaaaaactctagttctttttttctttttaacttgcgtgcagtaattaccaagtgtatgattacgaaatggcactataatgtccaaacgagatatttgagtagctttaatggaactcataaaataaaaatatatcattctatttattagagataacttgttccttgatgggtgtattgagtgagacaggagcaaagaatagatcaaaggaatatgatagagctaatcagggctgacacatatgatatatggagcttcttagaagaagtctacagaaaagatataaagcaaagcaaaagaaaagctaatggcaatctggtccaaacagcacaacaaagtttatatgctatatgccaagtatgaagtgctatgctgtatggactttattaggggtgtttttgaactcttgaaccaataactatctctgtgaaataaagctgaaatttatctaccgaaaacaaattttgcatagtagcttagaaaatatgaaaagacatacacagtttggactttgatattcatgttcccagagcatagcaagcacagtactgtggaatagacataattggatttctactttgatttttgtgctttactaccaatattacccgtgcgttgcaacggataaagacaattttaaaataactgaacaaaattatctcctagcgaggagagcgcgccatcgccagctaccccttctttcccagtgaggacaccgtcttctggttcccaaggtgaggataagctgtagctcctagctccctcgccctattgccaatgccgaccgccgccgcacagctcgccctacaggaagggcgcgcgacgtgctccagtggcttaggctgacaccacagggagagcggtgtggtccggtggtagatgacgtgacctgcttggatccgctcgctcgccgcccatggcttcctcggcggccgccatggcataggaagaggggagaggactcagaggagggtcgaggccaccccgccgcggctctgcctcgagcctcgaggctgtcctgccaccgctttgccttaggccgctatgtggggaaagtagagagaaaaaaagagagagaggagtctaagagaggagacgcgttagcaaaaaccaccctcaaaaccaccaagagtcattttgcactagttttaattttaatagttggagggtcaaaatatctggtattgcagttgagggatacaaattaggttgatcctatatttgagggagtcaaagtggacttattccatatccctgcatccttgccttgggcaggcaggcccacagcctgccatgcaacaagcagcaccagagtatgagcccattgggctctagcgaatagtttggattcaccgtgttgtaccgctgcctgatttccgtacgaatgacagaggaaaaataatccatgtcggtcatggtgacagaaaaaaattcacgaagacggacaaacgaaaaaaagaagaagttggaaacattttttttttttttgtaaataggtaaagataaagatttgtatagagcaactataaataaaaatttatcatagctacgtttaagcaaaggctgtttgcttcttcatgaggtaactactattatcctcagttatgttacatattccaccaagtttagttttttgtcacatgatcatgtagtgtaagtggtatgaacttttacatgtgtttttcctgtgcccaaagttactttgctatttgtcagaaactagaatgttgatatctaacacctgacactgctttgataagttgtgtgtattatctatatttttccatggcttccatggctggtgtaattactataatatactgtggcggtttatttttatatatcttgtatgtgataacatgtcaaggtggttttttttttctttctgacattagtatttacttattgaacatttattatttgatgggttcgtattctatttgctgcctttttctgctgagctgttctgtctatgctcagatgccacttctcacttggaaatgtctttaccgagtcatgcatttggcaagttatgagaagattggaggtgtaaacatgaaagaaaacgaaggatgagagatggacacttgacaatatttgaatggcttggtttgctatattttggttgttcaatgctaaatggttccaatgcaagtattctgttaggaatcactactctgggttgcctggtcatccaagttcttgtcaaaatagacagaattatgggatttgagctcttcacttcttatagctacttcctcatagataaggccttgattaccttatttatagaaataaactagggtgttttagttgcttaagaaagcatctgcccaaggaaaatgttgttgaaaatgaaggtatttggtattgcggacttggttataagtgaattggatattgagatgcctagttacctgggactgcttacactactacaaaacgattggcacacaagaaaaagatccatggaaacatggagaatggagatgttcagttcatctattgtccaaagatctctggtttatcttgtagtgcatggctaaaaataacatttgagattcgggggaaataatggtggaaggagtgcttggtaagttggaaaatagctcaggacaccacttgtttctggaatgtccgtctgtttcttcggattgtagaaattgaagggtggaactccttgcagaggattagatcatgctccaggaggcctaacctatatgatatgaattggataaagagatgaaccaggctttaggaacatgtgaattctgcaagactggcgagcccaaatgtgggttgctgcattgttgatattttaactactttataaaccagacaagagatcaggatcatatggtgctgagttcaccttcaattactgtgctgtttacttgacagaaattattttcagaggcttatttctgcaatgcattttttttctggtttgactcttgagggcctttgctgaaagcagttcaccttcaggagttgcagaactcatgcatgatgcaagtcctacttgctgactgttactccttgtggcttctaatgttcatgtagaatgtttgtcgctcgcctttcaggatatcacccgcactcaggttccatgatacctccacgtggccgcggagtagaaagcagcaatttcaatgacggttcacgttatggatatgagctggcaagtaaaggaggtgaaaggttacaatatgtttctcctcccaatggaagaggaagaccacacaggagggatggtggtgctcctggaaaagatttcatcttcattaatggagaatatgtgcacaggaatgacccaaacttgtctccaagagaaggtgactggatatgtcagaatcccacgtgagtatgctgaatgtatatttgtttcttctttcctttgttgaaatagattcttctgatggtcttgtaaatttattactcattattttttttatttcagttgcggaaatcttaattttgctcggcggtctcactgtaacaactgcaacaaggaacgctatgcacctgccatgtacaagtccagctacagtcctgacagacgccagttcaactctccaccacaagggccaccgagtagggttattggtccaccgagtggccgtgatctgccaagggagaaacaaaggtatagatcaccaccgcgtggttggggtatggtccgaccggatgatcatagggactattctacgcagttgtcccaagatcgtccaggacgaatggcagaccctatgcacagggacaggatcaacttcggggatgaacttccacaccgacagcgtgggaagtttgactgggatggctataatcaccgggagcatccacgcgatggaccatatcttgaccgaagagaaccacggttggggtctcccaggggtaactggggacaagctgtacgggacagaagtcattcacccatgcgtaacaagcccatgaacaggggactagacttacgggagagaagccgttcaccctttcgggacaggcccttgaacaaagcctccattggaagaggtggacctgaccgagactatgttcatccatttgacacccatgggcgacctcataatttgggcaatagccgtggccatggttacaggcaggaggatgatctgtttcctattcgcaatcaaggtgaccagcgtgtcctttcccgtcatcggaatggaatccactgaaatgtaatatctttcagctgggtacagattcttcgtgttgataggctatctggaaaagcgaatctaataaaaattatctcgatgcttgaggactcctgaagctttgtaataatgtttaatgttttgtactgtgtagttacttccttggttgggttgtttcagtggaagtttcaccattagaaatgtcttcatgaactgaatttaaagggcaatgctaggaatgaatattggagtggttaaagatgaacacaaccatactgtgctctgtatgttttattgtgtgaaatcttgaggtgtaaattttgtttattgcagccatgttttacataagctgctccaggcttcgtcagtcaggtaaaagcaattactcctatgttgtatgttccgtaaagcctgctagaatgctaccatggcattactagcactttcctgtgtctttggtaactgtttgatactcaattgtgcaaatatttgtgagtgcagggaataacaatacctgagcatttgccttcaaatttctaacacttttattggtaaaagcttgtgactatgtcattttgcatttctgtttctttctttgtactatctgtctataatctatactctttaaaacattctcaatggtagtatcactgacaactggggccaacaaatgtcggtggagggactgacaaatcaaccgacacaaggtcatcagatcgatcatcgatccccaatttcccacccccgacttttctcgttttatcgcctctccctatctctttcgcgcactcttgtcggttcctccgcaacagtaagctgccgccgccgtcgcctccctcgtaaaggaggcagagctctcgccgtttcctcatcccgtgtgccgcatctccgccactgctatgccgccccaagccaccgttggcaactcccccgcaaaggaggcagagctctcactgcttcctcatcccatgagaccgcatctcttggctgcctccaccgtgaatcgcagccaccacgcccccaacctctctccccacctagccgatctagtagcggcaacaccgcgccgatgatgccccccacgaaacgccgccaccctctagtacgcagccaacctcgtcggcggcggttgcgaacgcaagtgagactgcggcgaaggaggcagagcccacggaggttgcttcggtggagaccatggtgaaggagtccgagctggtgtaagcgtcagttgaggccgcgccgaaggagtctgagatggctctaacggaggtcgatcgtggtagaagcatctctgattgatactaaagaggcaaggtcagtcgctgcagaagttgagtcctactcttccatcccaggcaggtcaaaactcacttgttcaggtttggtgttcgaactttggcaacaaaattagtcggagtaaagagttatcaatccatgttgctacttgccacaaaattagttgggagtaaagagttgcctttactttatcaatctatgttgctacttgctaggga

SEQ ID NO: 48103 - DNA, 2053 bp, Oryza sativa
atatgttacactgcaatgatatatgtagagcatttgactttatctattgtaaatagggtacaaagatggctgctattgtttatgataaccaagtggatcgtttacattccctacttcatgagggatgcacatattatgtgtcaaggatgtccatagagccagctaggatgattgtgcaccagtgatttgtagaccatgcttttgtgtgtgttttcacatgtatcactactattagtgagatatcaaacatgagcgagaagacattgcttattacctccgcttataccacttgatcaagttttttagtttactcagggccgaccctaggcataggccggttgtgcaaccgcctatggcccaggctagagggggcccacccccagcataggtgcgagtcctaagcgcacgccagggagagcgaggttgactcttgaagctgaactgttgaaggtgtgctaatcaatttgttcactatataccctatttactatatattttatgctttaatatgttacactgcaatgatatctgtatagcatttgactttatctattataaatagggtacaaagattgctgctattgtttatgataaccaagtggatcgtttacatcccctacttcgtgaggggtgcacatattatgtgtcaaggatgttcatagagccaactaggatgattgtgcatcagtggcttgcagaccatgcttttgtgtgttttcacatgtatcactactattagtgagatagcaaatatgagcgggaaggtattgctattattacctccgcttatgccacttgatcaagttttttagtttactcagggccggccctgggcctaggttggttgtgcaattgcgtagggcctaggccagagggcggtgtgctaatcaattagttcactatataccaattttcatcatttcaattcatggttattgttgtataatttactttgcaatttcactatttcagtttttgcaatgttacctacaaaacatttgtcgggtgctcacaaaacatttgtcaattatattatcgttattatttatcaagaataaattactatattgcaacttgcaaactgattgatttataatttatcatattagaaatatttacttgcgtcaatattaatatatgagtatatattagaagcactggcggagccgaggcccggctaggatgggcaagtgcccgggttcaagccatgcatcaaggcatagcacctgcttaattacccccaatctgctgattctattgcatgccccatgcaccagaccaccagtaaacaatagataattaagatgaatatttagtaattaattatcattcttaggaatcagcagagtcatatgcatgtagacaggacagtagcagcaacggtgtacagtaatattaatgaacatgcttaaccaaaactagcaaaccaaagtgacataactcttagtgccatcatttttttttctttgcatgataatacaagcactataatcttgtgtactgttttttctcaacctaaattagaacctgcctttactcgagtctatagtaagtgacatacggatttatacaaatatatatgggacaattgcttatttgaccctgttttgaactgtaattgccgatttggccctactttttgaactttgcttatttgaccctctttttcgagtacgaagcttccgtctgaccctcttttgatgactccattagggtttgattttttttaaaaaagaaaatgtttcaagagttcctaatgacgaaaataccctccaaaccctattttgactctctctctctctctcaatcgtgcgtgactctcacagtctcacctctctctcactcgtgcgtgcagcggcggcgacgacctacgcgtgcggcggcggctagctaagggggcggcggtggcggcgagctgaggggacggcggcggcggcgtcaagcactgccccgccggcgcccactcgttgtggtggagggcggcggcggcagcgctttgagggggtccaagtcagcgccaatctgagggggcggcggcaacaatctgtggggg

SEQ ID NO: 48104 - DNA, 4379 bp, Oryza sativa
gcccgccctccgcacgccggcaagctccagcgccttcctccctccgtctgcgtgccggcttctgtcttcctccgcgcgcgcaccgccgccgggtcagcaacaacgacgacgacgacgccatggcgaagatcacagggagccgctccctccctccccgcgcgcgtcggcctcaatcttcttctgcgctcgccgccaccggtcggcaacgacgacgacgacgctgtggcgaagagcacagggcgccgctctctcccccccagcgcgcgccggcctccgtcttcctccgcgggtgcgccgccgccgccgccgccggggaaagagatttttttttatattatccaaactttaggtcaaacaagcaaacaaacaagatataacagggccaaataagcaagggcaaaatggactatttaccccaaaattaacaccgtcacctcacacaaacggaatagggtcagaccagagcttcgtactcgaaaatgagggtcaaataagcaaagttcaaaaagtagggtcaaatcggcaattacaattcaaaacgaggtcaaataagcaattgccccaatatatatgtacttttgttcattgttaggcttacccaggcttaaaaaaaattcctggatccgccactgattagaagtaataaaattagccttaacttgttaagagcccatagtatcaagttcgcctagggccctcgaaattgttgaaccggccctgactttacttaccataatgacatttatgttggtaagtagttcaattcaccacctaaacaatattaatttgtgacaaaatagaagttctattaacacacttttcatatgtggcagatgttattggaatggtcatgtttgtaagctctatagaggctacaaaaggaggatcccatgtaggaatgttcttatgattgatggcaggtgtgtacatattttggtttcaaatccccttacatttgttatcagagggctaaaatatctatattaatatactatctctgtttgtacagtggtaggatatagagtaattgatcagcttgtatagttagtatgacagtaataaattttcctttcctttggtgacacatgtaattagactataaggctatatttctgaactgccatcatctttttaactgggaagaacttttttaggctcggtattagaagcctctcataaatcatcaactatgcttgaccggtatcaacgatttcatgcataacactattgcattaactgtttgtggttgcaattatttgtaatgtatatattcaacttactaagttgttaacatgcatttataattctcatattgcatttgtcctatttatgtttatgcagcttcaaacttgtgaagttcgtcattaaaaggataaaaaatgcttactgaccatttaactaaatgggcgagatgttctcatgagcaacctatcattgtagcaattatgcttatagcaaagcgtgaacaaagtaagccaatgtgtccttattaattttgtgttaatcaatcttattgtcaacaaaattattttttttcgaggggacaggcagggagctcatacaattcactatagaagaagagagttgatccattttataagggaaaccggacccaaaaaccttacaacagcacggtttaattaaagaaaaaccgacaaaaaccccgacattgacaaactgaacctaagtagagtcgttcaacaagagataaactcctaaaacgaagccttcaaaaaggttatgccgacagaacggcgacatcgtccgatcctataacgaatctagttttcacccggaggaaactcttgaagtggagttgaacgagggctccagtagcaacgccttcaagaaggtgaacgacgcccaagggcgtcgccgttgctagcaccgagagcggagcaaggcttttgccttggagcacccatcaaccatagcatccatgacgggagccaccaaatgtcacctacacaccgagggtacctgcaatattcacaccatctgcacgacggctggattccaaaccaccccgtccccacccgagtgtgcgctggatctgagcaaggaagccagatccggccgcccccctcaccaccaacgccggccgacgcctagagggcgccggaggacgccagcggcaaccgcgggatgcctgcgtgctcacgccaccgccggccgccgcgccgccgccccaacgccgtcgccatcacccacaacaccacccggtgcacttacctcggccgccaccgtcgcccgtccctgccgccagcccatcccgccagatccggccgaaacggcgcggatctggcggtcaccgccgtcaccactccgggcggctccccaggccgcccgagcgcgaggagacgaggagcgccccgccgccgcccttgcggccgcgcggctttgccggcggccgctcgggcgacggcgaggcggagaaggggggtggggtggggggagaggggcggctcgacgacccggccgcccctggggagagcgacgcgagagtccttcattgtcaacaaaattattgaaaagctccaaaataatctcttactacataatcaacgatgcagttagatttgtagcatgttataattaatcacatatttaagaatatttcctagagctaagaacggtcattagcgctcttaaaccactcataattatatgtgtaataaaccgtgcaccaataaaaatcagttctatgaatatttcctagaactaagaatatttcctaaaactaataatagctttgaaacgcaaggattttacatgaatcttcacaagtcagttcgaccagttcctcaaaataaactctctaaagttcgtcgtcagtttcaaaggcggcttccgcttttttccgtcctcgtagcgtcacctacgccgcaagcacggaagacggcggcgagcggcggcgccgagcacgggtgcgcctcgccgacgtgcttgttcctctcgtggtcgcgctccgcctccatggtctccaggtcgacggagaagagccacgtctcatcttccgccggcgccagcgtcacgaacccgtcgccgccggcggtcacgatcctcgcagccggcgcctccgcggtgaagaacacctcctgacgccccggcagcccgcgggtggcttcggccagccggacgctcctctccaccgcccactccccgccgccgctctcgccgtagatctccaggtcctcgccggtcatgcggacgacgcgtatcccgccgccgtccacgccgccgatcacccggaggttggacttgtggtactcccaccgcatgtgcttcgggaactccatgaggaagaaggtgtccgtggcctcgtcgaacacctgcactagcccacccggtgcccaccagtagatcttcccggcggcgcggccgacgaactgggtgtcctcggggaactcgacgtcctcgccgtcgccgtacttcaagcccgtgtcgacgaagcgccagccgccgtcgttccccggcgagaagacgcacgccagctcgccgaacatgcagagcacccggtagttcgacatgccgacgccgcgctccccgccgccgccgtcgatcaggtaggcgccgcagaagaccaagctccacagaggcggcggcatgcgggcgatgccctgaaaccgacgcgtcagcggctcgcagacgaggaggtcggagaagcgccggtaatggcggtggccccagctggtcccccacggcccgttgacgaacagcaggaagtgataaaattgaattagaacatattaaattctaattaaatgaaatataaattttctgcaatatttgggtattttttaagtaggtaggtatataattaaattaatttataagtaaagtaagtgataaaattgaattagaacatattaaattctaattaaatgaaatataaattttctgcaatatttgggtattttttaagtaggtaggtatataattaaattaatttataagtaaagtaagtgtgagaaataaaatgttatggttggatttaatttttattaaattttctatatcattaattacactcattgaaattttcttggaatttacgtagtttaattgctaattttgataatacaaatatcattttagtatttatttaaataaaaattcttttatctctatgggcctttttcagcccactttcttcttcagcctaaaagcaaacaaagtctaatttatatccctatactcttcctctcacttgctggactgttcactgttggcccgcgtgccgcccaagtggtgcggcccaaatcctcgatcgatctcagccgtttattttgatggacggctcagatcattttgaaatccctaaccctaaccctccctctcccctccccctcgagccggccgcctccccctccctctcc

SEQ ID NO: 48105 - DNA, 12850 bp, Oryza sativa
  unsure (1)..(12850): unsure at all n locations
cccgcccccgacgccgcttttcccgctccctccgggggccccctcccccccaaccaagccggccgcctcccccgtcccggacgccgcctctccccctccccctctttccactggcaccgcttcctctcccctcccctccggtggcgccgctccctctccccctatccctcccgtcccaccggcacggcgcgggcgacgacggggtgcagcggcgacggtggaccgctccctctccctcccgtcggcacggcgcgggcgacggcgaggtgtggggtatggcgtgggcgacggcgacggcggggtgcggggtgcgggcggcgcggcgacggtcgggtgcggcggagacgacggagatggtcgtccctccctccccctctccctccctctccccgtcgccctctcaatggcggcgtcgacggcgtcggcttcgtccgagggtggatccgtcggcggtggcggccaccgcgggcggatccggcagcggcgctccctccgccgcctctcttctccctccggcggtggtggaggcgtcggcggcggccgatttttttttttttttgcaatttttttccatggctattgctaaccgaatcggatcgtgtatggatgaaaattagatgtgacgaccggaaaaatataaatatttatattagttatagatatatgtgggctgtgccagcccggcccagattgcaatagcgtcaccataacagcttgggaaatgttcttcgacatccctcacctatggaccgagttttattcgcgtcctcaaaccgcaaaacttagggcatgtacaatggtctttattagcgatctctctttattgttatgtaagcatatttggtgacgtggaagagagaggaagaaggaaagagaaagatggttgctacgcatgacaacggcatagagtcgactcttcgcatttattaggaaaatttttgttgcattgagtctaataaaggaaatatggctagtaagaaagtaatttggcacattaatggttagagaccgtattgtcttaactatcgtaacgtgatagcctctaattaacatagagaccataccggtctctacctttgtacttgcccttaaaaaggtacagctccctcaactgttaaaactagattaatttgcctccctaaatggttttgccctacatggtgcctacgtgacatttaacccggtcttttacgttgacctgtcatgtaagtggcacttaaatgacatttcagtcaaggaaaaaaagcgaaatttaaaaaggtaggacccatatatatctcaagagaaaaaaaaatcaatgtgtccacatcccatcctctcttgtcttttaggtcctgtttggtatagctccaactccctctatctcgacaaagagagagagagagataggcaaacgactgcggggagggatggggacagggcgctagctctgtcgcgcgtgacacaactgttgctaggctgatgttgccatcggcgcttagtcgaagaagggtaggaggcgtcggggtcacagtcgtcgatgggcctagtggacggaggatcaagatggtagcgtcatcgtccagaggaggtggaaggagcttgttgacctccccgctcctccctcatatgcaccccatctctttctgcggtgacctcctgttagtgtcattctttatcgtcgctagctccaactcgcccatcacaccgagatggactctgtcgccaagcttcttcccctcgcggccctgcctcacgcctccctctcccatggttgcaaggcttagggatcgcagtgcgtaggctgagaaagcaggaggaagctgcagatgaagaagcagcctaactcggtgatgggagtctcgtcactcgtctgatttggggccctgctgccctctatcaccaccggtggaatgcggggacgagcttcacacgacagggacgaagcgaagtgggatggggaatggggagcttgaccgccagtgatcgttacgtgcctcaaatgtccgtgaacaagaggtagtcgagggataaacaactgctgccactgttggagccatccgacgaaggcacggggatgaacggaggattgaccacatgtgatgtgaccatggctactacagatacaaccattgctcacatcatgaatgaacaagatgatatcaagatcaagtcctccaagtgctggaatccgattcggccacttgctacactgctgacttcaaacggctgccaaatttgcatacgagctccgttttgggcccgtgaatacttgatggaaaggtctcggagtcctctttccaacggatctagcctcatcgccaaactccatctcagttggccacaatcaaagaaacaaggtgttgcgtcacctgtcatgggcctatgggcatgtaacttcgtatgggaccccggcccaagtggggcccatgtgggatgcgccccaatcaggtagatcatgaccctagggtccctttggtcatcctcccaccattataattagctaggtacccctttagagttttttgggttttgtttagatgaaagtttagccattgctacttccttgcagcacgcgtgtcggctagaccgtccatctgcttgtattagaaaccccaacttatcgtgtgtattcattcctattttcaattcagattgcttttatcttgttcttgcttgtttcttcgatttgcttgcaggaataaggttgatctataccggcaagatcaacaacccacggagaggtgtatcgatcgctaaggcgcaacacaacaacgtctagtacggttgtagtcgggtcgtcaatgtttctcccaaatcgtagttatcatcaactcaccgaaagatcgggccaacaacagccttgagtgtctcaagtggagctcagggttcatcaagtggtatcagagctgggcccttgttaagggggtgggaatgatgaggacatcctccactattacccgctggcaaagatgcaaaagtcgggcggcgaccgtgtgagcttatgaataaccccaccctgcttagcttaggaggaggaagctaccttaaaagggagagccacccttcacttattggactggtctttttagggagattgggcctttcctcgagtgggtgtgcctaagaactgttggagtccggattaccttaatttgttgggcctcggtcaaccccacctaggccggattgttatcaacatgtgagtgtctttccagccagtcgaggatgtagtagtggccaaggacggcgggcggacaggcattagcgatgaggcagcagaagcgcgtgcaggcgaaggtgacgaggtgatgaagcggaggaggacgcactataggaggtcatcgatgtcggtaggagtatcttttggcttccatgctttttctccttgttctcaagccgccactaccgctctgcctttcttttgccatggcatggaaccctaagagcgttttgcttccttctaggtgaggatgtgcacaaagtcgtatgtgagaaaatttggaaacacgatttggaaacaaatagaaaacttgagaaaatttttttggtttaatgacgattcggaacgaatatttcccatgtcaaggagatggattctaatcactcgggtggacgtccacccgtttatttcatgtcaactaaatgattatgaaaaaaattgaaaaaatttgaaaagatagatcaatatgtaatacatcactccacaaacgtgcaagtccaaattcaacttctacaagttgtaacaaaaataacaaatttaactgcaaacatacgtatagtaatttgagttttgtttgttatttttgttataatttgtaaaagtcgaattttaacttgcatgtttgtggagtgaaatattaaatattaatatatcttgttatttttttcaaattttttcataactatttagatgacatacaacaaacgggtggacgtccacccgagtgattaaaacagtttccccccatgttaatccacaattatgggctccatacgatggctcatgatctcttttgtaaggccgcacgttatttgattagcaatggtctagtaggtgagaccgctcggaaattactctatccgttttatatggtaagttgtttgactttttattagttaaacttatttaagtttaataagtttgtagaaaaaatatataatattttcaatacaaaacaaacatattatcaaaatacatttaatttgaatttgatgaggtgtagtcgtattattaattttttctataaacttaactaacctaactaattttgcaaaaagaaaatcaaaatgacttatgatacgaaacggggattagtaatcatgcttctgtcatcaagtcaatcaccccactcatcattcggtcgcgtccgtgccgtcaataggggcccaccacctccaatgacaaaatccagacccttccccgacgtccgcgaaaaaacgtgagccgctcgaaaatcggaggagaaaacgaccgggcaccagaaccggccgacactctaacagtcgctgggacgtgggaccctgataccgtaggccccacatgtctgtagcacagagtaacactgtcgcgaggaggagcgtgctgcgtgcgggatccgttcaccgggggtgggcatcttcttcttcgttgcgattacgacccgcgccgacccaccaccaccaaaaggtcgggcgtggtggcggtggacccggggtgttagcgaacacgcgtcacggtggccgcagcgcgcgcacagcctaacctccacacgttgcgtactgggatttctggtttggagactttgcatgggcgtccactatctttgttgtattttcgcattctgcctcaaaggattaaatttggctggctatattaaaccagcccgaactcaaatcttttcccaactcaaatcctttccaaggaatttttttatatgtatacgagcttttcctaacttaaaacttttgtaaattaacttttttcaacaccatgattcatcgaatgtgttaacaaaagataatttggctaagaggaattggaatggtagtttgagatattgtttttatatgaaaaataaacaattttaccatcttttcctggattgtcatttttctagatttctttggagatcaattcaattctcatttggattatacacaccacatagtgtttcttatatgtttgggaattggctggtgagtgttaataaaaaaagttaagaaacttattcttgtagaggcttccgttataatgttgggctctttggcatagtagaatgatatgatttttgataaaacatcatcaaaatcttatttgcaggtacttttcagggcaatatattggtttcggggttagacccaactataaaggcataatgatgatatcaagataataaatgaagcattttgtaaacttgagtcgacgattatgcacctttttgtcaacttcagatggagattctcaaatagaattaagtaattaagggttcttttatcgtgtgttggtgtttcttagtctatgttttctttatattatgtcagtgtgtgctgagtttgttcatgtgtggactttgtaataattgattgtagctcgttgaattccggttattccattacctaaaaaacgattcatccaatgtgctaagacttttaaatactatgttcgataatactatgcaaatggataatactacctcctttttaaaatggatgattactttgatttttcaacacacgtttgaccatttgttttatataatgtaatactatcaagacgtatcacgcaccccaaatagaaccttggcacagtttcaaacaaatcgttgagcaaattgttattgtaggattatttacttgattctaaggataaattaaatagtttgataaataaacttaacaaataatataaaataagtggtttaagagaagagaactttttttctcaaagcatggagcaaataatccagtaaagaaaccaaaaacaaggtttgctgttcggtcgagatttttgcgatacgcggaatgatacatgttattagagaattataaattgagtattatttattacaaacctataaatattaatttgttttgtttctgaaaacttttatatagatttcttcttttataagcgtgtttacagaaaatgaggaagtagccgctgaagttgtctgaaaaaccctataccctcaagggctattgtgcaaaaccccgttctcttaaatgaagtgtaccaacaagctttgctccaagcaaaaaaggaaccaacagaagcaaaggtggcattcgttcgtcgcacgagagcaccacagcctcacgacacgagctcatcccccgccatctccgctccgctcctctcctctcctctccgtgctacgccaccaaacccactccccccgagatagagagagagagagagagagatccacagcctcacagcatcaaatcacctcccctttctcccagatccaagccgccgccaccaccccctcgccgtcgccgtcgccccctccggccgatctgatgcccgcgcacgcggcggtggtggtcaggtaactttgtaggccgcctcctcctcgattttttgatttttttttcttctcatgtgctaaccacgccacgccaccaccgctattaatacatccccgaggcgagtgtcgaggcatttaccaccagatcgatctcgccttccgctttcccaaatccctagactgacctcctcctgctgctgcttgcgttgcgttgcgttgcgttgtctctttctccgatcagcgccgatgcggtggaagcttaagtcgtcggcgtacaagcgcgtgccgtccagggacgccgccatggatctcgacgtcgagacgccaggtccgtgcacggttttttctctttttttttccctgcgatttttttttgggtggtgagattttgaggttttttttttctgtgctcggtggcggtttctgcagcgaaaatggcggacggcggggccccgtcgtggcgcatgtcgctgccgcacgtgtgcgtcgccacgctcacctccttcctcttcggctaccactccgggtgcgtgccatccattttctcatttcttcttctggttgtggttgttttcccaactcacggtgtggagcgcgtgcgtgtgattggttggtttggtgcagggtcgtgaacgagccgctcgagagcatctccaccgacctcggcttcgccgggaacaccctcgccgaaggtaagtaagcagccacgattcgggtgaaatttgatgttattgggcatgggagcaattgggtgtcctgtgtttcaggccttgtggtgagcatctgcctgggtggtgcgtttgttgggtgcctgttcagtggatccatcgctgacggaatcggcaggcgtcgcgcgtttcagctcagtgcgctgcccatgatcatcggcgctgccgtaaggtaattcgtggtgtcccacttctgttgacggctacttcctctcaatccttagtccatgcgtggtaatttgtggtgtcacacttctgttgatggctacttcctctgaatccttagtccatgtgtggtaatccatggcatcacacttctgttgatggtcacttccactaaatcctagtccatgtgcagtttggtcagtttggaatgtatttaattgccacttgctagcatttcttattttctagctggagttgttggtttcttggtgttaaacaaataaggtcagtggccactggtagcctggtttcttgttggtattgtatactttatttggaaagttgaatgttgggaacaacaaacttactctttcttatgtatcatattgatatattggtggtgtgacaagtagtagcttgatggattcgtccttccatgggattttgaatctccgagttatgtaggagatgaataaaatgtgtggtcctcttaacacagtgcagagagtagtatattgagaatactaggtttgccatcccgccattaggtaaatttatatggtttcttcgactgactgtggagctagtgtaacttcacatgcaaacatgaaagcaatcgaactttacgataaattgactttcactagccacaatagactgaagagtactgaaaattaattacacgcatcttctagaaaaccatggctcaatagtaaatattcttttcttaattgcgctcatgatgtacttagattgattatccttaaaaagggaaaagttctagcctttcaataattcaacactcttattaattgatagctagtgtacgttttggatatagcataccaagtcacttatgggtgttaagtcttggtttatttattggtgctgtagagttgctgataagttgaataataacaacataaaccatatgtgctctgattaccttgaggtgcttttacattgccattgctacatggcatccacaaactaaagttcacttaagtgcattgaatgataatatttaagatgctaacctttttttgaatctttagcacttttatcttctgcatgttatttaataggatccgttttggtagttgcaccaagactgttatttccgaaaatgcaattgtgtaatacttacatctatgagcacctaatacttgagagctgccggaaggaactatgcctgaacttagttattcctatgattctgtttcattgaaccttcctgaagaagaaacattttgcagcgctctcaccaatagtctggagggtatgcttcttggaagatttttggttggaacagggatgggattaggtccaccagtagcttcactgtacataacagaggtatgtaattggtgttatgcacctatgcctcaatctctgattgtctgtatcaaatattaatcttattcatttgtacctttttcttataatcccttggatccaggtttctcctccttcagtgaggggcacatatgggagctttgttcagattgcaacctgccttggaatcgtagtatctctcctaattggtacacctgtgaaggatattgatagatggttagatgctttcttctgtagctctctacatgttttgtgtagttagtaaatctgatgcatctaactttatcctttgctattaacaggtggagggtgtgtttctgggttgcagctgttccagcaactttacaagctcttggaatggagttctgtgctgagagcccccagtggctgtataaggtgtgtttatcttgggggaagctgcttattttctatctatgatcttccaacttaaatcacccttcaggtgtctgattctctataattgtgcttcggcaaatttgatcttaagtgcctttgctagtcgtaaaatgagatactcatatttgaggaccatcttggagtcactttgtcggaaacgacatttgatctcttaaactatatgcaaataccacatgctgatttttccatgaatgtttgaaggtcactgtcgtattaaatcaaacaattaatctgttggttagaacttgcaatctaccatcatcctgaggttttttgtgcttacaattaataatgggttgacacaaacttattgcctattgttacttagatggtaacacgaatgatatctatagaagagtagtccattggcacatattggtatttgcttcagaaagcacacattagattttcggataaatatcgttgatctttagtttcctcaatactgtgcctgttttctgattgtgcaccatgcaaatacagctctgatatgagcaaaacattttattagttttttttctgagaaaaccaattctcaacacagacttatacaactcccatacttctttatattggcaatttgtattgacatatttatatttaacttgtagcacatacattgaaaattattgacgagtcttatcttttattcagtgtggaagaacgactgaagcagagatacaatttgaaaaacttctaggtcctcttcatgttaagtctgctatggcagaactctcccgatctgaaagaggcgatgatggagaaaatgtgaagtattcggaattgttttatggtcgcaactttaatggtacaagctgttatgtgttttccattctgttgtgtatttgcgctaaactataaccttatttatgtttggccttgaagtttgttcattacaagtccctttttgctacagttgtttttattggcacaacgctctttgctttacaacagttatccggcataaattctgtgttctatttctcatcaactgtgttcagaagtgtgggtgtgccccctaaccttgcgaacatatgcatggggatagcaaatttatcaggtgggctcattggagcatcttctctttttttctgttgttctactgttctgttatattgatggttgatggattttgtttgatgtgtttgcttccaggctcaattgtagctatgcttctaatggacaaactaggaaggaaagtacttctttcagggagcttccttggcatggtaagctatcactgtgattggaacttggaagataatgttgaacattactcactgcacatctttactgctataggcctttgcaatgggacttcaggctgttggagcaaatcgtcaccaccttggttctgcaagcgtatatctttcagttggtggcatgctattgtaagttttagaattttatgtcttccgttactttgattctactatctttcaagttatctgaatttagttattaatgtctaggaggctaaactaaatagctgtgactactagttgaataccttaagcaggaggttttatgctcctattggttaagccaatttatgctacatttttgtgccaaatgtgccaatatcaggcttaaaaatatgcaaaattctctacttattgtatctacaaataggattttttttatggtgctctaaatttgttcagaccatccatttcacatcaacccaaaggatatcatttctcttatacctcattagaggtaatagattataagaaggatggaaacaaattattcaacctgatacaaaacattgttgcgtataaattcttccaagaacttgttcaggcaaccttttggttgcatatggtggaacaattctgtgtcaatatatcgatctgacatgtaaatggcactggggatatcagttgcatacatgatattgttctgctttgcagttgtttcattttgattcccctgacttcaccctcagcgttgttgtgcatccttagttattctttatatgaacaatagggctttccatttggtttaatttgtaactagttaaattatgagacagtttacctttatgctgctcttagcagaactctttaattgttcctgacaattatactttactggctcattaagtacaaatgttatggtaagtctaccagtttcttatagttgagtgcttctttttcaggtttgtcttgacattttcgttaggagcaggtccagtgccaggacttcttttgcctgagattttcccaaacaaaatacgggccaaggctatggctctgtgcatgtccgtgcattgggtaaggagttatgtttccatcacaaaaaaaaaaagacactgcatgtctgtgcattggataggagttcatttttcatcctcaaaaaatagacactgcatgtcaaaatgctggcagttagatcaaacagtgaaattcaacgtggaaatttcgttgctgattttcactttttggtttaatatgttaatatttggtattatgtgtctatgcatgtttcctgttccattaggatgtttaaaaatatgttactgctagtatgtaaccatagctgttcacattgttcaatgataaaaggagcctagtgctaaatacctggtgaagaatttgagctgttgtttagtcaggctgagctagaacaggtatattagatcaattcaaaatattcaagctgctaagtcctcaatagcatttccacactgttttaccaaccctggttatggtaatgaagatcagaatttcagaagtatatttgactctgtaagctgcagctttctctgtgtaacaaaatcgtttcccccaatcgccataagataaaaggtactgtatgctgttaataataaatgaataatggggccagatttttaaattagataataaaaaacttagacatttcgatatggttgattatgtaatggtaaatgataagtgtagggttgcaacaataatttggtagggcgcactatttacttgccatggttcattgtagttctaccatgattcgtatcgacgtcttgacatgctatgcttaaatgctgcaggtggtaaatttttttgtcagtttgttgttcttgcggcttctggagcaacttggtccacaagttctgtacacaatgttttcctcagcttgtgtggtagcagcaatatttgtgcggcgccatgtggttgaaacaaagggaaagactttgcaagagatagaagtttcgcttctacaaacacaataaaggtgctaatcttattctgaatctgacaacacaatttggatctgttaatctgtcttatctaatcttgtctttaacgtggcaattttttatttaaaggtggtttgcgagttgcgatgcacatttgaaactcacaagatgaactgcctggatttttagttgatatttcatatggccatgttgatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncca

SEQ ID NO: 48106 - DNA, 2371 bp, Oryza sativa
  unsure (1)..(2371): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcagtaaacaaacttccaggacagcctaagctgaacttgagcacattgaatgaaaatatgttagtccatgaagaagctaattaattaaatggaaggggacgtaaatttcgagtacgaacattgcaggtatcaatttcggttttgattttttttttttgcagaaaggaccagtaccaaaaataccatttgtaatttatagtctaacaattctttacccatcaaaataattctccagaatttctgttgaatttggtaaatgttcaccatcacactcctagaaaaagcattttcccatgcaggggaaatgcgtcatcctaggcagatggtggctccgcctgcacaccaacgccgatcttcgcagtcgggtaggaggtccgcctgggaagatcattttccctagcggactggagctagacacgctgcctgggaaaatatatcttagtccgcctgaaaaaatgagatgacgccgcctgcgaaaataggtaaaaaatttgaaaaaatgttacaataataatttgtgataaataatgttccaattaattaattaattgatgcttaaataatattagtaactaacaaacatttgatactgacaaatatacatatattacataagtgaatagtgtcatcaaaatgttaaaatattttttacattgtcacttcgagtacactatctaattatattatggcatcgcgttgttcggttgttccactcctgaagattcttgtaagcttcgcttgtagccagaatgctctctgcgtcgaagaatcgtcctttgacatgatagcactcatggtggatgaagtggtagaggtcacactgcacatttataatgcatgtatcgtcaaagcttgttcgaagttctattctaggcaactgcatgcatgaaagaagcacaatatattagtatcatctagatgtgcagttctccgatgcacttatacattgagtcaagagatttacatcctctgcattaaccatgtatcttccattaaccctgaggaatttgcatgcataatacccgcagaggaccgtgcctctagattgcttgtgacacttcatgacatatcatagaagaaaatagttaagttttgtaattagtaaaacaattgaaatacattaagtgagtggagtattaccggccaatatgtatatactaacagcttctcccttgtttgaatctactctccacccttcttcttgtagtagttgtatgcactgtatggattttttaccgtttcatattaagtaggagatttaattttaatacattattagtagacatgcaagagtattagaatcacttactattataagattgttagaaattgtttgtacgtcatgtgatgataatcaagggggtccaagattgtcacggtgccgtagttcgggtagataatgaaacagatgtaataatcgcttcatagtaatgacgttgtagttagtcacggatgaaataacacagatatgtacaaaaaaatctactggacttacttaaagttgtacgcggtcaggatgactcttattgtgaaagtgtaagtgttgacagtccttaaatcataatttatgaccgtcaatgcctgcatataatgagataaaatatgatatccaacttagtggtagggattattactaataatttccactagtgttggtgaaatatgtgtatgcaggtattttacaaagaaaacatatccgtcatgcgacaaaatacacctccgaacaatcaggacacgtttacacagattggaggcccaataagtcaataaaaaccacttagaattggaccaaaacatagtacataatgttaggggcccaataagcaacctcccagctgaaggagaggccaggaggagtgtttttgggttcgaccgaacccttcctagcgcatcatgccatctgctttcacgtggacagccctgattactccctaatgatggttgaagggtatttttgtcatttcccatggctataactgccatctggagcctataaaaggaggagaggatctcgttc

SEQ ID NO: 48107 - DNA, 15940 bp, Oryza sativa
  unsure (1)..(15940): unsure at all n locations
cctgcagcccaacctgaacaatgcatatgcttcaatccagtcggcgcaaccattgccccaaacgcagctgtttcaacggaggaccaacatagtgcttccctttgcgagggcacttccatttaccgcggatctctgtcgttgttggagcagctgctacttctgaaacattagtcatgtctgctaaggggcttctgctagtgcgttcttggactacgactttctgttccacaatgtcacggttctcttgcaacgtcgtggacttcgctcttctcgttgggggcttaggaattttgtttgtgttgaatgtttgttctagtttctcctttctcttgatggcaacaaaaccatcagctgcaactgtttcttcctgctctttgtcatccattgcagggttgccatggcaagtttcttctcctggagaattttcttcagtgttaggtatgatgatatcattacaaccgatggatggtaggctgctcttaatgccatttccgtcaaaccgccttttggtgcgatccttgcatgttctagtacaatcaactgacagtttgctctgctcattaccatctttcggggtgattttgtcagcatgacatgaactcataccatcaccaattagcagtttgctctgctctttctcctgatcaacctgggaaccttcttgagtatcacctacatcgatgccattacaatccaccggcagctcactgcattcgatcgcgccttcctgacctccttgagtatcatcatcatcaggcaagcccatggcattgcgatctggcagaggctcggcttcatttctctgaacagacaacaccgcctgagtttcagtttcagaagtctcaccgatgttgtcaagaaagccatctccgaacaagctccgcaagctttgcttcctcttcgtgccacgctccactttgctcttactaatgggaatgaactctctaatagcagaaacctcatgctcgtgttgctgtccacattggtttcccctcaaagcagaatcaccatcaccatcaccatcaccatcatgggtggtcggttccaacaacgaatccacaggcaccccgacctggatattctagaacaaaatatgaatttaaggaagtcaatttggataggaatctctgagaaaaaaaattggattgtaataatttgtgagaatgggtagcaagataaatagaagcaaatcgagcatgatctgaccaaaaagaaaaaattgcagcaacattttacctccagcgggtcttgggtctcgctgccgctattgccgccattgccaccaaccagctccggcacctccggcgactcgtactcatagctcgagaaccagttcttgatatccggcggctctgacgaacaacaccgaaaatgagatcggaagatccaaaattgccgtatcaagaaatgctacaatctgtcagggaacacaagggaacctacgggaagggaacgagaacgggtgcgagctccatcctcgcgcctgcaggaccaaaaaaaaaatcgccatcgtgagggtaagagcatcccgaaaggccaatcggttgagccggcgagcggcggtcgacgggatagcattgaagaagcaaggattgggaggataggaggagatcgaaggggaatgccttgaggcggcgtacctcgattgcggccgcggattcgtcgggggtctcggccatggcggcgaccgaggccggagggtgggagtcgcgaggaggaagaagaagatgccgctctgccgcggtgccgcgtctggggctctgaaatttcgaagtgcccgcgaagcgaaaagctcatgttgccgcgcgaaatgaaaaaggggaaaaagaaatcgccaaagacttttcggcttcccgtcaatgcattgaccaggccgtgaggcccctcgtggctagaaatggcgggcacaaatgagccggcccatataaagtttttcttttcctctttctgtattcgtaacaacccgtaataaaatattgactcgtcaggcaactgtcacgctttacgtttcttgatcttgacggaagctagtcaaccgtctctgacaaaagtcaaccaacattttgatctctactcggttagacagctcggtggatcgacgtccccaaacgccaccccgtgcgcgttccggcagaacgacgccgccggctgctcctcctccgccgccgccgccggtggctggtacctcagccggacgtccctcatggcgatcccggcgcacggccggctcgggctgcagtcgaacctcaccgccgtcgccgtcgccgacgtcccctcgatgtccgtgtacgacacgccgctgatctcgatccccgacccctgaacacacagcagagagagaagccattacgacgtcggcatccatggcgatggcgcgacgaggtcacaggtttcagggctgcgtgcctcggttgggcagctggcgttgccggggcagtagttctggtcgacgatgatcgggttgctgacgttccgcatgacgacgccggagaaggagacgccggcgaccgcgccggcgttcgccttcgcccacgtcttgatccgcagcccgttcgtcgtcccggcgagcgccgcgcccttcacggtgatgttccgcaccgccacctgctccggcgtgtcccccaggctcccgatgctgccacacaacacagcaatggagctctctctgagcatcttcgagcagacgacatggatttcggctgtgtcgctcacctgatgccgtggccggggccgcaagtgacggcctcgatcaggacgtcggaggagccctcgaccatggagacgcagtcgtcgccggtgccgatgacggcgttgcggacggtcacgccggtggactgcttgatgtggatgccgtcggtgttggggctgcgccccggcgccgacaccaccgtgtccacgatcgccacgccggcgctcgcctgcacggtgatgtggatcccggcgctgtcccgcgacgtcagcccgcgcaccgccacgttcctcgaccggtatatcgtcagcgacctcgtggcgggcgggcagtcggggcggcgtgcgcgccggcacgcccagagcgcgcggccgcggccgtccagcgtcccgccggcgacggacacgccgtccacgtcctggaacacgatccacagctgcacgccggcgtacggcacgggcgcgaccaccgtggcgcccgtcatgttcacggccaccgcgccgctccggcacggcccggcgaacctcgccctggacaccaggtacaccccgcccgccggcacgaccaccgtcgccgccgccgccgccgcgtcgcccgcgcacgccgccgcccacgcggcctcgaacgcccgcgcgctgtccgtcaccccgccgtcgtcgcccaccgcgccatagtcgatgacattgtacgtcgccgccgccgccgccgccgccgcaacgaacgccgacaccagcaagtgcgcggcgacggcggcatgagcatgagcgcggcgcggcattgggtggtgggggaagataagcttgcgatgcgattgctggtgcgatgcaacaagagttggttgtgttaaagcgacacgttgatgtggccttcaaaactgtcttggacgtgtgtgccatgagtggtttgaggggcaattacttgtaagattaggcaatgttatgtactgctgctaatgtgtggaccagttgctacgccacttattcgtgtgcacgggtgcacagcaaggttaggcaggacttcaggagcttgcagtgcagtgcagccttgcaggacattaccttcttttctcagttccctctaggccttggtgctacgaatcttagggcatgtataaggccacttacagtgcggtgaggtgtcgtgtggcaatctccatccacgttggcccaatgtacgcgtggaggagagaaggaggtggggcccacgttttccccaggttcgcgtggctagttttggctccgagaacctcagcaaattttgtcagagaaaagcacatgccacagagcgagagagagagagagtgaagaagctcgccggagagggagaggagtaggggcgctgaatccgtaccagatctgtgccgagttcgccatcccatccggcggcgacgagaagagctcgcccgcggaggtggtgaagcgacggcgccccgccggccgacgccgagctacctggccgccaaatcctccgccgccgagctcccccgccgcctaatcctcctgctacgagtggtctcgatgtgacatgcaagataagaccacttaaagaccacaactcccacaatggaagccacccttgagtgttttttgtgttttagtccttagtttcttacatgtcggcccttgtaaaactttattattaaatccttgattttttttataattggactctatgacaacaaaaagaaacacaaatatacccctgatctcctgtcggtcccacttgtcagcccctatctccttttcctcccctcccctactccttttccccatcaaagccaccagacgccaccaactcctcccctcccactccgctcaccgccggtggcagcactgcctctaccctccctcggctacactgatcggggcgtcaagctccgtggcagagggctacgagctcgagctctctcctctctccgccagcgaactggagctctctagtctctcccctctcctcgtgacggaccgaggggggcacggcagcgatgagacaacgagctcacctgatctgaccgttatctcggtgggcaatgagctcatgcggtggagtcctcggcggtggcgcagacgacctcattgaattcggacgcaatcttgctagatccggccatgaccttggcaagcgacgagcttgtgcggtggagttcgtggcggtggcgcagacgaactcgccggatctggacgcaggctcgtcaaatccggatgttggtgacttgccggactccttgaaggcgttggcggcacacgacgacaaccttggcagtggcggcggcgcatatataagtcatccctcatatataagtcatccttggggcagggcgggcagtgcagccgtcatggccccaggcgttaagcaccccccccccccccaaccaaactatatgtagctaagtgtgcatatatagtttgggtttgtaagtacatgttgctttatgttgtacttcctcaggaaaaaaaaacctcatattcattgtacttatgtccccttctagatttttttttggatggagtattagttatctcttggaaagagagttaggttcttatatatatattatgctatatgtatgtactacttccatcacaaataaaccaacatgggtagggatgcgatactagacagtacaacaaatctagatatgattcattgtactatctactgtcacattcatactcagcttggtttattttgagatggaggtagtatggttaaaatcccttgaacacacaaaaaaaagataatagttcgatgatttttatttgttctacgagatggccatgttagttagtgccttagtaatctatagcataatttccatgattgattcatttctcttgtagcactgcactaattttctacagattgcgtgatttttaaattttagggccataacagatattatacacttgaaaagtttggtgttgataattcctttttatagttaatttgtttttctattcaattatcacctaacaaatagtttatgtttagtgatgtgttaaagttaaacattccattctatttaaaataaaaggccacccgttagggttcaaatcctattgcccatatacattaagcacacgtaagtggactttcaataagaatttattcaggctacggatgtgaaattggtcttcgtgtatgttaggggtagacttgtgtgtagtaatgtgcacatgtgtgtctcccgtatagtatgaaaagtttagtcatatttatatatacaaatgctagttatcgtagggtctcaatttttatctcgctctacactaaaatttcaggtccggccctgctcacttagggcaatcttcagacaaactccaagaaaaagtagtgaaaataaaaggtgaattgaacaaacaaataaaataaaaatattaaggtgatagattgtacaaattatcttttagtttacaagaataaaattagaggtgataattgcctattctacacaacttgctcttactccctccgtccctaaatatttaacgttattgacttttttaaacatgtttgtccgttcgtcttatccaaaaaatttaagtaattattaattcttttcctatcatttgattcattgttaaatatacttttatgtatacatatagttttacatatttcacaacagtttttgaataagataaatggtgaaatatatttaaaaaagtcaacggcgttaaatatttagtgacggagggagtattaccctgtaaactgatggtgtatggtcagcggcgttgtccgtttggaatttgatcgtttctgctaactaaaagcgaacctagtttcaagtgatatatctcggactttcagacggaaattaatttgacattcatgtggaaagcgcgacagcttttgagtaaagttgggtaaacttaaactgaaattaaaggcagaacaacttccacctaaagatatcccatccactctcaaccaaaagtctcgagcttccggttcactttcaattaatcattggcattattaaccatgattttggagcggtttaaagtcagatattatcggctgaccgctcaggacaattttgcagaggcacatgcatgaaacattcgaaacatttgttcttttttttccggacactcaagctttggcatgagcttagcacgacaatccattagaagatgcagagtcaggcctgggcgacaaggctactcgtttatctcaaaatttatagaaagtctgaaaatatcatatcaccgtttcgctcacagtacttaggtgaaacggctgttagcgtaaaagtttttataagtaatacttttgtgttcctcaatgacttaaaagtaaatgctgaaaaattaactacaaacagaaaaactcaaaatcaaatctagttaaacttaagttttaaaattcaatttttttatgcttaataaagaaaccatatttgataccggaatatttgttttgataacatgcaactggtttccccgttgggtaatccttcacatttggcaaaaaaagaaatttcaagaactagaaagcctacgtggctacgtaatactctgtttttatattaataatttggaatattttgagcatactttagctttctttgcaaaaatccaagagagtggcttaatccgcccgttagtccgttactagggccggccgtcgtagcttccggatacaccaaccaatatggcttgctttttccgtcgcaaatcaccaagattttcacatgtagatgcaaccattgtacgcttgctgccgtacgtcggcggcgtcgtgccgtgccgtgcggtcgccggtcagaggcagctcggtgggatgaccacgccggacgccgacccgccggcgttcttgcagaaggacctcgccggcttgccgccgccgccgtcgtacgtcaggttgatgttcctgagcctgatccccgtgcatgggttgctcccgctgcagtcgaacctcaccgccaccgccgtcgccgacgtccccgtgattccctcgtactccacgtcgctgatcttcacccccgagctctgttgatcatcagccatggcgcccgatcagctcacacgcaccgagctccaagctcaagcatggcgtgttgctagcaacaagctaggtttggatttttatttttatttttttgaacttttttaattttaaaaatataaactctttcaaaacttaattatttacaagatatgaatcatttgaccatgccaaccagacaaacgtccagtttacctgatgtgatagtgttatttggccacgccggattgattagagtgacaatgttatttggtcacaccatcctaattgatggtaagataaaactgtacagttgtttgtgttattttactatgtcaaacgggctagggtagccaaaaggttcatattttaaaaaaagttttggaagatttatttttaaaatttcaaaaagaaaaaagaaaaaaaaatatcctatgtttgtggttacctggccggggcagttgacgttgccggggcagtagttctggtcgacgacgatggggttctggacgtcgcgcatggcgacgttggcgaaccgtacgccggagacgcggccggcgaagggcttcccccacgtcttgatccggaggccgttctgcgtgccggcgagcgacgcggactccaccgtcacgttccggacctcaccctcgccggcgcgcccgccgaggctgccgatgctgatcccgtgcccggggccgcaccggatgttgcggatggccacgccggaggtgccgggccccacggagacgcagtcgtcgccggtgcgcaccgtcgcgctgaggacggcgacgtcgcgggacagcgcgacgtggatgccgtcggtgttggggctgtccgccggcgccgcgatccgcacgccctggagcgtcacgccggcgcagtcgaagatggagacgtgcacgttcttgctgtccaccagcgtcacccgcttcaccgacacgttgttcgactggctgatgtccagcgtctaaaagccaaattcgatcaaatttacgaacaaattcaaacgtgaaacacagtatgggtttgaatatttgaaagaaattaattactgtggtgcctggtgggcagcggcggccggcggcggccttgcacgcccagaaggcgtggccgttgccatcgagcgtgccgccgcggatggcgaggccgtgggcgtagtggaacgtgatccacgacgcgttgccgacggccggcggcgcgacgacggtgccgtcgatggcgagcaccacgccgccggcgctgcggcagggcccgcggaagtacgcccgcccgaccaggaacgtccccgcggggacgcgcatcaccggccgctcgccgtcgtcgccgcacgccgccgcccacgcggccaggaacgcccccgccgcgtccgccctcccgcccgcccgcgcgccgtagtccaccacgctgtactccgccgccattactgacgccgccgccgcgagcgcgaggacgacgccgaccaccacaaccaccgtgatgacgctcatctcctctgctcgatctcaagctgatcgagagagagggagatccagagacgggatcggctgcgagattgctcgtatttaatggcgatctttcttgcatttgcgttgatttgcgggcggcgcggccatgttggggtgcctcgatcggagtgcgtgtgatcggctaggtaggagtgtggggtgaaggattgcgcggcggcttcgcgcgcttcaatggcgggaaggatcggatgcacggaatggaatgagattagcggccgtacagaatgccgtggtgtgtacggattgcttgccgtacagatgaatgtgtaggagagacggtttgaccgcgggcgacggaaaattgttcgtgattatgcatatttgtggtttcatccatgatactaatgtgtctttcaaaatactctctccttccccctaaatgtttgacgccgttaacttttttaaatatatttgaccgttcgttttattcaaaaacttttatgaaatgtgtaaaactatatgtatacataaaattatatttaacaataaatcaaatgataggaaaagaattaataattacttaaattttttgaataagacgaacggtcaaacatttttaaaaaaatcaacggcgtcaaatattttgggatggagtaagtatagtagaagtgttatattaataagagagtacttattttttgaatgggctgacatttcttagctggacgttctgctatggttcttttgtaattgtactgagcagataaattacttaaaagaaactagcactatatatcatgaagaaatgaaaacatacggtatagttgtttaatatagtataggaggaattagattactttgtaatatatattggattcgttgtattgagtcctgtatatatgaccagtatatatagagattatatggatagagataagaaaggataggatacaatcaatcctatcgtattacaaatttaactatcatatactttagtaatataatatattctaatagtatataattgaatgtgtcaaacaaatagggcttatgatcttgattatgaatcgaacaactatgtaaatgtaggaatgatgtgatctgacttttgtgtgttgtccatgtacaagctatacctaatgagtgcattgaaatatccgattgctaaaaataacgaaaagttaacctactgccgcttattcgtgctgtttgtactctactgactggtcattcgtctggttaatttgctacctactttcttccttcgtcctaaagtgttgttatttaagattgtgatccaaataaatctttgatttgtacttcatccaaaaaagaactcaacataatataggataatataggatgtgatctgtccatattcattttactagaagaagtcacatctccatctacaagcataggtatctttgataatagtgttttcattatcttgatgagctcctctttatttaggcttacgagccatcttattaaaaaaaaaagagaataaagcccaaacaaataaacaacttaatccgatgaataggatggcaggaaaggtatcatcctaaatgaacttatcatgattcatgccaaattaatacttagtcacataaaaccccggccttaaactactaatccacagaaaataccaaaaattgatgggcggatgcgtgcatgtttcttttttttttctctcccaccgcattatcctcttctgtgtaagcagaaattttatatggccaattctgattcagaattgaaagtttcttagggcattctcaatggttaaggtcactagagcaataagatgggacccacattcttatgttcttttgtatataacatatgctacaatatatatagctttttcttgatattaagctgggacccactcatgaaaaaactctattcaacataaagagcatcatgcgtggtgcaaaaggtatgaaatatttttttatttcttatggtctaaccttaaggttggttatagccatatttttactttctcctctcccaatgcataaaggtagaaaaaatactactttattctttaaggtggctttgcatgcaacgttgtggatgcccttatggaaaagttttcgagaataacgatttatgatagacttgacaatcccaagccaaaccatacacatttatgtgtgcaccggggatgcaagtgtgcttctttttctcgcttatcctatctatatttttttttctaaaatttatattaccatgtaaaaaataaaccaccaagcatgtttttatatggagagtagaactgcccatttatgcatttgtacgtgtttttatatggataatagaactgcccactttcatggctaaagtacataaacattcgccaatctatctattatataattaaaggaatagaaaaagaagcctccacggtcgctcttatggcctagaaattctcatattaatcggagaaaaagaaaaaacagagtccatatagaaatataatttaaaaatagttgaaattcgaaattaaataataaggaatattaaaagaggagactagagtccatatagaaatacaatttagaaatagttgaaatcggaattaaaaaataagaaatattagaagaggagactagagtccatatagaaatacaattaggaaataactgaaattcggaattaaaaataaggaatattagaagaagagactagagtccatattaaaatacaattaggaaataactgaaattcgaaattaaaaataaggaatattagaagaggagactagagtccatatagaaatataattagaaaataactgaaattcggaattaaaaataagaaatattagaagaggaggctagagtccatatagaaaaacaattaggaaataactgaaattcgaaattaaaaataagaaatattagaagtagagtatagagtccatatagaaatacaattaggaaataactgaaattcgaaattaaaaataaagaatattagaaatagagtatagagtccatatataaatacaattaggaaataactgaaattcgaaattaaaaataagggatattagaagtagagtatagagtctatatagaaatataatttacagaaaatttagaattttttaaaaaaatatattaaaagacgagtgtagagtccatataggaatatatataatttacaaataactaaaatttgatattaaaaataattaataactaacacgtatataaaatataatatgaatattacacattagtagttttataaagttattgcaaaatttaaaattatgttgtcattttaatatatttgaataatataatgagaaaacatatatgctattatatgagaaaaaaatataatgataatagcagcgtaatctgtgcgggccaccatgctagttatataaaaccaaccaaatttagcgtaataacaaccattcatcacagcttacctcacccagaacaaaaaaaaaacaaacaaacaaacagctgagctcctctttttgactgaactatcacaatccaccatcagttgactaacccaaaccatcatcatccaacggccctccgccctcctctccacatcgtcatcacatcaaatccgtcgcaccagaccaaagcaccccaccccactccagtccacgctccaaaccctcacgcccccacctcaccgccgccggacggcgacccctccccggccgggatcggcggccaggcgagctcgggcgcccacggctagccccgatcttcggggatccacgcgcggctcggctgcagccggcgagcgcgaggtcgactgcgggggaggccgcggcctaggtgtacgggatcgggcggcggccgctgcgacggcgagctctctcggctgcgtgaccgccggcgtggtgcgggggactgtggtattctctttacctccaccggcctctcgcgacctagctgtttcttggtcaaagtcaaacctcctcctgattagctctgtatttagctgttcatagtgatgtcgatttccgcttttcccctgatttgctctgctgctagtatcggatcgaattcctgctgacggggatgctcctgttttgctcgttaggntgatccaggttgcatgttcctagtgctagttggttgttgaccccattggtgagagncttttttcatgttaagctgtggtttctggtcgatgaccaaaaaaaaaagaactcttgctgttgttatctttcggttccagcatttattttgtatagatccatggtgcatttaatccacttgcctctcatgccttgtatatatcttaaataagtttggctagcaagaatgatgtacttgatgcctcgatgagccacagtatcaatgtgtgtgttacgtgtgatttagctatagtctgatgtgctacaaatctaaacgttagttcttatgcattggtaaactctgtatgagtattcttgtgaatgttcacactattttctcttatgtttccatgtaggcatccaagagcttcattctcaagtttggatgttgaaggggttcaggaagtagagcacaccaggatgtctgtcaagtgttccattactattatcatccaacttctcttctgctatatgctttgtcagccatgctatggcacattaagtgacatccaatgcctaaagagactgaaggaatcagttgacccaaacaataaattggaatggacatttactaacactactgagggatctatatgcggattcaatggcgtggagtgctggcatcctaatgaaaacaagattctttctcttcatcttggcagcatgggtcttaagggccatttccctgatgggcttgagaattgtagtagcatgacttcactggatctctcgagcaacagcctttccggtccaatcccagctgacatctcaaaacagctgccattcattacaaaccttgatctatcttataatagtttctcaggggagattccagaatccctagctaattgtacttatctaaatattgtcaatttgcaaaataacaaattaactggagcaatcccagggcagcttggtattctatctcgcctaagccagtttaatgttgccaacaatcaactgtcagggccgataccttcatctttcggcaaattcgcgtcatccaattttgcaaatcaagacctctgtgggagacctctgagcaatgattgcactgccacttcaagcagccgtacaggggtcattattggttctgctgttggtggtgcagttataatgtttataatagttggtgttatcctgttcattttcttgcggaaaatgcctgccaagaagaaggaaaaggatttggaagagaataagtgggcaaagaatatcaagagtgcaaaaggagcgaaggtatacttctcattttggaattgtggtgtatttttgagcgtgcacatctatctatttgaattcaccttgttactcttcccaatttatgaaacttggttattttctggtggtggcagttattgtcttttccaatcacgcttttgttcttgggatttaagaattaataggtgcctgtacttgttcagatgttcaaaaattgtgggtattggttaactcgctaagcatactaacatattttcatgccacgaaataaccacttaacaaagattttattgttatacaatctctctttcgtaattgatggtatattaatgtccaaagcatgtttctattttcccaatctgttatcaagtggcaccctcttcccagttcccacccatctctaaagaaacttaattgtatattttatcagtacagcgcttagggatttatttttagcatcagacctgataatatttgattagtcagcacattcacctacagaaacagtattgtttgatggattttcaacctttttttttattcaggtatccatgtttgagaaatcagttgcaaagatgaagttaaatgatctgatgaaggcaacaggtgattttactaaggataatattattggatctggtcgatcaggaactatgtacaaagctacactcccagatggttcattccttgctatcaagaggctacaggatactcaacattccgagagtcaatttgcatctgagatgtcaacattgggaagtgtaaggcagcgcaacttacttcctcttttaggctattgtattgctaagaaagagaggctcttggtatacaagtatatgcccaagggttcactctatgatcagctacaccaacagactagtgagaaaaaggcattggagtggccattgaggctcaaaattgccattgggtctgctaaaggtttggcatggcttcaccacagttgcaatccccgcatccttcaccggaacattagttcgaagtgcatattactcgatgatgactatgaccctaaaatttctgattttgggttggcaaggcttatgaaccccatcgacacccacctgagcacatttgtcaacggtgaatttggagacttggggtatgtagctcctgagtatgcacgtaccctcgtggccactccaaaaggggatgtttatagctttggagttgtgttgcttgaacttgtcactggtgaagagcccacacaggtgaaaaatgccccggaaaacttcaaaggaagtttggtggattggataacatacctgtcaaacaatgctatccttcaggatgcagttgataagtccttgattggaaaggatcatgatgctgagctgcttcaattcatgaaggttgcatgctcgtgtgtgctttccgctccaaaggaaagaccgacaatgtttgaggtttaccagctaatgagagcta

SEQ ID NO: 48108 - DNA, 32541 bp, Oryza sativa
  unsure (1)..(32541): unsure at all n locations
gaatggaatcctgctcagtatattttttccagcaattgcactgctgagcaacactaggtaaagctgtaagctccaagatatgcatgccatttggtttgtaagatctgtatcaattagccatgttaaaactttttctgtacattcttgccttgctgtgtactatctctaggattggcatgtcctgctgttgtaagatggatcaactgtatcagcatccgaatttagttgtagtagctcttagatttagcaatgttgaacagtactactgggttgttgatcctccacatttttttcggtgcgttcctttgtcatttttgttagttaatgtggagtgagcccctacaataatctgatgagatgtgggattactggtttctttggtttcttggtgagtttcagctaccgagttggtagttatcacccttgtgaaaagacttttagtcttcatgtctttgtttgcatgaaaattaccacgctaatatcagcattacaatagctagggatctcgaaaggaagcaatctgttatgcatgcacagcagatcaagaatcaatttaagagtgagaactaagatctaagctcttcaatgctgacaagtgacaattgcaaaatccgcatcaagtaacaaatccaacagtttcagtttcatacccctgaactgtattatacggattacggagtgttgatattactgaagaaaatgttgccaaaaatagcacattattagtgtaggataatttgatgtcacctcttaaactgaaactacatgccagtacgcagtacgcagacattagctcaatcatcgcaatacgtatcagtattagagaattggttaaattcattgcaatatatgctgcagcctaggagaaacaaaaacttgtgaaaattttgaggaagagataaaacagacaatagaagaaatatacactacaaatattataatggcattgtcaatgaagttggagtattagttgccaagagaaaaaaacacacacataatcagccatggagtaccattttcctatcggtcggcagatgagacactgcctgcaaaatcaggaaaatagtactctccgttccatattcaggcatggaagaaatcaccgtgttgaaaaacactttccttaatttcactggcttgagatcaatcgtgtggatatcgactcttttattttcgttaaaatgaaaactacctcagaagcatgccgatttggatgacacgacctgaagagcctcatctgttaccctagtaagtcaaagccaaaaccaaaatttaaattttcaaacttaattttgaagttaattttaaaatacttttaacgcagcttgtttttcagcattggctttaaatcgctaagaacacacaaaatttttatctataaattaatttttattccctaataagggaaaacaaatatgagcaaccaataaggaccaaagaaatggatgacacgacatgatgtttggcaaggctccctaagaactcgagatttggcaaccaaatcacaagcacaaaactggcacaagctcgagtgctggacgtgcatttgccaaaaagaaaaaggaagaacatatgtaggtccaactggatgtctgcagataaattattccatcggtttactgctacagacgccgcgagaaatacaaagcttgaacacactgttttcaattcacaagcaccgcattacacgactataattggagaaaaaaaaaggtggtacatgtctcacgctattgcaggtgttatgctggaacaggaatacaagcttctctcttgtttcataagttaacaaatccatcacactgcatgatggctggcggcacaggggaacggaaaaaaaaaagaaaaactagtaagggcgatatcgccggccatgactcccttcaccacctcggctgccaccatccctccggtcaccgcgtcgcattggtggtggagggggaattccaccaggctgttgcctatggacattggaaacaaatcgtgaggaatggagatggtatgctaaaaaattgtctagggcagcagaaaaattgtcttacagaacatatccaagacgcccgtcagggagcaccattgggaccatcctcattccagctggtgctggtcctctaccatagatcataggctgccaaaaaaaaggagaaaagtccataaagacagactacaatgtcaatatggtagcctacaaatgtttagtttggtttacctggttgaatccaggaccaccaccaccataagcaccatatggatctcccatgtagccaccataaggaggaagtggaaaatttggagctcctgctggcttgaacgagtgatcaggtttcttgtcacccaaaggtttggccatggatacttccagcacttgccctgtgtttcagtcagagcaagattaactctagttctgatgaacaaaatttagaagtagccattcacatagtccttggcaatgccagtggttccttgatatccaaaactaacaagttactaatatacagtgtaacagtgctgactgcaaaggtcctgtaaaatcatcagagcaaatgatctaaacatatctgctttccacaggaagcaactacctaaacaaagaataccaagttccataaataatgataaatgataaacaaggagaaaacattaccattaaattcatatttttcgcttcctttaactgccttcagtgcacttgatctttcagcaaagtgaacaaaaccaaaatctctcttatgcccatccttagcaggtggcaaaacgacttttgtgacctctccatgcttttcaaaaatctccttaatcttctctttagaagcattttctggtaagttcttcacatatatagtcttcacctgtaaaggaaatgtcattcagacaaaaatttcctaggactcaacaaaaaaggtgatatgacatatcaaagctaataatctctgtgaatataaaaaattgacaagctaaaagtgcatcacataaggagaaaccatcgaccacataaacaaccttgcacaggcattgaacgagtagaccaacttcaagtcaacctaactactatgtcagattgttttaatgtacagacaacaagcaattactggttatacatcccctactgtaccatgtagaaataaaagtaagaatgcgactgggacctagaaatacatcagcaaaaagatggttattctggttcagccatggtaaccagtaattatggttcacaaaatcttttaatgtcacagattaatgtttccttattcatttgccagttccttctctagcaaacattatatggcataaaggaagcaaattcagtgcctcttttccaagtaaattaccctaatagattcgcaatattgacagtttttttcctaaggggttctacttcagtgttcatagctgtactccgtacattgaagcataaattatgctgagtttttcatttacagtgtgccaactgagtggcccgtgcactgcaatgggatcaaaacatttcaaagctaatactaaaatttaaggtagtactgcatgtttcatgtgtaagaaaatgtcatcaatatagtacctgcaagaaaaaaaaaacacaagaagcatagatgcatggacagacaaggttgcatatgaactcttggtgtatgaatgaaatttagggttcaggtatatatgtctttaagaaaagtgattgaatcatttttcttggaaactacagcgttaagttctagacaaaacaattggcaagccaaagaccactgctaaagaagcaatgcactgattattataatttcacacttctgactgctggtgctcaccacaccaaacatgaagagtccaacttcaagaaaaagtaggcctctttccattcagaccacctccccatttgctaaagaaagacccgacaacttcaacacaacaaattaagaagatactgaatgatctaaaatctgttagtcttgactcttggagtattttctcaagcaccttgtatgcatacataactgaatgctattatccaaggcaattccttgtttgaatcccctggcagcaacacaggaaccaaaagaggaaaaaaagtcagcaaatgtcaccatttcaatggacggctggacacgagtcnnnnnnnnnnnnnnnnnnnntgctttctcccacttgccgtgcagccgttcccctgcagcttccttgagctgccatgcacatggcccatgtcacattgccgccttttgttgtgctcgcgctagtgggctagcgtgtaggagggtggtagcggatgtaaaagagggtgagatggtagatctgtgggtaggtgatgccagttagcaacttgaggtcaagcggccaaggggaagatagcagtggggcgtggtgcatgcaacagttgggggcatggggaacatatggtcagtatcggcacggcttgggaggcgccaagcacgcaagcattccatccatagagcatcgatatcggtagggtgtcgacctgtactgaaggcgcaatgcgtgaggcaggataaatgtgtgcgagaggaagataatggattaatggcatacgtcaggtgtgggatatgatcacgagtggagatggggaaacagtttctgcgggacgtgggggcagatggtttggagatgatgtgctggtgcttgattttgttcatgatgacagaataaggccacagcacgacattgcacgccgtgcacaatgggaaggacatgtgatggttggggcggaagggcagagcaaactctgctttttatagtagtagagataagggtactaatggatggtagattcaccaataggttttcttttcatatagtaaagatacctgggcagctgcagaagaagaatctgatgaacccttaggttcagcccagctgacggtcaattggctaccatcaaccttaaagtttggtgctgacaatttctgcctggcatagtctgcacaagcgtggttataatactcaacaaagaggaacccacggttacggcttgggtcatgtaaatcctgcaggaccaagagaacatctctattagcaaacttgggacctttgtcgtacaaaatacaactgtgaaatcaaaagacacaccttgaacatctcaatgttgacaacacctggccccttcccttggattatctttctcagctcctcctcacccaaccccttgggtacattaccaacgaatagcctgtgctttgcctgcgacagtgagcaccgcagtgtcctcccctgcaccaaagaccaaaccatccaatgtaagcacatcatacgtgatagaacaaagcctcctctatggcgaccaacagagctacaaggtaataccttgtgttctttgtcatgcagttcctcgatagcacgctgagccgcttccttcgcggtgaagttgacgaatgcgaatcctttgttctccttggtctctttatccttcatcaacctcacctgtcatcgatccatccatggcgtcatatcaaagttgcattgtgttacaggccgggcaaacaatactgaaaaagaagatgctgatagcattcagatacctcatagatttcgccgaacgagtcgcagagctcacggaggtcctcctcggtggtgtcgcgggggagaccgccgatgaacacctcggagccctgaggcggcagagcgagcagctcatcccacttccgcttctcgtcatcgtcctcaggcccatcgccgccgccgccggcggccttgtccatctcatgcgctcctccttcgcccgccgcggtccccgcgtctccgtggccatcgccctcgacctcgggatcctcctcgtcgtcgtccggctcgtcggagtcctcgcggcggcggcggcggcggtacccgtcctcgtcgtcgtccatgacgtcgttgtcgtcgtccccctccaggtccacctgctcctccggctcctccgactgctgccggtcggacatccccaaaaccctaaccctagaaacgaaccagccaccaccacatcaccaaaaaaaaatcagaaatcccatcccaaaagaatcccgcaaaacccaaaaaaaactccagatctagaggagaagcttaggttaaggaaaaaagatagagaagaaagaggaggaagagctagagggaggaggtgcgctcaccggcggcgaggatgcggcggaagaagcagctggacggcggcggcgctgagcacgcgaggaggtgacgcacgagagagagagagagagagagagagagagaggccttctgctgatcacggcccaaatagcccaatcggctatcagtcaaaactttcacatgttctctaaaatatttttattagctacttcttcacttgttcccttatttatatctcatcaaatcatagccatctcctatttaattacactcttcatcgttattctccatgaaattataaagtgaaaggtaaccaaacaattccaaagtctaaagataaaacaattccaaagtctattgataaatttttgtacaggacatcgtgactttgtggttttagctttaggataccgcatgaaatcactttggtaaacacactccgtacatatggttatttgtcacgaacactccatccattaaaataatatttttgtgctaactagacacttttttacatggtttagaccaaattgcctctcctttctctttcgattcctctcttcctccttatccctttctttctctccctccttcatctcttctccgcggtgcgtgcgccctgctcggcggtcgcgcccggagtgcgtgtggtctgctcaacgatggcagtggcgctcggagcgtggatggcgacagcggcggcacccggtgcgcgtgcagcctgctcgacgatggcggcggcgctggaccttcccggcatggccaagaatgcggcgattgtggtcgccgtctagaatctccccggcgtagcgaggagcacagtggattacaccgtagaagcctcacagtagtggctggtagtggtggcctcctgcagggccggtggtgaaggcgtggctctcctccatgctgcttggcgaggagcttgagctgctctgggccaagctggtcgtggccaagaaggaggcggcggggaagaagcgggtggcggtggaggagctccgccggcgcgttgactatgggcgtgacgagttgcagcggctgcggtcagatgtcgccgcaccgaggaaggagaagcacgcgttggagcagcggtgtgctggcgtggtccgcggctgctgctgccgccgagcaagccgcgtgcgctccgggcgccgccgccgctgccaagcttgtctcccgctgtgaccagccgtctgccgcaacgcctcagcagccgacaccgctgtgctcttggccgcttccaggaacatttcgacaaccacagggctcaccggccagcaacacgtcgacaacctcaccggagaagagagaaaggagggagagagagaaaggaggagcaatttggtcatgtaaaaaagtgagcctcctcttatgcccgatccaggtggctctctcaacggtggcgtggttatcctggttggcaatggcagtgaggcggcggtccacggtggtggcactgttatgcttgatgtccgcgtggcagtcccagatggcgacgtggcggtccatggtggcggcgctatgcccggtgtcggcgcaacagtcgcagggagcagcggcgtggaggtcacgggaggtggcatggggtccgaaggcggcggcacggggtccgcaagtgacggcatgatggtcacaggaggcgaggaggccgcaagcggcgaatcgacgatcactgggggcggcgaggaggccacagttgccggtccctgaccgtcttcattgccgtctctcaggtgctgccgacaatcacccgagaagacccgatgacatgacctgggtgtgatggcacccagatcgtcacaccctcgcatcaccccagccccgccccatcgcgccctcccgacgcccattttgggaatctgcctatcctcctaggataggaggaagggcactgtggagaggagaaaggggagatggcggtgccggcatgctgctgcagatgaggggccagaaacaggtcaatagctctgttctattgctagctactccgtaccttgtttctttttttcttttacttactatatgacaaattgattaatctccctgttgggtttttattaattctgatggagggaagtacgttttgttttgattgataacttttgtgccatgtgatttgaaggattactttgctaaatttagggcctcatcctttggctttttccgtaataagccaaaacggcttattagagaataaaaatgaatttgtaggtaaaacgtttatatatgtgttctggtgacttaaaagccaatgctgaaaaagaaactacgttgaaaatatctcaaaatcaatgtcaaaaaaaaagtttgaaaattcaaattttagctttttctttggctgaataggccatccgataggagccgagcaattgcataaaattcaaaacggaggcttgcagtactatcactaattagagaacagaaacagatactacaatatagagtgagagttggtgtacccttgcaaaagtccgatgataatatggcattatgctcaatgaatcctttattcagggataagtaatttgggttggataatcaattctaagaagtgtgtctatgtactgaataccattttaacgagggagctgtgagggtttttagaattcaattctaatgaaatcaaagaaaatctcttgaagatatttctcaggttattgttgccttttgtgtccttcagagatggatattttgtactcattgtgtccttcagagatggaaatttgagtcaacacaaaataatgttgtctaagcaaatggttgtctaaaggtaagatcgtcttttcatacaacttaacggagagttgttaataacaagttgacggtgatggtatttttaggaagttacttttgtcgatgacatttataggattagggtgcttatccatgaatatatatatgttaaaaatattgtgcaaaataatgtgaagggagatgattggatgttgattcgtgaacggtattgctaaaaaaatgtcgcaagttttttgggcaaaagactttcaaatgtggctatagtatagttgtaatggaactacaatgcaattacggctatagtatagttgtaatggaactacaatgcaattacatcgtagttacaatagtgtagcactgtagctacattgtaatctctatataagttagatataaagttgtatatattattttaactagcatggtggcccccgcagattgcgcggctagcatcattatattttctctcgtatatgttttcttattatattattaaaatatattacaatgacaacataattttaaattttgcaataactttatgaaactactaatgtgtaataactactctagtctcctcttctaatattccttatcttttaattccgaatttcagctatttctaaattgtatttttatatggactctgctttttctttttctccgattaatgtgagaatttctaggtcataagagcgaacgtggagactccttttttttctaaattttagttagtgttaaattcctatatggactctatactctacttctaatattacttattttttaattccgaatttctatcttttttcttaattgtatttctatatggactctatactctacttctaatattccttatttttaattccgaatttctattatttcctaattgtatttctatactctacttctaatattccttattttttaattctgaatttcaaatatttctaaattgtatttctatatggactctagtcacctcttctaatattccttattttttaattctaaattttagctatttctaacttgtatttctatatggactatgttttttctttttctccgattaatgtgagaatttctaggtcatgagagcgaacgtggagactcctttttttctaaattttagttagtgttaaattcctatatggactctatactctacttctaatattacttattttttaattccgaatttctatcttttttcttaattgtatttctatatggaccctatactctacttataatattccttatttttaattccaagtttcagttattttctaattgtatttttatatggactctatactctacttctaatattccttatttttaattctgaatttcagttatttcctaattatatttctatatgaactctagtctcctcttctaatattccttattttttaattccgaatttcagctattcctaaattgtatttctatatggactctagtctcctcttctaatatttcttatttttaattccgaatttcagctatttttaaattgtatttctatatgaactatgctttttctttttctccgattaatgtgagaatttctagaccatgaaaatgaacgtggaggctcctctaatattccttattttttaattccgaatttcagctatttctaaattgtatttctatatgaactctgctttttctttttctccgattaatgtgagaatttctaggtcatgagcgcaaacgtggaggctcctttttgttacgaattttagttagttttaaattcctatatggactctatactctacttctaatattccttatttttaattctgaatttctattatttcctaattgtatttctacatggactctataatctacttctaatattccttattttttattccgaatttctattatttcctaattatatttctacatggattctatactctacttctaatattccttatttttaattccgaatttcagttatttcctaattgtatttctatatggactctatactctacttcttatattccttatttttaatttcgaatttcatttatttcctaattgtatttctatatggactctagtctcctcttctaatattccttattttttatttccaaatttcacctatttctaaattgtatttctatatggactctagtctcctcttctaatattccttattttttaattctgaatttcagctatttctaaattgtatttctatatggactctgccttttctttttctccgattaatgtgagaatttctaggccatgagaacaaacgtggaggctctttttttattcctttaacaatataatatatatacaagttatattatagttatagtggaattatattacaattatactatagttagatttgaaagtttttccaaaaaaaacttgcgacagtttttcagatagtcccgaattccatgaattggtaggtgatgttgcatacttgcatgagtttgttatctttgcatgttgagccttaggatttagtgaattttaactttatagtaagataggatgcgcctaatctaacctacatgtgtgtatgtgaaatgtaatcgtaaatcaatttttatgctgatcatctatttatcttattttgactcgtatgtaatttccgacataaccagtttcacaaataattaagtactcgttaggtaatataactggcaggaaagtaaagcatgaggcaacaagaataacattattcattgtttcataagcattgttttgctgtatcaccaacgccacatacagagttttgagagaattttataaacaatattacaaatgtagcaaaccaaaaataaaacatcagcttctgacttcaatactgtagcataccaaaatgacaggaatgtgaaccgttcaattcagaccatgttaaggaaatctgacttataagttttaccaagccgaaatctgagcttcaagacaggccattcacctatcagcttggtaagaacgggcaacagtgctgggacaaggcaaatcacaatggccaaccaccgaagacgagcgactaaaaccgtgtacaaactgtcgacgggggatactcgtagaccggatatagagggtattggggtacgctggtattaggatctacgtaatactacatcaagcaaatggaaaacaaagattatactggtttaggccccttgataggtagtagccctaatccagttgatatgagattatatgacggaaatcacagattacaaagggaatagtggaactcgatgataccgacgagatcgtagtcgaattggttcaactagatcactcggcgacttggctcctgtaggctctgactttgtaagctatggtggatgtgttggcggtgagattcgagatgccttaggtcctctcgggggtcccttttataccgctagtcagttggtctccaagtaggggagacatcggaccctacacgatatagtgacgacccagttctgtacaagtaggactccttccatctgtggactccgtgatgaatttccttaacgtatacagaaaacgtccgtatacgtgcagatataccatatctatacacgacgtatatccgagggtagagggtataccttacccgtaaccctgacagtagcccccgacttctgcttaaatgaactcatgtaactgatcgcgacttccgatgtcgaggttgttgtcgttttcgcctgatcgatcttggtatgagaaccgtggagacaaagagtaatcgacaacaccatgcgaagttcaacggtcatgagtgaatttaaattgaagtccgaaaaactgccgcgcgtaacggacccagaaatttccagcggtcatctctcctttccttggaattcgcaccatcggtagtgcgtctatttaaggaagttttggggatccattttgaagtccgcttgttgcgaaaaactctccagcctccaagcgttcctcttcttctccgctcccgcaaaaaccctagcttgctcatctcggtcctttctccggcgacctccggcggtaatggatctcgacaagtctacttctaccagtgcgtcgttgaagaagctgcaggaagacggcgcccttctcggtcacgggaccatagagagaagcaggaggtattgaacccagcatgtcctgggccgcatggtcgcggtcgaggactatattctctgtggttttcttcctccgccttctgagtttcttcttttggtcttgaatttctacggtctttctttgctccatttgaaccccaattccatcgccttcatcagtatcttttcgcatctttgtgaggcctacattggggtagagccgtttcttgacctctttcgtttctactacgaattgcgttggatggaatccaacagggtatctggatgcgttggtttctgacttcgggatggcctgaagtcgcgctatatccccttccagtgcccctcttctcatagtaaatggcgggcgaggtggttctatcttcagatagaaaacttggatccggtcttcgttgttcctgaggaacagccagacaagatttcgtcttggaccgccaaatccgccttaaccccttcccttcagtccttcatcgatatcatcaatgacctccgaatacgagggttgtcagggtatgaagtcactgccgacttcattggtaggcggatccagctgctccaggctcgagcccacccagcctttgactattctgggccggaggacgcgacccaggtttctcctcggggtatttttcttgtattttggattctattcctgacttatcgaattctggttctcgatctacaggtttgaaccgcgaaaccgtggagcgccgtgtcagccaagtgatgatcagcggcccgacaacgacgagcaacgtccctgtccccctttgcgagaaggggacagccgagcgtgaagccgcaatcaacgtgagtgtagtcgacgacccctttatatttttcttcccgaatcgcatagtgacttcatatggtgcaggctctccctctgactgacgtcatcgggccactcgtggaccaccaggcgacgacttcgttgaaagagggcgtcgcccaggaggcgtccaacgttgctgctgctgctacgaccagtggcggcaatgttccgaagagggggagtaagttttcctccgtgctcggtaaccgtcgtaaggcacccaccccatcggtaagcccctttggtcattcatcgcgtagtcgaaagatattgtcctcacatcgtactcattttacttaggcctcggatgcgtctcctccacttccgtgacggcagaggctggtgacacttggcgagaagtaagtagacgaacttgaggtcttgttaatccatcgaactttggtagcctgtcttgatggcaaactgcggcaatcattcatagggctgtgcgggcgaaggcggcgcaggacgggtctggaggaaactccagcacgtcccttgcagcgacttcgacagatgtcgtggtcgcaccgaggggccgtgaggcgacgcccagtggtcctgccggtggccttgtgcctgctaggggcccgcacgccgacgtcctcacctagggggagctctagatcgagatggagcgtatcctccaggccggtgctcgtggcatagggcacaagatcgaagaggcgaaggcggcggcggcgtcgtcggctaatgaacgcaccgacaagttggcgcatgacctggcggaggtccgcgaggacctccagaagatgaaggagctggtggctggcaacgagcggcagcggcaggggctcgagcaccgcatgttggagctcgagaacaatttgtcagagatccgtggctcgctacgggttacctacaccagcttgcatcagctagccggggagtgcggcgtcacgaccaccatcccggcgaatcccgatgagttctcgctgacgacttcactcgcggaaatggccacggtgatggaggagatcccctccaagcatgcggccaggatcagagaggaaacgtccaacgggatctacactggggcatgccacgtccttgcgtgcgtaaggttggcgcaccctgaactcgacctccagaggatcttggatcaggggacggctaacgatgcgcgtaagggcgtgatggaagaagtcggtgatttgggggagtctgttctccccctttttgaagagtaggacttcagtttccctgtactccttaattagttatgctttgtaaaacttttgttggctccaactgcctttgtgtgtgcagtcatcaccttagttttctttagcattttgatcccgagtactttgttgtttgtagagatgtcgatgttgaggatgtccagcagcgcgggcagcctgagttgccagtgatcgttccagcacttgcgttcgagccgtatgtgccgtaggacgacgtagatcagaacttgtccgtggaaacgggcatggcgacgacttccttaggttggtcctttttgttttcatctcctttgatcttccgtctggattgacttaatttgctgtgttctcgagagagaaaggcagcttgacttagtcgtttccatgctgagcagacctcgagagtgcgcttgccgaccgagatcgtcgcatctaatactggaggacgaagtttgaggtggcagaactcgagaggactatgttggaagtgaaaaaggactgggcactttggttgtaatctgtacctgaaaataggctttattgaagctgtaagatgtcttacaggtatggatactattgatttatacatagaatttacgtaattgatcaatgttccaagaatttgctaactcgcgaccatcgccgtctgcaatcttgaatgcgcctggccgcaagacttgcgtggtcgtgtacggtccttcccatttgggtgagagcttgtttcgccctgcttggctttgaacccatcggaggacgtagtcgccgatcgaaagcgtgcgcgctcagatgcgcttctcgtggtaacggcgaagggcttgttggtagctggctgctctgacggtaactcgttctcgatgttcctcaagtagattcacatcgtcgtttcgcttctccttctgatcctcatcgaagtacttctgtactcgtgtactatgatgttgtagcttggtggggagcatggcctctgagccatacacgaggaagaagggtgtctcctggttagacgttgtcggtgtggtacgcacgacccatagcactaatgggagttcttcgacccacttcttgtcatgtgacatgagcctgtcgtagacacgggtcttgattccttgtagtactatgccgtttgctctctcgacctgtccattgctctgagggtgagaaaccgaagcgaagcagatcttgactcccagcctgatgcagtaatcctggaagtcggcactgatgaactaggagtcgttgtccgttatgatgcggtgaggcaatccatatctgcagaacatgtcggccttgatttcccccgtgggtgtcgcttcaattcacttagtgaatttgtcgatcgccacgaataggaacctgtagccgccctgtcctcgtgggaatggtccgagtatgtcgagcccccagcacaagaacggccaagtaagagggatagtttggagcgcttgcgctggtagctttgtgtgtttactgtgaaattgataggcttcacaccgctgaaccatgtcacaagcgtctttgagggcggttggccagaaaaacccttgtcgaaaagcttttccaaccaatgtacgaccggcggcgtgtgacccgcagatcccttcatgtatgtcgaggaggagatgtccgccgtcgtcgaacgagacgcatttgagaagtatcctatttggcgccttcttgtatagatcgttgccgatcatacagtagatttttgcttgacatgttattttctcggcttctgcatcatcctcgggcaactcttcgctgcttatgaatttaatgagtggggtccgccagtcatctgtggtctcgatatcggcaacggcatgctctgcctctgtagcccccgagctgatgtcgggggcgactgggctatcttcgccgtttgcatctttcactaatggctttgtcaggacgtccagaaaggtgccgggttcgagtggctctcgtctggacgcacaccgtgctagatcgtccggctcgatgttgaccttgcggtatacgtgtcggacctcgatcccatcgaatcttttttctagcttcctgacttctgcgagatacttggataactcgggattagagcacttgtagtctttgtgcacctggtttgcgactagttcggaatctccttttacgatcagtcgcttgactccaagtgcggctgctgctcttatcccagcgagtagtccttcgtattcggcaatgttgttggttgccctgaagttgaggtggatcgcatggttgaactgatctctcgaaggtgatgtcaagatgaatcctgcccctgctccctggctgttgagtgcgctgtcgaacgccattgtccatgtttcgttattggtttgactgtttgacctattttcaggtatagtccaatcggctacgatgtcggcgaggacctgggacttgatggctgttcgtggcacaaagtggacgtcaaactggcttagctcaactacccatttcgcaatgcggccgacaacatctttgtttctcacgacttcaccgagagggaaggaggaaacaactgtgaccctgtgggcctagaagtagtggcgtagctttcttgacgtcatgattactgcatagagcagtttttggatctgtgggtatcttgtctttgtgtcgtggagagcttcgctgatgtagtagactggtctttgcaccttctctctctcgacaacaatgacagtgttaacggagtatggcgtggcggcgatatagagaaataattcttcattaggttggggagcaacaagtatagggggatttgacaggtagcgcttgagtgcgatgaatgcctcttcggcttcctgtgtccgtacaaatttgccttgtttcttgagcagagcgaagaagggttgtcctcattctcccatcctagcgacgaacctgcatagtgccgccatgcacctagttagcttctgtacttccttgagtcttgtgggcgacttcatgttctcgattgcctggatcttctcggggtttgcttctattcctctgccagagacgagaaatccgagcagcttgcccgatggtactccgaacgtgcacttctctggattgagcatgaggcgatatcgtcggaggttgtcgaacgtttcccgcagatcgtcaatcaatgagtcgcttgtcttggtcttgacaacaatgtcatcgacgtaggcctcgacattgttcccaagctgattgctaagtgccccctggaccgtgcgctggaaagtgtttcctgcggttatcagtccaaacggcatcttaacgtagtagaataccccgaacggcgtgatgaatgctgtcttctcctcgtcctctttcgccatgctgatttggtggtagccggagtaagcgtcgagaaagctcaacaactcacaaccggctgttgagtccaccagttggtctattcgaggaagtgggaagtgatccttgggacacgccttgttgaggtcagtaaaatctacacacattctccatttcccgttggccttccgcaccatgactggattggctagccactctggatggagtacctctctgatgaaaccagctttgagaagcttgtcgagttcttctcgtatggcttgttttcgatctggtgcaaatctccgcagtttttgctttactggcttggcgtcgggttgcaccatgagtttgtgctcaatcacctccctggggacccccggcatgtcggacagctgccaagcgaacatgtcagcattgtcgcggatgaaggtgatgagtgcgagttcctatttctcgcctagtgatgccccgatcttgacggtcttgtcggggttggcactggagagtggaacgatcttgattgcgccgtctggtttcggcgtcttgtttgttttgctcactttcttgggtggctcagctgtggcgggtgggctgggcgtgtgctcgaccatgtcgaggctccgcttgtcgcattgcactgccagcttagcgttcccttgaatagtgattgttccctttagtccgggcatcttgagcacttgatacgcgtagtgagatgcggccatgaacttcgcaagtgcagttcttccaatgatggcattgtatgctgtatcaaattcagcgacatcaaaggtgatctgctccgtacggaagttatttgcttggccaaaagtcacaggcaacgtaatcttgcctaatggtttggacgatgactgaggagtgattccatggaagggttgatcggtgggtgtcaactcgcttcgtgggatccccatcgcgtccaaggtgctggcgaagagaaggttgattgagctgccgccgttgatgagaactcgcgcgaccttgatatttcgaatagtgggttcgaccacgatcggatatcgtcctgggatgacagcagtcttggggtggtcttcttctgagaatttgatcttctgttcggaccacttcattttgggcgcggccccctgccacgtcgaacagacttcacgttccactttcttgtactctcgctttgaggagtatgccgtggaacctccgaagatgtgcgagacatggagatcagagtctaggtatgctgagtccgattcctgagtagctacctcagcgtccttctcgactacatgtacttgcttgcctttttccaatgccatgtgctttgcgagcgactttttgaagacgaggcaatcctccagagtgtgtctgttcgacttgtgtatagggcaccatattttcttcatgtcgctgctttgtgggactgggcgcttgggagggtccgcgtattttgtcgcgagaacttccgcttgagctttccttttcccactcttgcaatttttcttcttgcttgattcaggtgcgtccttggctggttccttctctcccccggtcttcggcttgtctttcttgcgtctcagtgcgtcatccgcgtgagcgcatcgatcgaaaatcttgaatagtcttcgagtagtcgtgatgcgcctcgttgccaactcctaggtagtatagcgatctctgacaccggacttgaaagcgcggattacagaagcatcggtgatttgggggattgtgtttctgcactcattaaagcgccgaacatagtccctcaaggatttacccggggtctgtgtcaatgcgtgtaggtcgtcttcgatcgcgtggcacttgtaagttccttggaagttagcgacgaactgctgccacagatttgcccacgaagaaatcgagtagggcgggagatgcatcagccaagaacgcacagagcctttcaatgtagttggcaaataattcgccaacgcgttgtcatctgctccggcagcgtagagtaccgtggagtagacctgaaggaattcttctgggtcggtactcccatcgtacttctctatcgctcctggtcggaatctctcaggccatcggacatcgggcaacgaacgattgaaagctctacacccggcgatgggggcggtgggttttcggcgatcgtacgtccttcgtggatgtctatctgacgatgaggatgaagaggatgatgacgatgacgacgggtcacttggttccggtgtacgattacgaggacgccgtccaggttctcgaggatcctgtcgtcgccccccgttgttgtctcggcgccgatctccatcgtcttcatcgttttggcggcgtcctcgaccagtatcgcctggcatccgccgttcgcgatcatcgtgatcacggcgtgtggcggttatcacggtctcggtcttcgctcgagcggcctcctcgttctttgttttcgcgatgtcgtgaagagacgcgatgtcgggaacggttcccgttgtctcgtgtgcgtcgtgcttcttggcggccattcagatgatcacggagatcgtcggtccgtgaggtggaggggtggcttgacgaggcgacccccgctgctcagggagttcgccattagcaccgccagctggcggctgttccgggtgcgctgcagcagcggcctcctcgaacgtattgctgaggttggtcactgattcccgtagccgttctgtccactgtgcgagatcatcattcagaacgggatcgtaaggggtttccctcagtattgcgttgataaccccgatgtgctgggctggtgtaaccacttgattttccgctttcacattagcgcgtgctgacgtgctggtcccatcgatagcaaatacatcgcgcggtgtactcgttgatgatgagccatagtctttgagaaagtgtaggactgatggctcgtggggatcgatgtcgattaccccaacgaatcgatccgagatcagcgtcgctccttgttccttgtctgtatccctaagagagattcgcgactgctggaccttaggaggcggtgtcttcatggcgctgagaaagaccttgcagcttgagaggtcgtgattctttgtcttgtgaataggacaatagacctcatgagttggagaagtacgctgaattccacgctccttgcaggcacgaatttcagcttgcacgttgagaaaaacccagcaggcttgcaaggtatgtttcctggttttgtggataggacaccaggaccttgtcatctcggaagttgtccttgtctgctcgtgattcttgtcggaaggacaaggtttggccgcactaagatccttctcgggctcggatgtcatcgacgttccgttctccgcttcgacgggtggattcttcgacatggagtcgtccagggttgtagccacggcgttctcgcttctggtcattcatggaccagtcgagatcgacaccgtggtgtaaacgggaagacaagttcgccgacttgagtccacaccagcattgttgaagcaggaactccttggttgaggccggtgttgacgctgttgtcgacgaagcctgatgatatagtagtagaaccttgagcaccaagagcccctacctggcgcgccactgtcgacgggggatacccgtagaccggatatagagggtattggggtacgctggtacgaggatctacgtaatacgatatcaagcaaacggaaaacagagattatactggttcaggccccttgataggtaatagccctaatccagttgatatgggattatatgacggaaatcccagattacaaagggaatagtggaactcgatgataccgacgagatcgtagtcgaattggttcaactggatcactcggcgacttggctcctataggctccgacttcgtaagctgtggtggatgtgttggcggtgagattcgatgcttaggtcctctcgggggtcccttttatacgctggtcagttggtctccaagtaggactcggagatatcggaccctacacgatacagtgacgacccagttctgtacgagtaggactccttccatctgtggactccgtgatgaatttccttaacgtatacagaaaacgtccgtatacgcgcagatataccatatctatacacgacgtatatctgagggtagagggtataccttacccgtaaccctgacacaaactagttgcaaatgttctgatagttgccatgtatgaaaaccacatgagcttcttagtaataaacctgtaatgaagcaaaaactggagatcctcccacttggctatgatgcatatgaatgcaacagcaaatgaggaacatattgctaaggtgtctgagatcaagaaggcctgaaatgcaacctttttttgccataacaggaagtccctcacttccagcatcagcactcgacgcaggtcattaatgaaggcagctactccatccacgtcgtcgtcgtagcgatttggtgaatggcggtgacctcgtgttgcacggcgctggttgactgtgtcgcgaaggtcgacgggacactggtgaggtggagagcgaggccgttcaactcggcgctccctgtgacgttcgggaggcgagtgaacagatcgttcgtcgtgacccctgctcctgcgactagatcctgtgccggtgatgctgaggcttggctgatgataatcatgagatcggaagtgagggactcggctaccagtcggggtgcgggtgcttgcggagttggctggaaccgagacagcgatcatggtcttcgtttggttcaagatgttgacaacatgatcagcttggttgagtgcgtcttccttgaggagggtgttgaggagagtgattgctgcaaccgcgttctgctggggggtgcgaaagaccgctgttccatcgacgtcttgttgcccaatgagttctctcgctcggcgcccagattccaaggcgcgttgccgtcgatcttcagcctcctttgcaatccgttcgcgatcttgctgctcacgctgtagtcgttctcgctcctgtcgctgtcgctcttcctccagtcggcgacgttcagcttcttgccgtgcgcgatcttggtctgcttctcgggcttggcgctgttcctccatttcgttgtcagccatgaatacgccgaagaagaggggcgtgtagttatcctcatagctgtcgtcgaagttgtcgaggtcaccgtggtcgtagtggtagccgaaatcgtcgtagtcgaggatctcggttggtcgagaactgacgccgggggagctaaggtaaccatccaactcttccgtcgagactgtcccaagaggttggagtataacgccaacctctctggatctagattggatcggggccgaagccggagctcgcctagatcttcgagtgggagatgtcttggcagtgaagacagcggccaaattatcaggaagtttcattaggattgagggataggacccgtcgtcttgatctggtcgcggaagagtagattggatctcgcccgagtggtttgaagccgactcgggagagatgatcttggagtaggcctcggccgagttcggaataccgaagggcatggggacctggtctctccccgactggtttgaatccgagtcaaggagagagatcttgctgaagtcgttggtgatgaagttgaggctgccgaaccgaaacgcttgcccgggagggaaggcgaagtcgtcgatgccagaaacgaaacccatcgcacttagtcggcgagaacttgacgctacccctacctagcgcgccaactgtcgaaacaagatttcggcaataataaaagggagtggctatcaagctaggaaagtggatgggtttggagacaagaaatttttatacaggttcaggccttcttattcaagaagtaataccctactcctgtccggagatgattccgccgagtgtgttattgattgtatgattgggagaaaaaagaatcgtcccgagaggaacccggacccctccttatattggggaagggatctgtaatataaagtacagtccatatcctaacgggatatgggattacagataaaatacaatcgtaaccgactaggatcccaggtattttcttaacatacaagtttagaatctaacccgagtcctcatagagatattctatctatatttggtaccgtatatccagctggaatataaccgccatgtagatatggggtaaccataatctccacagcactatatcctccaggcaaggtgaaagctgctgcaaatgtaattgttgctataaggatcgctactaatgaagtgttgcttgtgtatctctcagttagtgccttgacatccttccttgatttattagttactttttccttcgcttccatatgaacattatgcataaaggatgcatcttggggatcagcttccaacataagcaaggacacttcattctgcatggaaatccaaataaagtcataaataatggaactaggatcaatatagtagcagcggcagcaacaacagtagcaacaattaaaataataaaatccccaaaataatatgaatatagtattgttacattaattatagttgtcagcaataaattataaaatttgaaaacaaaaccaattctatgatattaaggatgcatgctagtgttgaataataattgtatagggaaacaattcaaaggtccaaaaaatcttttgcacggtcatgggatagtgccaatgtaataacatgaaaatgtctaatgataaaaaccaataagattttgaacttcttaaaacttttgcatcatgcatgttagatgttctggttgtcattacttataaaccctaaggcagtaaggccctgtttggatcatgggattttcaaatgaactgtacaagattcttttagaatggttcccatgcattcctccagtttcataggaaataaaacatccaaccaaagctaaaagaacaattccttcactcattcttcctcactctctatatctatttgccgtgtgttttcctgttatcggaatcccttatgtttcactgttcgtgtgttttgaattcattattttccactttacgtactcaaccctatttcatctttgtcggtttatagtagaggcccatcgaagatgactcataagtgacaggttctagttaactcctctactgggtcaaaactatcgattatgaggtttaatattggctcgacaaacataatagttatcggtgacggcgaccagctgataaagatgacttttcacatcacagaccattagtttgtgacggagcctctcgccgatacagataagcccccccccccccccccccgcgcgacatagatgaggtgttcatatttatatttttttcctaacgggccctgaattgacaaacaggaaaaataataaacaatggtcacaaatacacaactaaattaatatcagattagcccctcaaagaaacaattttgtatctcccatcatctaaaccccaattgtcaaaattgtcataaaaagtgcactactgttcgctattttgtattttgttgggaagtctgtctgagggtgtgtaaaatgactcaaatgctgttcttctattcctgtgccttctcattctcatcctcgcaatttctctctcttccctgtggacgaactcgatatagctaggagtagctcgatatagaatactaacaatatgatgacatgggaattttgttcatgatctactagtataagctggctttcctaagtctaaaccaagtaatttagttgatgccgtcatcgacgaagtttttaaagttgaattgcacttgcacgtattcaagaagatgtacttgtgagatcagaggggaatgaaacaagcatacatacccagtttaacgtcttagcgcgacccgtgactttccatgattgccaacttggtggattactgtcacgccgaaatttagcccaaatttccagactattttgtgtattaaatccctatccaggaccagccagggtacacaaaacgacaagtaataaacagttacaaacgtaaataaagcgtaaaatacttacagaagaggcacttagtcctcacaccgaaacaaaagcagcagcagcggaaaaggcgatcccagcggggcttcagctccactccacaggcaaaactcaactggggtctgagccttggtcttttaacttcgtcttcagctcagaagcactacacttttgaaaaaggggaacaatagcaaggctgagtacaaccaccatactcagcatgccacaccaatgatgcagacgtgcaaggggagacaatgatggtttgtggctatttgcataaaggtggttgtaaagcattttattaagcaaaatagtaaaacggttgagtaattaaggtaatattaaatctccactgatcaacgctacaccacgttgaacaggcccaaccatcccacttgaaccaactagtgcattgagtcgatttattaagggtcagactaatcacggtgaatctggttgatcgcccataaccgcgggtacggctattcgaatagttttactctggccagaggtgaacaactgtacccacaagatacaatccaccggcatgtcaccttgcctgcgtagacacgtcaccatgtcgagtgattgtgacaagaccctccgcataaccctcccataaccatccacacaacggtaaggtttcacccccacccctaccccagaggtgggcagtcccctcgtgcgccgcggtgaatccggcagctggacaaccggacaccccagctgacccaactccatcacgcccaccctcgccaccggtgtctaggaaagggtcgagctatacttcagatcaagcagttacccactcccgcttgtggcaagcgctgtaagtcttccagggtttcctatgaaccggtccttaattgccatggatgcgactcgcaaaaccatgcacccacagcccatcattgagtcgcgttttagttggataattacgatcatgaaacattgctagatgtctcgagcacgcagctcatcaatatactagaatgtctaatactgcaatcatcgactgagctagtagtaattaagcatggctaagcatatagttctagctaggttaacataagtaacacaagctagtcgatttatgacccaaggttgacaaagaacagatatcaagtaaacatggcagaagcgaaaagaaagaaaaaccctgatcccatgtaattagcaaaacatacatatttatttgcaaacggtaaaacatatgtaaattgggatcaacatgctcaaggggaatgtgtgacttgcattgcttcttcaaacaatcttctgaactgaactcttatccttgcgaccgcgaacatccgaaacaatggattctacacgctagcacgcaaaacgacgaaaaactctaataaacaccaagaaaaaagtacataaaaagtaaacaaacatgtggatctcaactttagatgaatcttacaacttgaatggcccaattcggagttcgtatgaattagatatgaattttagaagttttgagccatttaaacggatttctagaattattaatgatttattgcgcaattaatatttgtttttacaaaggaaatgggacatcgctgacgtcagcagggggcggccggtgctaacacgtgggccctacgcgtcagcggcacaagggtaggggcgcacggtggacacggtccaccgcggcctcgggcgcacgtccaccacatggacggcccagatggaggcccagccgatccgacggcccagaccgaccgtggctaggatcaaggggaggcggccagccggcggtggcgcggcacggcgcgtggcggcggcgacccagccggacggccaccggtggcggcagcgcaacgcggcggccggcgaaggagggaaaaagagaggggagggaggcagttctcaccgttgggcacggcgacggagggaggcggccggcggagcgcgggatggatgggaggcggcggcgttcctcggggaggcgacgcggacggcgctccggcgacgaccagcgaaggcggagaagcggccgaggcagtcctcccgcgaggccgaaggaggcgacagagcgacaccaggtggtccggaatggcgcccaatggcagccgatggtgatagaggtggcggcggcttgagttgacagtgaaggtggagtttcggtgaggggttggggaaatggagccgcggttgggcttgccctcacggtggtggagctaacagctgcggcggtgtggtgtgaggtggccgggaacggcggcaatggtggtggtggctcgggtgcacggtggggtggcggttctagcggcgaaatggaggagcggaggggatgccggggtacggtacgacgctgcgaagccgccagtggcagttgcgtggagcggcggcggcgggagcggctgtggcggccggctggagtgtcgccggcgagcggcggagagagggagcacggtggggaggtgattagggggtgtggcgagctcggggtggagggaaaatgggagagggagccccggggatgctttttatagccttggaatggcgggatcgagcccgggagaggcggaatcggccggtgtcgtgggacgccgacgtgggctcgtggcggcggttcggcaccgatcttcgaggggcgagtgggggtttcggttgaggaggtggagaggaaccggtccacacggttagatgcgagctcgggaatgggagggcgccggatttggcggtggagtgggcggcggttggctggaggtgggagatgaccccgacaggtgggacccacctgtcggcgggtcggggggaggagggaggacgagacagttgggggaggcaaagtagacttcgggagagagagccgagcgggccgagggaagggaggccggcctgtgaaggaggagggggaggaatttgggccgagcccgaaagggaggaaggggaaagaaggagaattaaatttgttttctttttatttaaatgagtttaatgaactttgtgactttaaaattacttcttgagctctgaaaattcgtgggaaatttcagagagtacattaggggcgcaaagaatattataaaatattctcggccataattttcaaaggaaatttttaattccctcaataattcacttgattaaattgatttaacttttatttaatttctagaaaatgtattattaaatgatttttaatcccgaacgaaaattggggcgttacaattaccatggttgtcaagcattgtgacatcagtgcctctatgagacaacaaagcagccaccatttttgggttacccttatggacagcaacacgtagagcagttttcccatggctatctcgcatgccagtgagtttccgtagttgtggtgtgctcaggataaacttaacatactctacttggtctgcggatacagctccatgaagacatgtccaaccagtctttgtgcaatagggagcatctggacaatggataagaatctcttgagcaatgccaatatgccctcgaattccggcagaaacaagaagaggatctagtggcggtgttattgtctgatacgatgtaccctagagaagaatcatgttccagcaatactcgtaacacggaccatgccccagagggcggcatagtgaataggagcacgcatatattcgttttgttgtttggccagccaagggcggttctccataacctttttagcagcgtctgaaagtatgtctagggatgcaagtggggcgggcttttttttcggcccgcagtcccgccccacaaaaaagcccgcaaatttgcgggctggccatcccacgtggaccttgcaaaattgtttggcccatcccgcacagcccgttgggcgccacggcattagggcacagactgggagacgcgagacgcagccgcagcggcgcagccgagacgggagacgggagatggcggcggcgagacggcgccacagcggctgctactctcgtcttcctcgtcgcccatccatccaaatccagcagccgacgccctccagtctcctgatccagcgaaatagtgaatccagtgcatttcatacttcagttcttgatagttcttgatagatccatccaatccaaatcctgcagcttgcgatgctgcactgccgcctccagatctctacacactaattaaggtacaagattaaactaacctttcatgtgtttcttgtgtatttatgtgaatcaacgaattgcttctccaagaatagtagcaggttgtctcactcactctatttgtttttgtatatgttaaactttgagtgtgattggtgatctagccattgttatactggacatcagcgtctgcaaatgatctattgcatcttttttttatctaattaatgtggtgcatgattagctaccactggtttgacataacaagattgataggtgctcattcagagaagtttccttcagactaatttcttaattattagcttcagatttttttttcttgttctatagtatataaagtacagttacatgtagtagtaatataaagctactgttgcagtatctggtacgttttacccaacttcaacatgctattttcatgaactttggaagataaagatggttttggacaaggaggctacaaatgaagatgtaccattgcatctattgtcaaggaaatgaaagaaaaatttaagaagtactgggacgctcaatacttgcaaatatgtttcccggttatttttgatccaaggtataagtacaaattcattgagtttcgtttgaagtctgcatttggagctgctgcaactccttaccttaaggaaatcaagagtaatatgcagaaattgtttgatgaatattctgccaagtatgggggctcaaacaacatcaattctcagcccgaaacaagtgttgagcagaatgttgatgcaagtaatcaattcactgattggagacagtttctacatgacaaaagcaggagcaaagtaaagagtgagcttagtcgatatcttgctgatatgcctcaggaaggtgatttccaagatgggcatgattttgatatcttgaactggtggatggtaacaaaacaaagtaccctgtgatttcacgaatggcacgtgatgttttggctattccagcaacatcagtggcatcagaggcagcattttcaactagagaaaggatcattagtgactatagaagtagactttcgagcagtactgtagaggcattgatttgccttcaagattggatgagggcagaaggtttgggtgatttctttgcacgtgatcttgctgagagtgatgaccaaaatgtgcaacattcaggtatttaaattgagattcgtttgaattaacttggctattctatatttttgtatagttgtatactacaccactaacatcattgtttcttttttattaacatctaacagtccagcatgtactcttttttattaactccattgtttcttcctatacaggtgaaaatgcctatacacctctagtaacatgtagtaccagcacaacaaccagcagcaggttatatatctcactatcctcgaataactgcttgttattgtcaattatgtcctttaattcatattttggatgcattcttaattgatgaaacttagtacatatttactccattctacaatatggaataacgttgtgatcagtcggttgatgaattcatttctaattttcgattagtagtttctccactctaactttattaaatttaatgtgttgaaggtaatatagaaaaagaccggaagagctcatagagttggaagcagttgtttgtcactttgtcaattgggacagttggtttatcatgaagagaaaatgcatcatcatcactctaactttagtcatgatgttgaaggaaaagaatggtgttcttattcagtactatacttgttatgtcattgaaaaagaatactttcacatgaaaataatacagttttcatgtgctaaatttgggatatggagtagttatgtgcttgtgtgatcgatgaacctaattaaacagagatgtgcacattgtgggctgtccagcggtgcccgttgggctgagcaatcccgccaagccatgcggggcgggctgccgtttgcccgcacatgcagtttgcggctggtgtggggcggggcgggacggcccacaacccatcccacttgcaatcctaagtatgtccaaggaaacaatatggttgttacaattacagagtgtctgtgttgtactgtgtaattctaaaaaaaaagaaattaacaacgagaaatacctcgacctacaaaatctcacctgcatttccacttctcacgg

SEQ ID NO: 48109 - DNA, 2248 bp, Oryza sativa
aaggcagttgctcccgttcttagttgttcgaagcagcacgtctgcttcacgggcagccatgtcctccttcaacgttgtggaatcaccagatttggctgcttccaggagttgtctgtcgatatagatggcccgcccggcacggcctggcccaggcacggcccaccagccatcgggccggcacggcccgatcggcacttcgtgccgggccgtgccggcccatgggctgcgcctcccgcccaggaacgaccaccagccgtcgggccgtgccgggccggcccgaaggcgcgggtggcccatcgtgcctttttttatataagtctatttttcatctctcctctttgggctgtggcatatatatagcgaaaataagtctatttttcgtccctcttctttgggctgtggcatatatatagtgaagataagtctatattctgtccctcctctttgggttgacatatatatatatagctaaaataagtctattttacgtccctattctttcgaccatggcatataatatgtctatttttactccctattgtttatgtgtcgggcctagcctgcggcccatcgtgccgtgccgggccagcccaacgtaccggtggagaggcccaggcacggcccagtggttgagccaggccggcacgggcctgacccctgacgggccgtgccgtgcttgggccggaccaaaacgccgtgctgtgtgccgggccatcgggcctcgggcctcttggccatctatatctgtcgatcgtttctactacattctctgataggttagtgtcggtgcctgatgtttcctccatggaattttacctccaattttagaatattgtgtgcacagattatctgttttccgttcaatattttggacaaagtacggagtactccaactggatgacttaacactctggaagccttctctgttaattaggcaaaaaaaacatattggatcatgtcaagaaattaataggactataatgttactagtttttagcgaaaataaaacccgggcctaacgtgttgatcgacatgcccagctgggctaaactactttgtcagagaagaagagaaataacgcgagtgttcgacagaaaatgattgtgtacgtattttgcaacaaaagaaagaagaaaatatcgtgtaatagttaaattacaacattctgggacatccttttgaaatatgtcaactgtcagcgtatttttgcaaggatatatatatatatgtgttctttggtgtggattcgaaactaattattcctcgtacatgaaaaatggaacgataattaacacacaattaattaagtattaaaaaatattaatatgatttttaaaagcatttttttcaaaaaaattcacaaaacattcatttaccagtctggaaagtatgtgtgtggaaaataaggaatgggaggttggtaagctcaagaaatgaaaacgacctagaagcattcatattaatcatatttatattctgttttaagttcaatatgttcaaggccgcagctctaataaaaagcactaaatctctagaaaagattttacccgttacataggaaggtttgtaacggttttattatgcatcgaacactgtgtcactacttaaaaaaacgatttttagtgatgttggccttttatttttctagtaggatatgattctcggagccaaatgtccgtctacgaaaatgtaaaccggagtgtattttcatcatccgtctacgaaaaacaatttttcagggcacagacggacctcttaagtagccggctgaaaaaaattgattttctcatgcggaacgttatatggtccgcatgcaaaaatcatgcataaaaaaaaatctaagtcattcttatcttctcctccacccctccccacaactcatttcccctctccactctctcacacacgcccctcactctctcctccctccctccctcaaaatctgactggaggagaggagggcgacggtggtgcggcggctccccctctctccctccccactcctagatctggctagaggaaagggagcgacaacggcggcgtgcactgtagcgcctacagcatctggaaagattggatttgctgcctgcgaaaatcattttcgcaggtggtgctttggtctgcctgtaaaatttaggtatttttacgagcctttagatacatacggaaggtttggccgcctcgaaaatgtgtttttaccgccaggaacaacgctttttccagtagtgtgcataacctttttttttcg

SEQ ID NO: 48110 - DNA, 9567 bp, Oryza sativa
ttatgattttcactaagaaactatattgatacatatatatgacaactttacttaaaaaatgacatggtttgaaataacatcaatataaacaacccctaagtttagaggcggtaattgtgagtgctcacttttacttctctcttggtacagtaaatctggaccatattcgatgtactacctaatataatactcccttcgttttacattataagttatttaaatttttttttctgagtcaaagatttttaaggcttgaccaagttcatagaaaaagttagcaatatttataacactaaattagttttactaaatttaacattgaatatattttgataatatatttgttttgtattgaaaatgttagtgtatttttctataaatttgatcaaacttaaaaaagttttgactaagagaaaattcaaatgacttatatcatgaaatggagtgagtacaataaatatgtactagattatgtctcatcttattctaagatactctctctgttctaaaataaatcaatctcatactaatatatgacatatcataatacaataaatattgttatattttatatgcagatttattataataggatgcatcaaattctagtgcgaggtgaggttaatttatttttggttgacggagagagtactgtacagtccgtactaaatcaaaatatagccgatgcatcaagccagttttttctttctcctgtgcgtctcaaaggtgccgggtatggaatcggcacctttgaccctggctaatcagtgccgccttgcgggtgttggttgggcaaaccggcacctaagaggttttccatcgggcaccatttaggatttctgtactagtgtttgtatcactcaacgtatattgttagactaattgcttgtcaaatttatgaagtttgaattttaaaatggtgcacgccgaagcgaacatattaactaaaagtagtacgcgttgccgttagaaaagaaaaacagatagataaccaaagaataagattttattgcactctcacatgtatttatattggtaaaagagctaaatgattatatagatttatcgtttctccactattataaaaattgaagatgtttttgccgagattttggtatatcatccgtgtgtttgagttgatttctaatttcatctttatctttttttgtctgtcttctttttttcgctgctttttttttcgattcgttttttcattcggtttcttttgctccttttttttcgctattttttttatctggttttttttatatctcatatcggatatgttgcacgccgccactgcttaccaaatctagcgcagtcccacttcaatatgtgtcccatgcgttttctactccaattgattacaaaaattgattccccacacctctctcatcatttttttctcacaattttcctttcaattcgctttaatccattggatttagtttttgtcgctgatgatagttggccggcctttaattttgcggattcgttctgtttcggaaaagcggaaagagtagatcgagtgaatcaaaacccctcgaccaattttcagatataaaaaaagatttgactggatttgatagggagaatcagctcctgcatacgggcataggactaggaggttgaagatggtggttggatgtgtgaattaggcctatagctccacttgtgggctggatcagagagataggacagtcggctgtacgagctgggcatgtcgctcgatttgtgggctagattggagagaatcaggtcgagcagagggaggaaagaatgggctttcgacccaaacaaaggaacaatttttattaagttttttaattataatgtatatatagtgatcctaatatttcattcattgctcagttcctaatagcggttgtaccacggaaaaacgtttttacccgttgcaacgcacgggcatttttctagtagaagaaaaagacaaagaaacttatgttaaaaggtagagcccatcggctgactaagagctgattataagtcgtaacggctattactgaaaaatactaataatagaacaaattaagagtaagacttttatacctgtattgttagcatcttaaaactcaatattaaaaaaggggactacgataaaaatactctaaaatcagctttaaaaatatttattataaacgagatgaggacttacaatacgtagtgtgtccgctcgggactactgtcgagagggcatggaattgaaacgccttagcaatgcttcgcggcgacggcaataaacgaagagagtttgagcatagcacagatgacccgatggatggcacgagcgagtatatatatgtacaaatcgttcatgaactgagggcacgaatgccgcgaagacttcgtataacaaatcgggggtggtggtcagctcagatgatgacatgtgaacaacaaggcgaagacttgagacgacgtcaatgggcctcatcgtttggaacagtactaacctaacaagttgttgggtttgctgtcccgtgtaccatgcatctgtttctgaatgtaaaatctctttttagcacaaattttatcacttctatagtattgttatttatttcattaatatcctcttattttaatctatctataagttacggacaatcaccattacatttctacgtttagggcaaccatattgtggctcaaaagcagacagtaagcaatgaatacacttttattatcaggttataagcattgtaaaaagaggtaacaacaactacttgattgtagtgttactaccgggtagcaagcataggaagttagcaaccaaatagcagataaggaacgtagcaattctacaggataggaaataattttttttcttggtggacccaatcttattctctatggcaggcaacaaacattgtgccctctatcataaactattacctcctgctgcttgggcccacactaatatcaagttgggttggatagactggacctgttctgctgcccgggctgcggccgcagccggcaagaacagtgctgcactcactatgcacgactgtagccatcacagtcggcctgccgaacatgcccactgagaatatccttaagagggagtggtggtggtgaatttgccacacctttaccaccgtctacttttatttttgcaaacaaaaaaaaaaggtcctacatgtcaagctccccacggtcaactttttacttttctgtgagaataaaatatataatgctgttagtaacaaattaaataaagaggatatatattgaaaataatggtaataacgagttaatgatatttttagttaaaacttctgttgcacagataagatgctaaacaacccaaatatatggccttattaatttcgcttatgcctatacttatattacttatattataagctaaaatttaaattataaaacttaatattttatttttctatcgatgtttatttcacaacatttatttttatttttgttactaaggacacgtatataaaatttacttataaattatttttatttgctaataagagatataaaggaaaaattggaaaaaccaccccataaatcactcgaagtttgacattccacccataagttattttgttgcaaatgtccactcacctactaagttttgttgcaaaaaaccatcccagtaaacacatgcttaatccaatcaatatgttttcataaagtgtgagcgattaatgtggttttaccaaaattaaatacttccagagtattcttgatattttttttgagataccacaaataaaattgcagacgagagcttaaacgttgtcacactgagtttctctatatgaaaaaaagttcaattaaatatggaaaataagtctaatgcaaacgcttggacggtattgacttggctagcttagtctgtgataactatacaccagcaataataaactgatttgattaagtatgtgtgcattatggtgattttttttaacaaaactaagtagagagtaggtatttgcaacaaaatgacttacggggtggaatgccaaacttcgagtgatttatggggtggtttttacatttttccccgatataaataagcacaacaataggactcatgcttattttctaaaactaagaggtaaggcaacctaaacattctagacttgtcttttttttttttgaactgagagagagtaggtggctgtcctacctgcctgtcgggtgtaccggttagtagtattaaagtcgcatattaacttttttcctacaattaatttacactagtagtcatcccatatatgtatatctattaatttcatttcattattgacattttacattaaatttgcctcatcgatgttgatatcatttggcggtattaatatgctacttttttattttcggaaagagagagctctatgtattaatcatttgagggattacaatcgcgagcttttagctcggaaacacacgccggtgcttgcaagcacaaaaccaccaattgcttcaaggcaaagcaagttgggctaaactatatgctactttattaggacaagttttacaaaagagatggatgtcacagctaatcttgactataacatcaactaataaatatatgtaacatgtacaatactcccttcttccaaatgtctaagacctatctcttttttatcaaggccaagaagcaattaacccattcaccatatgataaaaccaatggacatggaaccaataagtactaaaataacttcttcgattccgatcaacaatttaatttagtacatggtgactacatataggacttagacttttagaaaaactaaataatagactaagtcttagactttcgaatggagaaaatatatcatatctatactagttctagtgcccccaatgtttgttcgcccaatctactcttttttgtctctctccttttgttttgaattttgtgcagtggttgtctcttacatgagggggtggctccttatctctctcatctcttctctccttcacctaactatttaagcttatgtagcatctaggagattgtgcttggatgcttatagtatttgacgtggcggacgtgagcctattttttgacgcggtcggactgaaatgccccggcgccttatctcctcatattgcttgctggacactaaattgcttgctggacactaaatacataggtagatacattgtacatatatgtgacagatataccggcgtggactacgttctatccagccaccgccgccggcgagctccaccgtcgtcatggttgtcgcaccgggcgtgagaggtatacacggcattgcatcaccatccagccaactttgaaccccagcacgacggtgaacccgacagcgcggtcaccgctgccgcccccagcgctgtgtcactgtcaccgttggcgtccatatcgccccccggcagccgcctggaagatggtgctcacaccgccatcgaacgtgaggaagaggcaatgcagtaaccagacgtggcgcgccatcttggcgaactcgacgaaccatggcgtgtcggagaacgcgccccagcgctcgccacggcgccgcgctgcgccgtgctcccgaagaacaccgcctccatccgcttatgcaccacggacaggtacccgtcgcacgggaactcgtcgagcgcgccccaccgcgagctccgcgcgtcgaggaactctgccgctggtgccgccttaagctccgcgaactcgtcgaagaaccgtcgccggtcataggagctccggtcgtggagggcgctcaggccgaagtcccactggtggaagccaacgaacatattgagcgtgatgaacgactcgagcgtgaacttggcatcgccggcgtggcacagcgggacgcccgggtgcacgatgagatcccaccccgcctgccgcatctcgccgatagaaccctagctcaatatgaggagataaggcgcaggggcatttcggttcgaccgtgtcaaaaaacgtgctcccgaccaccacgtcagcacagcaagttttatatatttagacggcgaggtccatcggcaaatatcgacggttatgtagtgtctttccctaaaactttgtttttgcgatatcttgtagcaaaatttgccatatatcattgaccaaatttacctcaagaaagaagagaagattgtcggaagattgttcctccagccgagggtgtgtcgcttgccatataactagaattaaacactggaggatgctgccatgtggtgcggcgtgtggatcgccaggtgtaacaccacaggtaaccacttacctagagtaccacaccaaaatgcactcaaaaccattaacttccaaaattattagaaatttcagcagagtctcccctataaatatggatatccatgacagacagttataaattaaactaataataatatcattcccacagtgtgatccatccatataacccatggaaagaaactaatagatatctaaaggattatttcaagaccaaaccaggatatagtttaagtgtcattatgtacctaagcaatatagtttgatagtgcacagataggtgtgtatacataggtgtgtatacaggagtgctacttcccgcccatacatgccgatctcaatgtggacctaaaaccgaataaacacaagagtgagtacagaaatagtcagcaagtacaatatggaactagaaaacacatatacacatcattggcaataaagcatgcacagaaagctttttttctttgataagaaacacatttttaaacaccaagtcaaagaaaaatagtagttcccgtcccgtgcaggcatgaattgaaatagtagtttacatcccggacaattgtgaatacatcctagcatttgtcggcaaaaccgagtaagcgtgatcaacgcttacccacaggaacatgaatagaaaactagatagcacatccatgactcgcatggagcatgaataattgaaaaaaaaaacaaagaaccaaattgaaaccatattgcacatccatgtcaagcatgaaacttgaattatttaactagaaccaaaatccggaatattaaaacaagaataacattgtaaacataagatgaactcgaaatctaaatagcgtgaacaacaattttgaacataagcagtcacttgtcacaaacaaatatatcggaaataaatagatagagcaaacaatccataaatcacacaattagttcgtcatgcacttgcctccaatcaagggttggtatcatgcacgatctgaaggaccaccacctaatcacaaacaaaaccttaacaaacacattcaaacatgcatataaaacaatgaaaaatgtgaacctactcccccatcccatcaaaacacaattacaagaaacgccgcttgcactataaacaatactgctgcttcaaacctttatatcttgaaaaataaaaaggctatgactgaaaatatatacattttaaaaatctacagaacaatacctacaacttttatgtagaaagcatatttttattctaccatttaaatggactaatttgcgcttgaaagcaggcttcagaatctgtctagaatttcagagggcatatacaaaaacaactatatctggagttctactcatctaatcaaagtgtattttaccaatatggaaatctcggagaaaactctacaactttgtctataagaggcctgactgattccgctgtttaaccactccaaaaacggttcaatctactactatccagattatgacatagaaacaacagttgtactaaaaaatccatatcgcctaaaccacttgagataaattcgcgccctttggtcagaagatagatccaaatattatctacaactttctagttatacacttttgcataaaatatcatttagacctccgaaacttcgaaaaccgaaacaatgtaaatctgccaacgtggagaacagccaaattgaatcacaacaaataaaactccttctctaaccttccttatccacgaattaaagcactaaaaacaccctagaacaactgatagtacaaggggataaacctcacttagagtttccttcaagattccaagggaaaaacaatggggagcactgatctacctttctcctttctcctctcctcctccttgtttcgtttttccacttcgtttcttgttcgaagttcatggggtggagatctatgaaggcaagttgctgtagaggagtgggggatgtgatatcacatacagacaggaggaggggagggagaatggcggcgacgggtgagggaaaggttgggtttccggttcccctcctctctctctaggttttaggggagaatcaatgggctgggaatgcaactcaaaaccaataaccaaaccaacatatgttttttttatttttttcgaggtgttacaccgagtcgctacttgcctcatgacttgcgtggtggaattgaaaagaaataagttcactttgactcccggaaaagtgactcgaatctaatctatccatgaccctcaacagcaaaacctgatatcgtgattcctaaattgttaaactggtgcaatttaactctctcggcggttttggaggacagtttcactaacgtggcacctgcgtggccgtattgacgtggcacttatgtagcattagaattaaaatatatacgtgaggcccacttgtcatcctctcctccttcaccttctcttctctattctctcttacgcagttgggcagcgatggcaggcagcgctgctgtgggaagtggaggagagggcagcggcgggcaggcacagggcattgctcagcggtaggcggcgttgcggcgggagatggaggtgagggcagcggtgggcaatagcaggggcgctgctcggcggaggggctcgagggccccacaatttgtttctaaatgggtcccatatataatttttaattctaatgccacataagcgtcatgtcaaacgccacgtgtgacgaaaactaggtcaacacagccatgtcagcgaaaccgctgtacaaaaccaccgagggagttggattgtacatgatttaaatatttaggggctcaagatatctggttttatggttcagggtcacatttaaaggagtcattttgaaattattccaattggaaatatcgtggcgaacatttaggatttgccgcacggcgcatgtgttaagactttgccacacgtccaacttacactgggttttgggggcttagacagccgcactgatcgccctcctccagggccgggcctgtgtcctgtgcaacaatctgatgcattgcgagtagtcctgtccttctggatctctcgcgtatgtgtgcctgggccaatacagacacccggccagactcagtcaccatgcgaatttttttcgtttttagatttttttttaatatttacagaaataatctatcgaccaaaaaaattacagaaatagcccctgccgccctaatggtgggcggcaagctgacgtggcagacggtgggtcgaccgcgccgtctgccgccgtcggccaaaattgcgattaggcccctgccgcccgtacagagggcggcaaggggctaattgcaattttggccgcccataaagagcttgcggccgtactttttcatctggg

SEQ ID NO: 48111 - DNA, 19431 bp, Oryza sativa
aagggacccagatgaaaaaagtatggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaattttaatatgccaagttgtccgataatagctaacccctacgtgaggatccctctcctctcttaaaccgcgctttagtaaccctgtattgctttggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctttgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcctatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcttggtcctgcgtctgcaccggcggtgcgcctcccagctgtgaaggcccgatgacgtcctctgttgagcctgaagcgaagtcgaagtcagtgatgtcgaagaggaaggtggaaggcaacaagtggtccgacgaggtcccagcatggtccagtggtggaccctgactcgacgtgccggctgcctgtgacgaagtcccggtgtactgccagaactacgctgagtgcgaggtcgacacagctgcctgagacgctgaccctgcagcctgggagaagtgtgcggcctgcgtcatagcgaactgggcgaaacctacacatcgacaacgggacccttgtaagctaagacataaaatatatgtaaattgattgtcgaagtaatgttgtttttttaagtacctgtggggggcacaacagaaggcctagccgaggaaggcggggtgctgaacggtgcacgaaaccctgaagcaatcggcaagtgaaatggctcacttatatgtgcgaggcatgtacagaaatagtaataaaaatacttacctccgtgcggagggggagttggcctaggaacgtgcgcagctggacggggaccagtcggtacgggtggccgccgtacagctgtgtctgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatacagggtactcacagcacgagcgaagtcctggtcgcggtgcctggcatagaggtctctagtgctcgcaacgtggggttgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgctaacccttgcgcgagtacctgcgaattaatgtgtaatattagtgtgaaacgacagatgttacaaattattgtgaacaggcagattttaatgcaacaacggaaagcgtagtgcaagatcttacccgtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgtggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttagcaatacgataagatcgatgcaacgtacctgacgacggcaccacagagtacccatcgtagggtagtcgacctctggttgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggtgatgctcctggcgtagtgcacgagtcccttgtcgaccgcgtgcccgtggccgccacagaacatcacccagccaaaaagccagagcaagtacgcctccaaacatcggctgtaggagtactcgtcggcctcctcctgtagctgctcaacctgcaagccgtcgataaaatgttaggcaccttaactgtggactaaatatgtaatacaattgtcatttcggtacaaaaacactcacggtgaactaaagcagccacctcttcgtaggtccggtgttgcggtggtgtgccaacggctcgagcgggaggtgcggtgcgcgctgtactagtgcgaaacgtgccgtcagatcgtcctgccagtctacagccgtggtcactggcccaacaacgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggctgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatataatgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacttgtcaaagtccgacatacatcagcatacctaaagacattaggcaccttagtccgacgttacatcacgagacctaaagacatgacttgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatttgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaataacatgtgccgtcggctttgagaacacactcctgcttcactctcttgcggtagatacccctgcctgccttatcttgacatagtatctcaaacctgtgctgttgggtaccttgcactagagctcaatgtttcatggcctttttacgcaactcctctagctttttctacatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccaattgtaaacttctgccaaaattgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggactcataccaacaacttttgttttaatcaattttaggaaccagtaccagctgtcggtattctcactctcaacaaaagcaaatgccaagggcaatacctgattgttcccatctacccctattgcagttagtatctggccccgatactttcctgtcaagaatgtcccatcaatgcagagaacaggacgacagttcacgaatgccatcttgcatgcatgtagagctaagaacgccctttgcagcacactcttgccaggatgttcaatcgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgttggattattgaccttggttcatatgtgagattatcgatgacatgcgcatacatctcagatgcaacaaatgcacatgtaatgttcctgtggtatttctaaacactaggtagaaaacatgtatgcttggtaacaactgacactgtccaataatccttccatttccccttatacgcgtgcactctccagggacaaccatgtttttccctttcccacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcacctttctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtcccttgccatcatccatgttcgtctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctgaagcccctcattaaccatccttttatagaaggtacactcctctcagccggtctatcaattcccctttctgatacaataaaatctgacagatctaccccagttggcccgtaacggacgtttcctggtccatggtaaacttggaatatttatttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccgcctgcaaaatagccggccccgactggtttttgcattcgggccccttgccgccccaccagaggacggcaagggttttcctgcaaaaaaccctccctccgtcaccgcccgttcctcccccgtttgccacgtcagcttgccgccccagaggtgggcggcaggggctatttctgtaatttttttggtcgatagattatttctgtaaatattaaaaaaaaaatctaaaaccgaaaaaaaatcgtcaccatgctagtgcacagctcactgtgcaatattaggccttattcgttttgaaggattcctaaaggaaatctcaattcctttggaataaacactatttatgcattattcatgcattcggtttgtaggattcaaaggaaaattttccataggaacactatgccaatcctccaaaaatcctgcaaaatgtactaattccataggaatgaaaacatccactctatcctcttttgtttagctcggtggaggaaaaatttctgtgttccaatcctttgttttgcacgtgcattcctgtattattcctatgtttttcctattcctgtgatttggaaatcatgtgaaccgaatagtcacactaatctaaaataccgatttcaaggtgcaaactctaccaaatcattgggccacgtggccaaaccaaaaaccaagttcacatatcgttaaaatgtgccacgtgtccaaaagagcacgctcattttaaacgtgtgtgaagagtccagataaaacaaaggaaaaatccagagcattctaaactcggttgaaaaaaataacatgagaacacgaaaagaactggtgaaaaagaacttttaaaacaactataatataattataatataatttcactataactatatcataacaatattataacttgtatataagtattaaaatactatatgcaactttatatctaacttatatagagattacaatgtagttatagtacagtcacactattgtgtactccttccgtcccataatataagggattttgaatttttgcttgcgttgtttgaccactcgtcttatttaaaaaaatttgaaattattatttattttttttgacttactttattatccaaagtactttaagcataacttttcgttttttatatttgcacaaattttttaaataagacgagtgatcaaaccgtgcaagcaaaaactcaaaatcccttatattatgggatggagggagtacaatgtaactatagtgttacactacactatagtaacatttaaaagttttttttgccaaaaaaacttgtgacagctttttagcaattcgaaaaaaaatataaacagcgagctaatattagctgtcgtaaaccggcgacaaggaagacatctaccgcaatattttccggatccacggaagctgttgccaatgagcaagatccattcactcaatggagcaagcggagggcgtcgagccgtaccagctgtgatggtccgcgagtgtggacgcgccaaccagccaacgagcatcgaggtcgagacgccatccacggtagcaacgaccgccaccccaagctcgaccacatccaggaggaagaagagagagggatgaagaagggctcaatgaggatatccagatttggacaatcaagggacgagggcgatgttacctccgctaccatcatcttcctccacttctccttgttcttgcaagtgttgtcttcgtcaatggctgatgcctttctcctagcaccgacgcggcaatccttgttctcgcaagcaccatcttccccaatggttgtcgcctttctcccagcactgacgtggcaatccctgttctcgcgagtgtcgtcttccccaacagctatcgcctttctcccagcaccgacgcgacaagtaaagctccaatgccacgatccaacgaccagttctctaagccaccaaatccgacatcctttaacccaccggatccggggccacgatctccggtgatgctgagacatggcgggccgcgatggcaatgagcggtgacggggacgaatcatcgaagattctaggcccttccactttctattactaggtgattctccatgctttgctacaggtttgctaagcaatttttaatatatatttttttttcatcaatggagctaagagtaaaaagaatagaaaataatgaaactaagcctcatcttaaaagcgaacaatttttacttgtcaaattacagttttgcccttgactagagaacaattgccaagcctaaaaattttaaaacggtttatttacacgacaagcaaaggcctaagaatgaactaataacaatttgacattggaacataagatgcaagtaaacacccattaacataagccatgtatagaagcaatgttcagagtacatagattaggacttgcgcagaattccactatcaacaatatataataaacatagtcagctaagtaatgtacaatctgtaatcaataataaatttttttgggctcaaacaatatcaagatacttggtcttaaaagcatgacccaaccgaaatctgagcttcaagaccggccattcaccaattagcttagtcagaacaggcaataagattgatagaaaacaaattccaatagccaaccacaggatgcgaggggcaagaacagtgtataacccagtggcaaatgctgttgtggttgccatgtatgccaaccacatgaggtttctagtaatggttctatagtagagcaagaactcaaggtcctctgacctagacaggatgcacacgaaggcaacagcaagtgaggagcacatagctaaggtgtcagagatcaagaatgcctgaaatgccagctttctagccatgataggatgcccatcatcgctgctatatcctccaggtaaggtgaaagcagcagcgaaggtgattgttgcgatgaggattgccaccaaagaagtgttgtttgtgtatgattgagtcagtgacttgacatctttccttgattcattagttaccttttgcttggcttcctcaagaaggttagaaagacatgttgcatcttctggatcagctctcaacataagcatagacacttcattctgcacacgtaaaaaaaaggtgcacatgaagcacatggtattatgatagcaatgcaaatgagtggtgctataagtttgtgattagaggccagaatgaaggagaatgtaattatgtaacagcattttataagactacgcatatcctgcaaatcaaatggaaatgatgtatttatgccacatgtttttctttgtcatttgtccctttgtttactttttgattcatgctgctgatgcttgtttgggtttgctttattaatagtatattgcacagtatttaacaggcatcaattctggtttattactccctccatctcaaattatagagtgtcatcttttttaggaaaaatcaaactcactaacttttgactaataaccatactaatcatataaatactaagtattatgtatgttatatcacaagattcatattttaaaatatttttatgtgatgttaatttcatattcattaggaatataacatggaataaattaatggtcaaagtatgttattgaagaccgtgtaaaaaataaagatcttataatttggaatgaagggaatacattttactactagatcttatggatatttaatgcattctactaaatcaaatgaccatttttgactgaatacaataacttcaattatagctactactactactactccgtaaatcaaataaagtgattgtacaaatttatatacgagagctctatttccgggtaagatactgggaatcgatccaaataggataataaaaatgagaaatcaacaagtactttgaaattgcggtgcactaatgcctttcatggttcctatatcaatgttacttttcagtttcattgctattgccttacatgagtatgtatgcttaatttgttcagcagcttactgatttccagtcaaatttatcttggttttctaccatgaattaactgcaacggttttatggaaattaatttgcggcaaatatacgtacccagatgagagtcttagcatccttggcatcccatagatgcgagcttgctgtctgtgcactgttgtcaaccattgtgtagtcaacgtctttccgagacagtagagcggcaaccatcttcggattacgcttcatgaccgtgtaatgtagagcagtctttccgctgctatcccgcatgtttacgagtctctggagttgcggtgtcctcatgatgaactcaaagaactctgtattaccagcttgcacagcttgatgcaggcatgtccagccattcgcactgcaacagggagcatctggacaatgcttcagaagctcacgagctgcaccaatgtgacctcggtatgcggcagcattgaggaggggtgagccatttgtggttgttatatatcctaaagactggtcatgttccaagaatactcgtagcacatcagccttatcccagagtacagtgaggtgcaccggagaagtcccttttgtgttttcttctctggccagccaaggacgtgcctccacaatcttcttagcaatagctgaaaaacaagtgatcatggcacaagtggaatatgtaaatttgagtagtagaagtggtcaatgttctacatagtcctaaatgtcaaaatcacgattgatgctgaagatacctgcatttccattcctcacagcagcagccaaagcattgtagctgcaggctcccacatgagaagaattgggaatttccagcactttctcgagaacgtctgcgagatctctcatcgctgcaatgaacatgggagactcgttgtgcttgttcacaccttgcgacagcgcaggctcagcttctatcagctccagagcaagctccttgtggccactgcggatggcatggtgtagcgcgttgcatccatccctgtcttgcctcaagattgcctcgctctgtcccagctcgaggcagcatctgagtaaaactgaggccagagcatcatggccactcgtcaccgcagtgagcagtggtgtctccccatacaagttgactttagcgacaagacacggggatagcaccattaaatctttgcagaagctctcacggccatgaatggaggatatgtgaaggcaggtgttgccctgtggagttgttccgagcagtatgcttggatcctgcgaaaccatgttcttcaatgatttggaatcacctgatgtggctgcttccaggagccctctgttcatctctactcctggtgtttcagactttcagtgctgatgtactggctgaaacaataaatatagctataggaccagtagctggtgactaattttttggggcattgtggctacatacttgatgagatatctttttggtgctgattgtgaagatattgaatgatgtctttgtgcaatgccttacaagaagtaaaactccaaccagattccactcttcacatgtagagagcactgcattttccacacatgtaaaaagcccgaaactgcaaagaaaattgtacagtatatcacatcatagcatgtatcatttctacatgtttattatctatcgtataataaaatccactgacatgtgatctaagctttcttgacaagacaaaaggaaaatatatagtagtacaagatttaactaaaaaatatcaacatttagcacttgatttgatgaaaatctaggattagagtaaaattaatctggaagctattactacttaaactacaattgtaatgtaggatctaataggatatcacgatttcagggagcggggttcagagccagttgatagggttgtccaatgtgggttgactgaactcaactcattaaaacccatcactgaaggtacacatgagacacggtgacatgaccgaattgatgaactagcagaactgttttcaatggtttgtcaaaagtcaaaaccaggtttgaacaacacccatacctgttggcacgatgctgttttcccccatggggctggttgctgcagcttggacaccatggtgttgactatgctgctcttatatggacacaaatagaaatggattgggctggaaacagaggaggatgacaagaaagcaattttctacgttttcctaaatttacctcccacccccgtgagctggctaatcctggcttcaaccagaccagtgtaactgcgtaagtgatggtgtgttgtctattgtgctctctgctagtgctattcttcagtgtttgcctgtggtagcttgtatcaactaccttcttattgaatcttgtacttctttcctaccaaaagtgtaggaataagtaataatgctggcttcgtctagcctttgagccacgcatacccagcagtgatggttaacaattaactcaacggctagttgaataataatagaaaaaagaaccgatcagctccaactagttttgagccccttaatataaactaatgcacgtattgtgcctattcagttccccattttcaaacaagtaactcactgtaaatcgttctttcgtcctcacatcatcaggttaaatggttaactaccccttcagccaacttggcattccaacaaacaccttgtgtacacaacctttgagccctaacaaacaccatacatgtgcacagttgtacacgatctctgcgctctaatctgaataaaaactacagttgcatcataaaagaaacattccacatccaaaaaaaaaataataaagcaacaactctcagataaaacacgaagcgacaatcaagccagggctaatatctggggatttttatttgagcaagaacaaggggctaatacttgggattttcgttcgagcaagaggagaggatgcactttgtccgtgcgtcggcaatcctaacgactggccagccaactcctccgccatggatacgacaagccaactccgctgcgggctgcggctgtgtgcgccgctgtggccagcctcgctgcactcggatagagaagcatgggtcggcgtaatgcttttcggcacccgcccccgcgccgagagctggtttctcccccacttccccggcgccgccgcgtcccgtcgccggcatctctgcgcctcgccgccactacggctggggctagctcgcctcgcctgctcgcgcgtcgccctgggcccgccgttccagcgggacaatcctagaaggaaaaagttccttttaccgtcgagtttcattcgttttttttttttttttgtttttgactgaagaaggtagaggagagagagaggctctatcttataaccattttattaatagtagttataaccattttattaatagtagttaaggtgttacagcaaaagtacatcagagcagaaaaacaagggaagaagaaaaaaaatagagaaaaagaggaagaaaaaaagaatcattcgtaattctaatccgcaaaactagatatataaataactatcaaaatttctttttatcctatatcatactagtaattgcctgtactaacgctatggtgatattttatagtacaatagtgataaatagaaaaatcccaccggatgtttttgttgttctattttcttttgaagagcaaaacgacatattaatttgcaatcaagaaattaacatataaacccaaaaatagtctaatataaacgcattctaattaatcttgttcacatggcccagatattgttagtaggagcaacaccgttattctttttgaaaatcggcaaatccatatttcgggttggcggcagcgccgatctgggcgagggcactgtggcctgaggggcgaacttggcggcggacgggactggggcgcagccgcggtgatgtggggaggaaggcgtgcaaaggaaagagggcggagcggcgtcaacgcgatgcgtagtggcggtgccggtcagcagctgctgcggatgatgaggaagttagcgccacgccggggatccagtggcggcagcggtggagtggcgtcagcgcgatgcataatggcttaatgcggatgtcagtgtgtgcggcgatgcgtggggatgggaacggggtggatgcgtgagggagaggcgcgatcgggtggaagaagcgcggatgccgtcaaatgcaaactcatcagatcattgtcgatcgtcggatgtgtcatacgatgaatgagtgaaccacttatttaactatagggtagatgatgtgttgacttttgatgtttttttccatgtcacacatacatggcacgagaaaaaataaaataaaaataaaaaaaatcaatgaaatcaacgtgtcagttaggcaaaattttttaccctgtgacatcgaatgtttggacacatgcatgaagtattaaatataaagaaaaaataactaattacacggattatgtgtaaattgcgagacgaatcttttaaccctaattgctccatgatttgataatgcggtgctccacaaattacatcgtcccactcacgtcataccaaggaaattcctaaattcctatctggagagaaaatcggatggccggacgcccgcaccactcctcttgaccactccaacctcatctctttctctctcatgtcggtggagatgctgaagtaagaggcggcgtcctcgccggacgacgatggcctcgcgtccgccgcgccgcccttggccgcggccgttgcggcgccctcctcctcgccaccaccggccactcggttgggcctctcgcgcggacctgcgcgaggcgactggacaacggtgagatggagcatggcgggcaggtcgccggagtcgagggaggcagtcgtggtgcggaggtggtggagggagagggatcagcagcgtgaggagcaagagcaccactgccgcggaggctacggggaggaaccgacaccggcggaattagtagtcgtggtggtggccgaggccgtggccgagggagcgcaacattccggcaccgttgaagatttggtcaccgggatggaggaagaacccaaatctagaccaggtaaacttatgtgatttttcgatgttccaatttattttctctcaatgtttctctgtgttaaatcgaaatgtttcactatgtattttaatattgtttcacatttttttcatcgattcttgaggatccattgatatttctcaatgtttatatgttaaatcgaaatgtttcacagcgtattttaatggtgtttcacatttttatcattgattcttgaggatccattgatgtttcaacagtataaacttgatgtttcatgtgtaagacataaatgtttcaatctttgattccaatgtgtttcatcttttctaattggatgttgcacacaatggtgttttcggtgttacaatcagcatctttaaatgttgcatataattggaatatttttaaccacatgatgaaacattttttcattggacaagggaacatctaaaacatttttgttgaaacattttttagttaatggtgaaacatgtgaaacaatttttctatatacggtaaaacaccgtccgaagttttgactgggattggatgtccgatccctagtcgtctccaaataaataatgctagaattaacaaaaacaaagtcattttagaagcatacatttaagttcttttgttcgcttcgttgttagctcatatataatgcaaaatatagtacatttagtaaacacataggtatgttaattcggctaataggttagagaaatgatttttcacccaccaaattaacaatatcttcaaatgatcaaatccaagctatctattatgcctccctcatttcatactaacccttcacccactttcctattctaatcccgttcctctttatcagttaacggtagagtccctaaacctttttaggatctgtaagagaatttctagagtggggtgcacgttgatttatctcaacgaaattgatgttcaatcacacggtaacataactaaattctctttgttaaatcccatccccacctgtaaataatcataagaggattccatcaaacgtgacaagtataactgatgacaagatcaaaatctctaaaattcccaaatttttttaggacatatacaacaaaatccacaaaagaatggcatagaagatcaaattgtatgaaataagaatggcataaaactcgcagaagtactgtaccttatataaaatcggagagcagtagctaaagatccatatatgctgctgaaggcagttatagggatcttaagagggtcgccaacccagccttcttatcgttttatctattgcacgccaaacgctaaacaatttcgataatgacatcaacactgatttggccccctgttttgattaggtcttctaattgcattgtcatggtgcacaccattgtgattaaactacatagtatatactaggggcggagccaggaaaccaccaaaagtagggctcacaacctgtttagataccttatatcttcgaaagtttcactaaaatttaaatgaatcttataggaatttaggaaacaagcctaaagccctagctgccctaggcttgtcatatactaactattctttcttgtataaaagttagacacatatactcacgcacacaagccacattcacgctcatgtacaccccagatgggtgcaccttagattggactagtctcacgcaattatatatatgaatttggttgaagtttgattaaactgcttcaaattcagtcaacttttgttcaagatctgaatttttcatggtgaggttttgcccagacatgcaaaatcatgctatctcaggctctcccatgatcattttacccagaatgatatattctgttcccaatattcaactgagctgtacatcgcttggtatgttgttattttttttaataaccggaagtgatggacaaaaaatagtggctatggagatgaaggtaagatgagctcaagactaatttattaatttactattaattaacaaaacttttttttacccctaccaatgaattagaaatttacaacttcatatccccatccttgtaataattttacaatcaagtatgtgacacattagtttgcattaatttttccattgttcacaaattatcattgaacatccctaaaaggctaaaactgtgatgaaaactcgcatataatttgcagttaacaaatcaataacaataaacaagaacttgaaaaaaaagatacaagtcattacataagctccacatgaataatgttcagagtacattatttagattatatacatgaagttaaagatttaacaatgtatgctattattgatcaaacaacacgtgacacatatatttgaacaataacgatataatatgctatcatttacaagatatatcgataatatcagaccatatcaaggaactctgatttgaaagcttgcatgcctg

SEQ ID NO: 48112 - DNA, 1897 bp, Oryza sativa
aaaatctatcagcatatcaacaaaaaaaaaatctttgcaacagcatattgagtattgttaatcttctattaccacttcatgcatgttctggacagctctaatctcttgccagtactcatctggtgattttgagagaatagagcattgttcctccttcttccttttaaatgattccatcctagctctactgccagcttcatcaattagatcaatggccttatcgggaagatgtctgtcagcaatatatcttgctgacaaataaactgctgcattgatgctttccaaagtgtatttgcatttgtgataggtctcatacttctcacgcagaccaagtaatatcttcacagcatcctcctgcagagagttcaagagaattgaaataatgatcaagtggaaggtaaccccaagagcagagagttcaagagatttgaaataatgatcaagtgaaaggtatccccaagagcagagagttcaagagattgagataatgattaagtgaaaggtaaccctaagagacaagtgatttctgaaattgaaatttgtattacctggctaggctcattcaccaaaacaggctgaaatcggcgagccaaagccttatccttatcaaaatgcaatcggtgttcatccagagttgtagatgcaatacactgcgaaaaaaatacatcacaatagggaaaggacaaataaacttggttccttttatagtagagaacactttgcactcaattgcagatgaccaaaaataatccattatacttcacagcgggtgttgtccatacagatcatgtccatgatattaatgaacattttagagactagacatccttcttcaaaggaatatccctcaagtgcacatggaaggacatcaagagtgtgtgtagcagtactgaaagggtcagttaaatactgaagccctagcaccaagtgttacttggatatattgcaacttattttaacaaaaagaattgaatatagataggatgtgcataagtattgttgtatgtcaacaggttgcaggtagagtggtattcataatacttcaatgatacaaataatggaacacatgtatggcatatttaactttatttttaagggattacctattgaattatatttatctattattttctgtttggaaactgcactaaattagccattccacaccactagataaatagatattcacctagacagtaggtaaaatgatgcaaacccaggcaccaattgctgctaatccagaaaagaatcaagtagttttgagaaacaaaatgggcaacatggattgagggatgccttttcatgacatatacctgcaattctcctctagccagtgcaggcttcagcaaattcgcaatatcaagaccagctcctttgcttcctcttccagcaatcccagacccaataagagtatggacttcatcaatgaacagtataacatcacctgcatgaaactttggagctctttgaagattgaagaccaagaacggaagttttggatcttgtaatgcatcaagtcagaatgtcagataacctgctttgcgcacttcacgtattaaactagtaactctggcttccagttcacccctctctttagcaccagccattagtagagcaacatccaatgataatatacgctttccctacataaccatgtcaatgaatggtaattatcaggtattaagtacaatcgagcaagcaaaattatgcaaccaacatgattgtatccatctcttgtagctaaaacttaccacgaggaaaataggaacatctccattggcaattttatgggccaaaccctcagcaatggcagtcttaccaacacctgcttcgcccaaaagaattggattgtttttcgtgcggcggcatataatctgaactactctttcaatctcat

SEQ ID NO: 48113 - DNA, 35664 bp, Oryza sativa
gtcaagtctagacaaaatagagccagtgcactcttctctgaaataacaataagagcaagttcatcctttctacatctgtgctatcaagaatagtactagctattagttcaataaagtgatgtcaaaccagacctttatttttattcgagtatttgacaattgcagacttcccacctccaggagtaaatttctcacgcactttaaaagaagataatccgacaggctctcttccatcctttgcaagctccccttggactcgggtaagtgcctgctttgctagctgacttgaatctactcctaagctaaaatgacaatcattgtaaaaggaaaaaaaaatcaatgaaagtttagtggtgggatttgtattcaaaacgagaatgcagagaattggtattaactacactaagcggggatgaattgtataagtttataggattttaaggaattaaaccccaactcctaaagcaaccgtcctcgaccaagcacacccctaaatgtgcaaaagtacactaattatttatttttctctttattaagtggaaatccttagcgaagtccacatccatcgcaacgtgagcttgctgatgtgcaaattcatttacatttcaggttgcatggctaatgaattagctaatggtatataaagatgccttcatttttctagtttgtgagcatacacatctctaaacttccaaaatatcgtttgttgtttactggccgatgaaaaggtcgtaggtggttgatgcattgaccacactatcgcggatcatatggaagcattttttttttttgggaaaacatggaacaggagaacatcaccacaaacctcttaaggacgttgttcgtggtgggatcgttcaggttgaagaggccgagcgcaatgtgctccggcgagatgaagttgcatcccatgttcctggagaactccacggcggcctcgaagacgcgcttgctggcccccgagaagggcacgtccgtggccagcccgaccggcgcctgcgcgagcccttccttgcccacggcggcgcggcacgcctcgcgggcgcgctcgacgcggacgcccgaggcgaggaaccccagcggcgaccggtcctccgcgacgaggcccagcagcaggtggtgcggcgccaccgtctcgtcccccatcccgcgcgcctcccgctgcgagaacaccaccgccttcaccgcccgctccgtgaaccgctcgaacaccgccctcacgacgacgcccccgcgccgccgcggcgcgggcgcggccagcagagccgcggacgcgcggatcggtcgccctgccgcaaccgccaccgccctcccacccccgccggcccccgcaggggagaaccggcggcggaggccggcgcccgtggcgaggatggacgcggacggcaccgacgacgacgagcagcagcacgcctccatcgccctaccacgcgccgcgaagctcgctcccaactccccccacggtgtatgattgatcggatgccgctgcagccgaagccgcttcaattatgtggcggattctctcacacccgccgcaaggttgtggctgtaaaggttcgctcgcgaaatggaatagaataatcgggtgtgagaaggtggtgtggggtggggtggatggaagaacagtggaagtggaggcggcacgcaaggaaggagggggagggagggggaaccggcacggcggagggagagagatgcgggggtggaggcagagcgggagaagaaagggattttctggcttggattccaccgttggcgtgcgcctccgccgcgggggtattctccggtcgggcggccacgcccacgcccacgcgcgcgctttatccgaacggaagaggggatggctttgcctcgcgccgtcccgggggccgtgcgatcggggacggacggcgcaggctgcgtccgtaaggttaaccggtgcatgggctgttaggaaagttgtgtgtgtacacgaaaggtttaatgtgatggaaatttgaaagtttgaaaaaaaaattttagagctaaacagggccatggtattgggagagtaccgtttccatgggtgtggcgtctgggcagcccgatcagtgtctcggatcgatttgttcggttacaagtttacgtctaggtacagtgacgtgtgacagaacgggcacaacgaggcgatttcctaattggttgcactatttacatgtgcttgcatgccaaccaaaatggttaacaaaacggttggtttaaatgggcaaatcctagtgttggttacatggaaattggcagaatagcgtacctatacgatgtctcgctatccacacatttgcatgcacaatacaaacacaccgtttaacataactcaaatataatgtaatagatgatagatacatgaacataagaaaatcgtgttaaagcaattcgtatgtacaaatgtccatatatcgtatatagatatcatgcatcgcaatatgtgtgttctatttaaatcaggatatgtcaatacgtgtgaatgtttatagaggtaagtatacctccttgtacatgagtttgtaaaaaaaaaatctcagttgagtagtgttcttacttaataaaatgagatggattttttgttcttagccgaatagatattgagaattgaaatggaagtagatgaccggccataagtgatatagcagtataacccacaaccctaccacaccatttaaggcccattttccaaagctccatgaatccattgttcatggagcagaaaactcgttagaataagtctattttgcgtctcttatctcttttcttgattgaatggtttgaatcaactctctcaaccataaaatcaggtataatatctcacacatctttaaaaaatagtgcaaatcgattctttgggtagtttgggaagtgttttttttattgatgtggcagattgactacaagtaactcgctgagccaacagatgaacccacatgttagcgactctcctctcttccatactcttgtcactaagccaacagccgtgatgccttgcatgtggtgcggtgcagcatgatgaggcccaaccgacgccacccccgacatgtgggtcacacctattgagtcagcaagtcaatctcggtcaacttgctatgttagcaaactatttttcaacccaccgaagaagtcgatttgtgctgatttttaaaaattagggaggtattgtacctagttttgctgttgcaggagacgattcaataaggaggaataaatgagaaacggacaataggcttattccgaactcgttatccgggccaacaaagagcttacggaggcctacaaatgaagcgttatagagaagaaccctcacttgggcctctcattgatctgcctccaaaaggcccaaaagagagggctcgatagctctaaagcatcaaggcgcgtgatcgctatgatgggcaaaacattggatctcgtctcggcgccatgtgttctgttccgatattttttggccgggtggtacaccctcccacgatagatctcgcgtctcgcgattcataacctgatttgatccacggccccgcaggccaagtagcacagtaatacagtatactaccatgcttcatatgattgagcgcgctgcaatttgcagtagcgaaaaaagacactcccaaaaagaatcgatccaatgcaaagaggctggggaattctcccaaaaagaatcgatccaatgcaagcagttgcagctagagcacaagaacaaatatcgtgcccgtacagcagacggacagaggagttggacgcggacagaaaagcatctccatctccatatatcctgtgacggagtcggtcctccgattgtccaacgaacgcaccacatcgatctgcatgcgaaagcgaaaggaggggggggggggggggggggcggcacaagactgactcgccaatccaacggccgcgaggcgatcgatcgccccgtgtacggcgaggtcggctcgtgatcgaagcgccgagacggcgtccgagctgtgtatgtgtatatatacgtgatatacgtactgtaccatccaccacgacaggaacaaggagagaaaaaaggagaaaaaaaaaacaaacactggagacgaaacggatttgcggataggcgccacgcgcgcgctgcgacgttacatataccccggccccgcccgcgcgccgaacgctccctcgtctcgtctgctacctctcgctcgcgcgcccgcccgaaaccgatcgatcgatcgatcaggtgcggggcgcgcggtggccgtcggttgcgggaggcgcgcttcccatcgagcggattaccggaaggcgagggagacaccgatcgagagacagaggaggcgaggcggttgcgttgttgcgggcgttgttgcgggcgggcggtcaggtgagcgggcgcgtcgcgtgccgcatcggcgcggcgggttcacgcgcttgttgccgcttcggttgctatgcccgttttgctactccgcgaggcgggggcttgggactgattgatcgatgggcaatgcaggggcggcggaggcggaggcgatggggggctcgtacgagctcgtcaggacggacgacgcggcggggcacgtcttggatctggaggccggacgctgcgccgccgtatacccaaagggcggcggcggcggcggcggcatcgctccaccaccggtgccgtctccgccttcgtctccggcgtcggcgcggcagcggctcgtctcgctcgacgtgttccgagggatcaccgtactggtacgcgcagaaatcactccctttttttactttgttaaaaaaaatctctttcttttcgccggtatgtttttcctccgattattctgtcctttaaagatttctacggtttattcctgcaaatctttatggctctttcttgcttgattgccctgtttaatttacgatatatgacaaacaacctaccaaatcggattgcttgccgagtgggtctctgtgcctgctgcatgtgtatcgatcatgtggtgtggtctttggtgccaaccaaacacgctccatgactcatggactcatgatgcatggcagtggcttagcagcagcgaccacacttctcttcccttccctttccctttttgtttgtacttgaaccacagtaaccaaaagagagcagagctgcttaaactaacccaacagctcaaactttagctttatcagggaatatttagcgcatccagcgatgcctgtacgggccgacatgataggttgcgtctttctcttcatgctgtcacacacaacatctgtattctctagccacttattatcttgtccaaacagcaaaatgccctctgtttttcacgcacaactttaaccgttcgttttatttaaaaaaattttaaaaaaatttaaaaatataagtcatgagtaaagtactatttatattttattatcttgtaacaacaaaaatactaattataaaaaaattaaataaaacgaacgattaaaattgagcgcggaaacttatggttgcactgacggagagagtagcaagttagcagcaactgtagccattatagtagagctgtggaagcatagatcatcaatttttagtcgcggcacatcttgatgctatgcaagatatagttatttagaactgacgtgaattaacaatcaccggcctggcctgtcagattctgaggagtgattgctcctgagatgtggctagaatcgtcggtgctcgtggcccctcgatcacagtaggaaaatgccctgcctaccatcgtacggaatttctccagctattggactcgaactgcacggcagatttcgtgcactaatatgttcagtttctgttgctttcaaacctccattagtttgatagataagtgggtaatgtcaagtatagctcacctgtaaatatatttagataagtagatgagcggagcgcatgtaccctctatagttggcacttagaaaaagatatcacgtacggtctgatgcagctaacaacacgagtaatcaaataatcaatagaacttctgatggtagaaatatattctcctacaatgagaaacaaaaaccattatatccaaaaacttggttcaagtgctcgtagaaaaggtagacatacttaaaagttgaagatatatcttctacactaattaggtaccctaaagctcccatgtcactaactagaaatatttgaccattgattaggtgagttattctgtcatggctcttaatcatattaggattttgtgttaaatacaaatatgccattggagatattacaaactctttaatttttattgtcatggtgtcttttaatttttgtaaaaatttaataagtatatgacattctgaacccccacttttcaatcttactattgtttaattttaaaattcaaaattagcaagctattgtagatttgtagagtcaataggaaatgagcctaacttagtgagtggtagtacacattagcccataaccagatacccaccttttgtcctaaaacctttttcttacacggggcaattcaagaaccagaggaagccacattttccggacaccgtggtgacgagccgagtgacagaaaaagagcaagaatgttgatcagaaggccgggcgcaccacctgcgcggaatctcatcaccgggcatcgatccattatcctctgcagcgtccgcgtcggcggttggcctctccgcgtcaagacaagcccatgcgacggccggcgcctttttgccatgtgccaccctccccgccctgcccgccgcggcgtgggatcgatcgatcgatcgatctcgtcgtctcctattctcctctgctttccttcgacgcgcggtcggtcggtcggtgcccactcccaagtcccaatcaccaattcacctcaccggcgcgcggcgcgccgcgtgcttcaccggttggaccccctgctgccacggcaaacggcccgcccggtgcatatgcgcgctcgcgcgcgcgggggcgcggggtggcggatcggttggttccatccacccgtcgcaccagtgcaccaccggcgcgggcgggccgggtgcgcctgctgctccacgccacacccacacatgtttcccgagcactttttctcgcgcctctctgctccgtggtactgtgccacacatctcgtcacctcgagctcctttttctggctttctttggtgccgttttccctgcgtgctcgtcaccaccttccgtggcacgcgacgccgacggctgtggctccgcatagcagccgcctgtacgcgcgccgcacacggactaaccgcgtcaaattgcaggaaccggggctgcgttgcgtaataatctcgctggctctcgccgccatctttggtgtacgtgtgggcggcgaactagtacgtctctcaccgtcaccaacgccaagacgcgcacacaaaccatgcccgcccgtccctaccatgtactgtatagatcgtgtgggctaacacgtccggttttccgttctttccagggtcgcaccatcccgctgaccgtgacgcgaccaatcctagtttctttcgctgcttaattcggttttgtccacttgccctggttgccttctcgtcagctactagctactagctagagaaacttaagtgcgattttgagggagagaatagtggagactaaaacaagtgcaatgtcggattcaggcaaactcggtacaaccactgaaccgcacgaccggtggacgcgatgaccgccacggaagttcttttaaaatcttgatatggtctccggcattttgagtacccgaggatatgacctaccaggatgcagagtcaagatccactgagtctgaaccttgaagacttttttattttagattggcacacgaaaggtgagcgacctttctgatgtcattccatcgattactgctgagaaaaaaaagaacatccctaaacacagaaattagaacagttcgtagtttagggtgccctgttgcaaaagtaatgaacgacagacacagaaaagtagtaaccgataagcctgatagatatagctagctagcagtatggatggagcagcacaaatggatcatggatgtcatctttaaaggagctagatctctgcctcacgtagcagtagctggccctaaatcctaatgcaccatatgttcacaccccaactagacgtgtgtgtaccaattcctcccggaacaatcctgtccagtggtactgaaaatgatagccatgtactacatgaagaggtaccacacgtatatacataatacttccatgtgatcaggctggcctttagctaagctctagccaatctgcaccaaccacaccttagcttgtcccggaatatccagcaatgcaaaatccaatctatccgaaagccatgagagtatgagaccaacttaatactaatggcctatacctgcataatcaaaagaagttcattaggatcagagctagcttacggatcacagtgacacatgtgccaatgagaggaggtatattgcacgaacgttgatcggtgcctgggccccactatgctttcttctactccaccactacagtaggtgataggtgacaggccgggtgtttgagtgttaaaaactgttaatgtgttaatgaggtgaggccacggtactaggcatgggaacggtaggttcccgtcgctgtaaaactttggtgattcatggtctctccacctactgtggcttttactacctagcactagctagatggaaatttagtatgttgctgctgtattttggcaatgtaaactaaattgtagattggtgaagagatcagttttgcttttttaggtgaggaagagatcaatagataactctttacgatggaccattttccgaccaatcctcatcttagcaaacctggttttacactcttgcaagtaacttctatgttacaatagttggtgcttgcttcctgcttccaccatattatgaattctatggggttggtatgaaactgtccatttgtgtcatggacccatggtcgcctggccagacaacagaaaccaacggcaagggattcaggtgtccgtggttgatgttgccgaggggcaatggctaacgtgcgtgcatctttttatgcccgaaatgccggtaggcttatcatggggcgagtttctgtgttcccagttgattgctagaatatttggcttttgaggtgaaatgtactgagatggaatctgatgccagacagaaacccatattttggtgaagttgtttagcatcgtattctcccttcgtttcctaagatatttccatgggccgtcagtgttttatatatcagatcgacaatattttagaatggtaatagtgcaagaaccgatattatagtctatttataaagattgacagtggattcatatctggttattcggttttgttttgtgcttttatagcataaccagatctagtttgtactgtagcagctaacaagtgggtctagccagatttattgttgcagcatctgggtgtttcctaaatactttttttttctgaaaaggatcgtacatattttaataaccattggaaatataagtaactcgaatctaaattttccaccgatcttaaagttattttcatcataatctttcgtacaactgaaaagctctgtatacatatattgaagtcaaaatgattgcgccaggttgccaacaccatttaatctgatgttcttttgcatgacaacaatgtagtaggaaagatagattttttaaataagtaggattaagtgttgctttcctccctgcagcttatgatcctcgtggacgatgctggcgcgtttcttccagcaattaatcactcgccatgggacggtgtaaccctggctgatttcgtcatgccctttttccttttcattgttggagtcgctctagctctagcgtacaaggtacaggatgacaaggctaagatcgtgatatttaacttcctttctgaaactaacaccgtaccagtgacacttatctgaaacctaattgcgtcacgttgtgcagagagtgccaaacaaattggaggcaaccagaaaagcaattctccgtgcactgaagctgttttgtgttggtcttgttcttcaaggtatcagttaggaaattcatgaaagctactagctacaattattgtaggaaaatatgtatttaactttctcttgcttctatattatgcaggtggattttttcatggtgttcgtagtctaactttcggaattgatatggaaaaaatacggttgatgggtatactacaggtatacggcacacgccattttataccaccaacactttctccatcaagaataaaaattatagtatataatgacgtatcttcgtggttgcagagaattgcaatagcttacattgtgaccgcgctatgtgaaatttggctcaagggagatgatgacgtagattctggatttgatctgctaaagagaaaccgttatcaactgtgagtataaaaaccaaaaccggtctaatttttttgtgctattgttcttcacgttgatgagaaattagtcctcttattcaccttaaaatatcgtccacttttgtatttccaggttcattggcctgatcgtcatgatcacatacatgggcttcttgtatggtacctacgttcctgactgggagtatcggatatccgttcctggttccacagagaaatctttctttgtaagtgacactccacctttatcttatacagtacaagtggatcaattactactaacaaggatgggaactgatgaattttaaattcaaaatctttatcaggtgaaatgcagcgtaagaggcgacactggaccaggctgcaatgctgttggcatgatagaccgcaaaatcttgggcattcaacatctgtactgtcgaccggtttacgcccgatcaaaggtactaatgaaaagcaacagcttgaatctgtgtgttcttcctcatgtacaaattcggtccataataacaactgctctctcctttgacagcaatgcagtataaattcaccacaaaatggaccacttcgtcctgatgctccttcatggtgccaggccccttttgatcctgaagggcttctcaggtcactggacccttgccatcataataaatctgtctttaactatctttcaggctacaacagtacaacatttcctttgcaaactttgctaaattctcactgttctttcttgattctcgtatcagctctgtgatggctatcgtcacctgcttgattggtctacaatacgggcatgtaatcgtacatttccaggtacagtagttcgctgatatgtcagattgatgagcgtttgattttgcagtccacattgaaaatactctgaacttctctctgttctgaatcgatttgcagaaacacaaggagagaatcatgaaatggctaatcccctccttcagcatgctaatccttgcgttctcattggacttctttggtaagtaatacattgtaatcttcaacatttcattcctaatcatcaggagcgtttgaactgaccgttatgctgatgaacctctccaggaatgcatatgaacaagccactgtacaccgtgagctacgccctcgccaccgccggcgccgcgggcctcctgttcgccggaatctacgcgctggtcgacatgtacggccaccggcggccgaccgccgtcatggagtggatggggacgcacgcgctcatgatctacgtcctgatcgcgtgcaacatcctgcccatcttcatccacggcttctactggagggagcccaagaacaaccttgtaagttttgctgcaacactgacgatgaacatcattttccagatagatttcactgcaaaataacatctcttctaacacggctacctggctggctccattttgcgcagttgaggttaatcggagttggggcatgatccatggatgcagcagctagaagcctagaaggcacgtatagaggcgtatttaggacactatttggacagagacaaacgagacatgtgcaggcctagttttgctacaggcttagttattgttgcacagattcgttctctctgagagctctttgtatatggtaaacaacgagcctgtgtatatcatgacaatacgatctaaaagaaatatatagtacagaaaaaattttcagctgcacagtttaaatatgaagagctgcatgacactacctccatatttaaatatgtaaaacaatgctgatttttatcggtctttgttatacaattttgacaactatttttctattaaaacatactaatattttataattttatgttttttaagagttattaatggttaaagttttaaaattttgactgaataaagtcaacggagtaagactttttagtcaggataaaatctgtttattgactatggccctgtttctttcagctttggattattataatctagattattaagttagattactataagctagattgttataatctgtagtagaataagcggttagctgtttctttcctagattattggatttgcaagtctaaagagggagtgggatggcatggtgggtaatttttcacccaataatctggaaaaggctcacctaaatgagcttatcggattataataagctactttaataatttttctgtttctttcagcttactctcaataatctggattaataatcccaaagctgaaagaaacagggccagggagcttctgcagttttttttttagaaaaaaaaaacattcagcctttaattgatgagggcgatattttggtccaggacgtgtgggctatgaaagtatgaatcctcgtttcagtcaaggcaaatgctagccgaatagtagcccaacataaaaaaagtccagttggctagtttgggccaaaattaactcacaaatatctctgttactaattttactgttaccttcgtgttgaaatataagagattttacctatttactacccaattaaaatcccttatgttttattttaggatggggtggtaactaccttaggacgggggtagtatgcgtagcctttacggcctggaattactgacttgtacaaaatgtcaaacgcatacaattgtacacaagtatacttctctaatatgtgctgtgatacaccatttacaccgatcgtaagccgcggcagcacataaaaaagtccattttttctgacacataaaaaaatcattcatattttttttgatggaataagaatgtaatcttgctcataacgaaaatgagactctcggccgagcagaggttcctcgcgcgcgacgagacgacggtggctttagctaaagctagctatcggcgagcgcgatgagctggtcgacgacgcctggttcggcgagcgtgctggtgtcgccgagctcgtccagctgcctggacgcgatcttccgcaggatcctccgcatgatcttgccgctccgcgtcttcgggagccccggcgcccagtggatcttgtccggcgccgcgaacgccccaatctgccacaagaaacaagtgaaggtattatgcatcatcaggtgaaaactccacagttgaaaacagtagttgacgtgtgcgcgtcttccacggggaaaacggctgagagcaatgcagcaggagaacaacactgtatcaccatcagtgtaaagtctgaagaaaatacctggctgcgaacagtcataacgaggcttttccgtagctcatcgctgtaaggaacaccgtccaccaatgtcacgaaagcgtaaattccctggcctttaacctgaaacgggcattgctgatttaagacctggtttttcgtggaactaggggagagggtgcagaaacatggagccaacacaaaggagcaagatgtaggtatagggatgaacctcatggtcaattccaacaacagcggcctcggcgcattttggatgtgaaaccagagcagactcaacctctgctgtcccaatccggtggccgctatgatttttttcagagaagggtcaattacttatagcttgatttttttttctgagaaaactaagcattgaattgaaatcaagaataagcatgaatagaataggttgctgaattacctgacattgataacatcgtcaacccgtccagtcagaaaatggtatccatctttgtccctggcattcaaattacatttgccagtgtgtaaacatccggtaattctgcaaagctgtatattccactcattgaagaactatttgattgagttacctgctgcaaccatcaccggagaagtaatagccagcaaatggcttgaagtatgtggtttcatatctgtccttgtctccataaagtgtccggaaagccccaggccatgacttctttatgcaaaggtatccgctgcattctccttccatttccttccctttctcatctactattactggctgtcaatcacgtgcacagtaattacaacataagagaggtgattgaaatagtataacaaactcacttcaagtaaaaaatgtataccaaaggtcagtcattgtatacctgtacaccgaagaaaggaaatgtcgcagatccgggtttcagaggccaagcgccaggtaaaggagtgatctgacagaaataaacattgaatttcaatttgattcatcagatgcaactcactttagaatcaccgaatttctcactagatatgtaaagacacaattaccataaaaccaccagtttcagtctgccaccaagtgtctgatattgggcatcttgcatcaccaataatatcatagaaccatctgaaatgaacaaaagagaatgtaagaccttttgagtatattataatttttgacccaggaatcatcacaaacctccaagcagtgggattgattggctcgcctacgcttcctagaactcgaagagatttacgagaataccgagtaacatactgcaaatacatcagaaaatcataaaggatacacaatgagccatgaacataaactgaaacaaagcaaacatcagttataaatttcactctggaagaaatgttcttgtgcagttatttttaaaaacagtcttttgaaacttgatgaaaatttgatcaaaggcgctctgattcaaatgtggtggaatgtgtgaaggaaataaacaggacatgtggttcaatatttgtttgattttttcccttgaaaagtaactaggttcaagatgtatcttcgggttgtttctttataatcttatcacaatgccataatattacataaataattgctggatggcaacagtcatgggtagtaataacacaaaaaattaagaagtgtacctcggtaccatcacgcatgagtgcacgaataagtgttggtgcagtataaaatatcgtcaccccgtatttgtcaacaacgtcccaacaacgactaggatcaggatagtttggagcctacaagtagcatcagcaaaggcattgcaaattacaaacatggcaggactaaaactagtccgaaagacacacaattgttatttattgtgattctaggcataatatcaattaaaaagttctctgaaattaccccttcgtaaacaagaactgtggctccattcaggagaggaccatatgtcacataactatgcccagtaatccacccacagtctgcagtgcacctgatgcaagtcaaacagggaaatctaataagaaataatgcagcttgcagaaaatttcctattaacattaggaacaagtttatactacccaaagatgctaaaaaactagcatcataccagtatatatctgatggcttgtaatcaaatgcgtgcttaaatgttgttgcagagtacaccatatagcctcccgttgtatgcaatacaccctgcagacctcacaatatgttaatgtttggccataggataggctaacaaagtaacaaaccatgtggtttagggtacctttggctttcctgtgctaccacttgtatatagaagaaacaatggatcctctgcatctacccattccacatcacattttgttggaaaattgggcacaacatcctgggggacgcacatcatctcaaattttagtgatataacatgaaatggaggacttaaaaagaaatcttccaaataacacagctgttctgcagatgttctgttcctacttcctaacacatatgacgtggcgtggtactttttggatagcattgaagttgtttgttttgggcgtacctgccaccaaacgtctctgcctgacgtccattttgtgtcttctctcttcattgccgactgattttcgtatgtcaaagaaatgcctgctcagcacaacaaagataagcatgaggaaactcctcaagaactgtatccacaattacagagggattctcagcatgacatcagacgaggctaatttaggcagtgaccaactcatagaagtcagattgtacatacctacatcgactccattcttcgcactgtcagccagcgacacatctactatatctttgagagctatgagtttctttccccttttcaccgcgttgcacgtaatcacaaccttaggcttgcagtcaatgattctttgtgctagtgcgtcagcagagaagccagcaaacacaacctgaacacaattcggcatcacaatatgaaatggaacttcattaaaaaagacacatgacaattagcatcttaaactgctgtgacaattaccgaatgaacagcgccaatccgagcacacgcgagcatcgcaatgggcagctccatcagcatcggcaggtagatcaccacggcatcacccttcccgacgccgacgctcttcaggtaatttgccagctgccatgccacagattcacacgatcacaccacaacaatttagcacaggacaccaaaatcaacctcactttatacgacgccacggaggcattacgtgcaaatgtttcggcgtatctacgataggagcgcgtgtgatctttacctggcaaaccttgttcaggagctcggagtaggtgagcttcgcgtcctggccgggctcgttcccttcccagtacatcgctatcttctcgccgtcgccagcctccacgttgcggtccaccgcattgtagcatatattggtcttgccccctttgaaccactgcaaacaaattcttagattactctcgtggctctcatggcaatcgagcatcggattcagacaattgttcatcatcagtcgagaaaagtgacagtactagcttacttcgatcttgatcggccccttggtgacatccagattctcggtgcagacctcgtcagggttccacttgtgcttccagtagaacgtctccgcgatctccgaccagaacccggccggatcgtcgatcgaacgtcggtacatttcttggtactgatcgccggccatgtgcaaaaacacccggaacactcgtcacaaccaagaaccaaatcgagtaatcgataaattcacagtgaccaaattgttgcaagaaaatggggaatttaaccctggcaacccagggtttactacgactgcgccgtcgctgtctgccactcttgccttatctgcgcctctgcggccagcgatggatggatcgctgcgcgcctcaaattgaaggtacggcctttgaacgcgcgatgcgccgccagttcgagggggagagcgaattgacagcaaccgagaggaaatcggcaaagcagtaagaaaagcagagaggcgtgtatcggcgatcacctgctgcgtggaggagacgagggcctgggaggcgaagtccgtgctggggtggacgaggccgtggtcgtcggacgccgccaccggctcgcccagcacggccgccgcggcggcggagggcctcctcgcccgcggcttgccgttaccgctcgccgccgccgccaccgcggcgtgatcgctcgcgcccatcgcccaccctcctcgccggagcagcggcggcgaagtcacggacatcacccaaggtagagccgcagcggatgcctgagcctgcgcgggaagcgggatcgcagcgcgggcgcgtgcgcagccgcagctggcgtatatatgcagctgggccatgacggccacggctcacctccccctccccctgcccgcgcgcgctccaagcctccaacaacaacaaacacctttctgactttgctgccggcttcagctggtggaggatgcaaatcaggcgggatggtggtgggttgcggagaaacgaaggccccccctctctctctacactctacgtatctctcttgggtttctcctcgtctttctttcttctggtcgtacctggacgttggagctgacgagctgtgccgctagagctggacctcgcggcgtgacgctgtcgcgcgcccggtgacggaaacggagggggagacgagacgagacgcgcgcgggggccgtggccgtggccgtttatatgcaacgcgtggcgctcggaggcgtggcgatcgaggagggcctcagaaattttttgtcacgtttggttgcgttgcgtggacgaccgacgagggggtggacgaccgaccgggggcggggggacgaccgaacgggtggacaggattcgtgtggtttttgacttgggactcaccgcggcggatgccgttaaacacgagcgaacccgactggggttcacatcgtctgcctttcgggctgacggcaaacattgccgttgcatgcatctgtaccgcacattctttcattaacggttgtatatagtggtcctaccacagagattaaactagatgcggctttgccgcataatagaccagccaggatgaaatactccatccgtttcatattgatcatcatttaacacaaattgaaattttcaaattgatcatcatgttatcatagccccttcgtttgacgtgtaatattattgcatttaagcatgaaaattgagtatgcatgcatgtatgtaggaattcgaggtagtaaagctatcgtttcttagagcaagtttaataagatagtcaaccactgactccaaatcatctatagtcaatttagtaggaaattcatatactcctataaacattactacacaatttatacttggtcgcacctgtcatacacacatgtatctgggagtctgtactacagctggctacaaatctatagcccactgctcttctctcttctgttttatctcctcaaaatgtgtcaataactggacctgctcttatgtatggggcctaagaggagttaaagtgtgcatgtttcttgatttttccctaccacatactcacattaaatgaaatataggaaagttaatccttttttttcttggtgaaaaagttatatggtaatgaatatggaatggagggagtaaatgatatggtatgataagtagacttaatttctttatctatttaatgcctgaaattatggaaactatgcccttttattcatatattaatttaaagcagcgagacattgaattcatagacataagttggaagtcgaatatatgcgcacaaattccaaattccaatgaaaccaaagtaatgaaactacttactcccttcttctaaaagtctaaaacttattccattcttaggtttttccaaaagtttaagtcctatttatagtcattatgtgttaaattaaattattgatcagaacccaataaactattttattacttattggttgcatgtttattgcttttgtcacattgtaaataaattaattactccttggtcttggtgccaaaagaaataatccctccgtcccaaaaagactcaattcctgagtttttatgtctaacgtttgaccgttcgtcttatttgaaaaaaaatataaaaaaaaatttaaaagataagtcatgcataaagtactattcatgttttatcatctaacaataataaaaatagtaatcataaaaaattttcatataagacggacggtcaaacgttaggcacgaaaacccaagaattaagtccttttgggatggagagagtaggtcttacttttggatggagggagtattttcattttatctcctggcggagctaaaaagatttttttgagcccaagcaaactatacttcttgtatttgttatataaatttcatcatcaattcattcaataacatataaatttaatggagtttttgtcagtgagcttgcgcggccgcttgcgatagccaggtgtggcttcacccctgcctccacatgtctataaaaatcaagaaaatcctttttttaaaaataatttatcttcttattctttaaacataacgttctaaaagtgcataacattaaaaaattctatttgcacaataaagaagggtaaggaattaattatttgtttgaaaatttggaattgcgttgagctcaagctaaagcaaaagatactggtgcctccttattctcttctactacttaattatatcctgaatactccatcaaaaaattatatcctggataaatgattacaaagagtccttatctgcccattgcaacttgtatgtgcagccgaactgtggtctccaccgtttggcttattttctaataagccaaaacggcttattagaaaataaaaataaatttgtagataaaacttttataaatgtgttcttggtgacttaaaaaccaatgttgaaaaagaaactatgttgaaaatatctcaaaatcaatctcaaaattaagcttgaaaatttaaaatttggctttttctttggctgattaggccatctgatgggagcctgtaagtgtcaactgagagcacaatcaaatcaaatgatataataatatctttagtttttctcacctacactatttgaatgtaatgttcactgtttttttcatttagatggcaacgtcatgcaaaaaacagagccgtccgtctgtacattgatctagcgttcttagagcaggtacaatagcagactataagctagctatagacacatttcaagaatatataataggagagagaagagcagcgggctataaatttgtagccagttgtagcatgaactctaagatacttgtgtgtatgacaggtgggaccaactatgaattgtgtagtatacgtttataggtactattgtatgaatcggctattaaattgactatagataatttggagccaattgttggctatactattaaacttgctcttacgttgtcttcagttgcaggcttgcagctaaataaagtcttttttttgtccttcccagtccctagtccctgctcctagtcgtcgacgactccgctgctctccagtctccattcctcaatctgcttcttgctcctcggcgtctccatcttcgccgcggtgccgctgctacaacggacagtatatggcctcctttgcaggaagttcgatggcgcatgcgtctacaagatcaaagtagcgccgtcaacatgagcgaggagaagtctgcgatgcgctccctgtcctccacctcctgcaatccctcctgctcctcgggccgttggcgggtggttcaccgcggcgtcatagccatgacgtgtaggtgacagaggatccgacgtgacgccatcgctcacccgtgcacgccgcctcctctcctccgctagctagcgccccctcccttctcctgatccggcctccgggtcgacggccaccaccgccgctcttctcttcattgggctcaacggatcttgccgaagtttgtatcggcgacggctatcgcgtgcttgaggtgactcctgcagcatggcgacagccccgtgcgtcaaggaagggcagcagcatggcggcagggagcgcaagggagggcgaggtggccgggcggtggtgaagaagacgagcccgcgccttgagggaggacatgagcgggtggtccgctgcggcgcgcgggtggtggaggatccggtgggcggtgaggcgtgcatcgggaggagggatgggtggattaggggtcgagcgcttttgcgagaaaaaatcaagcttcgttagtccatcacagcgaactttcggggagaaagaagacacgtggcagattttcggggaggagaagcttaatttataggacgccacgtggctcaatctctaaccagggatagagccctgaaatcggtattagagattagagacctactaatcggtattattagttatttctctccaaaacaaaattaagcaaatagaatcctcttttatacgaagagactacaataatctacaggcctagaacaagctcggtatatctttaattattttaggtgggttcttcctaatacataaccgtaaattttctaaaaaaaggaaattaaaatgaaaaaaacagaaaaatctagacatttctcatattacaatttaaaaatacatataggaatctagacatttttcaacgcaaaagagctacgtcaatatattactgcacttaaaattttatacagccgtaacttaccgattagtgacctctaattaatctctctggtagggccacttcatacaaccattgatggaagaacgtgtggtacagatgcatgcaacggcaatgtttgccgtcagccccaaaggcagacgatgtgaacccgactgcgtgagatacggagacgggcgtgtgcgcccgcttcgctgggttttgtcgcgagcgccctgccgttttggtggcgcgtgcgtgcgtgcgtcctcgatcgtggcattcgtcgtcactgacgtaaacgtttgccacttgtctagaacgcgaagtaaagaattcgtagttctcctgctgcttttgagttctcggcttttctcgcggctcgaccgaggcagtggatccgcagtttttttttaaaaaaaacgtatggagtttgttaatccgcgatccttggaacggccacagacctgagcacgaagtttaaagtgttgacatgatcaaggattcaaggggctcctctgaagccgtggcaccgggccgcgcatacggtgtgtacccaacctgtgtgcgactcgagggaaaagaaaacccacggcacaaacggctttcctgcacggtccctagtgtaccagcttctgacagtaatggcacgtacagtaggcaccaacgcatgcggcgatgatggagcccgcgcggtcggtcggatcaggacatgaacacgtgtaggacactccctgtgctgtgtgcggctgtgactgtgcgtgcgcccacgggtatcttctccgaatcgtgcagtcgcggagtcgtcgtaggctagtagcaggtggcctcccttcccggcacacgctgcaacctgcgaaatacgcgatgcgatcaattccatttccatctcgcttcgcctcgcgcgcggccgggccacttgcggccttgcgggatctaatctttcccttccccgtgtgtacccgcgcacacaaacttggtggcggcgtccgctagctgctctgcccccggagactccactccctgtgtcggaagacgccgtcgcgaatttggcttcgcgatccagcgcagtacgtagtgccgcgaaggcagtcagggcccccagccgcttgcgtgaaaagttagaaacgaaataagctaagtactctagtactattataccagtatataggcagcaggattgtcacgtcgaaaaaagaaactggcgagattgatcagggagggatggtgcactgggcttgtcacgtgaggaacacataaatcgaatcgatccccttcagctatatacttaagttgtttattacgtatgttagtgataggctgatagccacttcttgatgtgtgagtgtgaccagttagatcttttctcaccaactagttgcagtcagctagcagtgctgatggtgctaacgttgaaaattggagaatatctacctccctgattttcgtttgtgagatgaacatttagatgtctagttttccaggtaggaccatatttttagcatgcatggggatagagtttgcaagcgtgtgacttcacgttcgaatcttgatgtatactttcactttctcagtgatgcactccagtaggaattctttaaggttaacaatggtgtgctagtggtctccgtctgttaagcatgcgcatgggtttttaatcttgtaaacagcgttgggccgaaggatgtgtgctgagtgccatttcatagaggaataagtctattttgactctctcatagttcttttaaaaaaaagactctcatgtctggcttccgattaaatcatctccctcaactgtataaccgggtataacgcttcacccatcttccaaagccggtacaaatagactcattcggtggttttataagcggtttctgctgacgtagtatattgcctgcggttgactcgttaagccaaaatatgggacccacacgtcactttcctctattcccctcctctctatcttcctctctcctctcctttccacctctcccctgaggccgatggcacaaccacaaagtccacaacatccctcgccgccccatcatctgtgccactgccggtcctccatgccgcgtgcacgacgccggccataccttgcggacctctccacgcctaaaatctcctcctccccccagcgttgttgccaacactgattccttgccactagtttgttatcactccaccaattccttcgacgtgttcctgtaggggcggtcagccggaggggcgtgtgcagtgatgggtaggatcaaaacagctagtgaggtcactctctgcccagatccgaggacgatcggcccaccgtgaggtccccgatttgcgcacacgctaagaacatgatgggcacgatgccgtcatccaccatggtgaagaacagtagaacggcctcgtcctagaacccgtgcctcgcgtgggtggtcaccatggttgtggaggaaatgatgtaccagtcgaccaaaggacacaaacatggcttcacccaagaacctgtgcctcacacggtcaccatggccgtgcaagaaacaacgtcccgtccgggcggaaacccgtagaagagcgcctgcgggaggcaagctcacaacgagtactcctcgaggctagccatgagcagcgtcatggtcaacatgtgccacgccaacctcgtagtccattgcaccaccacctccaagctcctacgccgccgcatcatccatccagttcatctgttgacaaccagatggctttgccgaaggagcgaacggcaggatgcactcctggacgcactccttggtgggttctaacagctttgccaccatcaatgggttcttgttgtgtgccacctctggtggcctccttagcatccaagatggtagcgaccctctaggacttcctttgcgcaccgcctcaccactgtcagccacgtccttcggcgattcagtttgtcttgcctccgctactgcttgtgaggagagagagagagagagaggcggggaaggagaaaatgaactgacatgtggggccacctgtagaaaccgcttcgcaaaccgcacaggttttctaatatggggtatacactatacccgatttatagttgagggaagcgattcgatccaagggtaagggatgaggcaggtataatagacttttatagatgggacttgttctagcgtgacaagtctatgggcccaaaattctttgctattatttggcctagcccagtccatctacaaacttagcatctagcccagctttctttagtcctttcggcccaaatatacagacgagttgggcctttagtccttcgtgtcctttgtcttatctcgtatagtcgtatgccctccggcgctgcatttcgtcacatgttttattcacaagaaagatggcagccaatcagtagcgtggacgtgtggcgtgtcttttcgcttggacgatactggggagcgtaatgctccactattacggacggcaccgttgtaataaaattgtaatgtgccaatccggcaccgcatccaaaaagaaaaggtagatatcggccgcacaacatatcctgcacgtcattgttcgccgtttcttgctttgcaccgtcgaatagatcgtacatttcgtgggatggcgccgcatctctctgcacttctgcaggacttagaggggagaaaacccacaccaacccacatctgtagccgcccacatgctggtaacatgtcaaagtgcgcacctacacaggctctgatcgactacagtggcgcagccactactacagcaccgctacaagatcatgcgatcgagcagtatgttttctcggtccaaacaatataataggcattaccgatttgaaaatatggcacacgacatgtgtttcttttaattaatcgcatcccaaaacctcactagtttaacccccagctgctgcattgtcccacccaaaacgctctccactctccactattcacagtccatctaagggcatgacaaacaatggtaaaaaatcagcgtcaaagactcagtatggaatagtagattattgagcaaattgttgttgtggattacctacttaattatagatccaagataaattatttttttagacctagaagataaattaattttttagaccaagaagataaattaaatattttgataaataaaattaaacaaatattttttataaaaatggtgcaagcaatacaatagaagaaagtattttgagaagatatattttttgaaacatggagcaaacaatccgtttcaacaattcagtaaataatctgaaaagaactaagcataagagaaaatagtacatatgaaatatcaactacttttccaataccgacacaccgagtgcaatttttacaatgtggagcaaaaagagagagaatattgtcgtttattgattaacaaatggtccaataaatatcttaatgccatctacaacattcaatagatcaagaaaccaacatgaaattggacccaccatcattatcccagcggagctgccaacaccgtcgttgatctcccttagcttgttgccgtcatctcccttgagacgcagccattgtctatctccctcgtcatactggtggggcaacaggtcctcgtccagatccgaagaagggcccccataatgcgtgctctctttctgtgcacaccaggagaggggacgtgaactgttggcacttgctgttcaagctgtggcggtggaggcatggaggatgcgtgatactagagaaagagcgagagggaaatggggagaacaagagacaaagagatagatcaagacttcaaaagatgattttggttgagtcaaccttaaaagagtcgatcgactgaatttgctcgatatctctatctatgtcggttcatataaaaaaccggtactgatgtttcacatatcaaatagtattttactgaaccagtatcgatattattagtgttagtttttttaataaaccgattctgataaaatgttattagcgtcagttcttgcctacagaggatgagggttggatgggtggacgggagacattcactatcagttccgggttgcatagtgcattacaattatactattatgttgtaagtagcggttagtagttgcatttgatcgaaaattctacaagatttaagattttttttttcgcgaacgcgcaaaaggattacacgtcaatatattagaagaatagaattttgatacacgacgcactcagccagaccggcctatgacaaggaaggaagaaaaataaagataaaaaacaaagaaaggaaaggaactcgaaacgacggtaactctactccaaacagcgagagggggcagagccactctacgctctcaacaattccccaaaggaagcgacagccgctaatgaccacatccggcctctgaaaggatggactctaggaccactgcgaccaaagagagcacagagtcaaaaaccctggagttacgtttcttccacagttgccatgagactaggaggactacggagtcgaagctggcacagagatgatcaggtaaacaagccctagaagatggccaccaatcctgtagccagctgccacggaggggagagagggcagcccagccagtagacgacaacacccgtaaccagacctgatgagcgaacacgcagtcaaggaggatgtggttcgccgtctcaagctcttgagcgcaaaaggggcaggccgagtggctatcaatgccgcgcttctggaggagatcagccgtccaacagcgctactgaaatgcaaaccagaggaagaatttgcacttagcagggcccttcgcgtgccagagaagatcggcacaagcaaaggagtgctggccaaagaagaacgcctggtacgccgaacgcgccgagtagcgctagtcactcgtccaacgccagaaaagacgatccccgacacccggcgtaagttgaatgtggagcaccgcatcccaaacaagaagaaattgggagatgaccgggacaatgagggcgccgcggatgtcagaaatccaggcgttgtttgctaggccagaagcaaccttgcgcgaaccatgcagacgcgggggcacagcgaagaggagatccggagccaaggaagctaccgagcggccacagatcgattggtcagaccagaaaagaatcgactcaccatcacctggtacgaagaaggtggacgcctcaaacatgtcagagacggctcgctcggctggggccttcaggctatcccagtagggatgccctgagcgttggagccaaagccagcgaacacgcagggaaaaacctgccaacctaaggtcaggaattcccaacccaccgaaagctctgggacgacagacattcgtccaagaaacccgacactgcccaccgtgagccgagtccgtgcccgtccacaagaaggcacgatgcttcttgtcaatggccttgatcacccaggctagaaggccgatcgccatagacacatggaccggaatggaggagataatagattggaccaaaacagagcggccggccatagtggtgagtcgtcccttccagggaggaagacgatgggaaaccttatccacaagcggctgcagggccgccttcggcaacttgtgaacggatagcggaatgccgagataagaacaaggaaaatcagagatcgagtaggaaaagcaggactgaactagctccaggtcttcagccgaacagcggatcggagtaaccgaacacttggcaaagttggtgcgaagtccggacggtacaccaaagacagagaggatatcctatgtagtcccttgatttattgcaccctattttcatttgaattttcatttgaagtggcgtttgaatatataagagcgtacggaagcaccatggcaacaacatggatgaatccttcgccgatcgatctctccagtcgatccatccgtgcacatgtcataacctaaatcctcacggcaaccgagctcaaactctgagacaaaggaaaaaagagcgaccgagtgtgtaaaacaaacacgacacgtccttccgaccttctcccgacgccacagcacaacacaccctttgcgcgactcccctacccatccacctcacccggccacacgtgtcacgccctcccgcacgtgccgcgcgccccccgacccgcctatatacgtgcaccccatcccgagctcacctctactccagcctcgtgtcagtgtcgtggcgtgtgcaagtgcaagctagtcgcagctcgcgcgcggctcgtggacagttgaggcagatagctctaggctctagcccagccatggctgcaccggtcaccttcgccgtggtcgcggcggtggcgctcgtcgcgctgtgcggcggcggcggcgcgcgggcgcaggacatggacaacgagtgggcgcggaacagggggttctacggcggcaccggcggcggcgtggtcggcggtctgctgccgcagtcggacgtggacctgctggagttcccgctgaacctggagtacctggaggcggagttcttctgctggtcggcgctgggctacggcctcgacggcatcgatgccagcctcaccggcggcggccctgcccccgtcggtgcccagaccgccgccctcacccccttcgtccgcgacatcgccacccaattctgctaccaagaagtcggccacctcaggtaaaaacagcggagatgcaaacgtagctcgatcgaaccggtgttccacaagcgtttgatcgattttgtgttaatttgatcgtacgtgcctgcagggagatcaagcagaacgtgaaggggttcccgcggccgctgctggacatcagcgcggcgaacttcggcaagatcgtggagacggcgatgaacacgacgctggacccgcccttcaacccctacgagaacagcctcaacttcctcctcgcctcctacatcatcccctacgtcggcctcaccggctacgtcggcgccaaccccaggctcctcacccctcaggccaggaaggtaaagctgcacacaccccgatcgacacacgcgcatggcacatgatcactctaccaccatcgatcacgcacacagcatgtacgtgcagctggtggcggggctgttgggcgtggagtcggcgcaggacgcggtgatcagggcgctgctgtacgagcacgggctgtcgcgggtggcgagctacggcgtcggggtggcggagctcacggcgcacatctccgagctgcggaacgtgctggggaggaagggggtcaaggacgaggggctggtggtggcgccggggcaggggccggaggggcagaccgtgggcaacatcatcgccggcgaccgcttctcgctcgcctacgaccgcacgcccgaggagatcctcggcgtcgtgtacggctccggcgaccccgccaaggccggcgggttcttcccccagggcgccgacggccgcatcgccagagccttcatcgcctagcaagccggccgaccgatggaagaaaaaggacatagatacatcggaacacatataactcatgttcttgcaagctgtagactatctatacaccttacatgtgtgtcagtgtgtgttttgttatagaacttgcatggataaattggggagtgtatacatgcatactggatggtaatatcaataataaataaaggagacatttacaaatttgtcattatgtaagaatgctactcgagtaatagttctagtggtaattttatactcctacttcctaaattgatcatcatgtaatggaattcaaattttcttaaattgatcattatataaccgcatgtaatggaatgcaaattttcttaaattgatcattatataaccgcatggatacggatttcaacataatacaattaatacagcagggaagaatttatgtatgctaaggtgtactattttacgacttcctttacgagcacggagggagtaattggcaacaatgttttgatcgatacatgcattgtgagagaatatgtgcatgttgtcttgattgatgcgatttaaattattcttggtatatatgatgctcattttaggaacgaggaagtaattttctagtgacaatcaaaccaatgataaatttgtaattgtaattttcccttaataaatgggacaatttgctaacaaatttgatagctagacacatactattttctttctattcttttagccgtttctgatgttaagcctaacgttctgcagtgcccttccgacattggagttcgatggatcaagccatcggagaaatgaaagaagacgaagccgcaaagggcgaaaattgggcctgttgtagtgttgtgcgattggcccaatttaaatgggccgcacgtagccctcaatcccgtttggaataagttcactttgggtccctctatttgtcgcccagtccgattttcgtcccttggccgcaaaaccgggtacgacttatccctcaacttacgaaaaccgggtaaacgaggtttctcggcggttttgaaggcagttttggctgacgtggcttgtttgactaggtctttgtcccacatggtattgacgtggcgcttacgtggcaattacatctcgggaaaaaaaagcgtggtcccacatgtcagctgcacacaaaaatatttttaaaatggtggggcccacgtgggccccacatgtcaacctcacacctctcttcttccctctcccttctctctcttcttccttccccctctctctctctccttcccgggctgccgacgacgcgggtggtcggcggagcaggcgagctccggtggcggcggcgggcatggtcggcgccgccccttgaccgaagcacgttggaggcagaaaaggtttcgagggaggagcagttggagattgcgtcgggggcgggccatggctggagggggaggttgtctatgctgagatactgcagtgaggtgaggccaaggaggaagtcgggtggtagggaggtgaaggcgttgccgtcaagggcgaggcgggtgagggaggccatcccggcgagggaagggacggcgccggcgagcgcgtttccctggagctgcagcgcggtgagcgaggtgagggaggagagcgtgggcgggagcgtgccggcgagcaccctgttggcgaggttgagctccgtcaccttccccgacccgccccgttcacaggtgacagcctcgaagccgcacacgttgtcgccatcccaccctagggccgggaccgacttggctaggtcgtggatggcgtccgcttcggaagccaactcagcgacgtcggcggcgcgctatgatgaggaggagggtgagggttaggaggtgggggatttggggcggagagagagagagagagagagagagagagagagggtagtttgggaaggaggaagggttggtttggccgattccgacgtcgcggtgctcgccgactccgaccgcccggcgcgcgcacttctccggtcacccgccgccaacgccgcgctgtccgcggcgctccggtcgggggcggcaccgaccacgcccgccgccgccgccggagctcgcctactccgccgcccacccacgccgtcggcagcccgggtaggggagagagagaggagggaaaggaagaagagagaagggagagggaataagagaggtgtgaggttgacatgcggggcccacgtgggccccaccatttaaaaaatatttttgtgtacagctgacatgtgggaccacgctttttattatttttccgagatataattgccacgtaagcgccacgtcaatgccacgtgggacgaagaccaagtcgaataagttacgtaagcgccacgtaagccaaaaccgccttcaaaaccaccgagggatctcgtttgcccggttttcctaagttgagggacgggtcgtacccggttttgtacccggttttgcggtcaagggacgaaaatcggactgggcgacaaataaagggacccaaagtgaacttattccatcccgtttggacttccgacaactaaacaggctgcacataatgggtaaaagtctactttacatccctcctattgtcgtcgagtttcagaattgtcgctgaacccgaataccatatataatgcatcccagatctttgcaaaaccgtttaaataagatccttcggcagtatgaattcgctaacgtaacaaattgactcggttcactcacgctaagtacacgcttacatggcaaaagcaaatatggcccacatgtcatcatctcctctcttctctccatcttcttccacgcaccctggctggcactgcttgacactgcggaataattaattatttaccactcttacatgtggtgataaaagatttgtcactgaacccacatttcatagacacataagggctcatatgttatagacagcgagtgacaaataattaattgttacatcttaaaagtggcaaaaagttaaatgtccccgacaccgcgcttgtggacatcacttggcttctccgcatctcctagctgcactccggcggcgatgatgatgacgacgacctgcgcgggccccccaacgtcgcgcggaggagagcctcgtagcgtcgtgccttcgcaacatgttctagacgttgggggcgtgcttcctgaggttgaggatggcctcctggaaggtgccatacatgtcggcgaagacgaagaagccgtcgagaagggaggaggcggtagatgagctagtggtttgggcgacacgcttcttcgggaggaggagcaggttggcaagcgcggcgtggagcgcgtggaggtgggcgaggcctgcggggcggtacggccgtgttggagagccagaagagaactgttgtgatgatggcatggaggtgggagagcaacgggtcggagcgacaaaggaagttgtccgagtagccaaggagctacgaggcagcgaccgtgcagcggccgacgaagttgcagaggaggaagcccgagtcgtttgctgacgggccaatggtctctacttccccaccgctaccacaccggccttcctcttcctaccccattccagtaagctgcttgccgacctccttcatcgcctttgtcaggcatgtcacacgttgatcgccatctcctcgccccatgattgactatcgagccacaacccgggtctcctcccagtgtgcgccgcctggctgcttgtgctgcatctagtccccttgctacaatcggtgttgacgtgtgcgccgcatcgagccggcctgctatcctcaactccgactagtgaggcagtgaccacaccgatgatttcctccagatgcgacgaagctcgacaacactatgccgagctccaactgtcgtgttgtttgcaggccaccaccctcgcccgacagcgccggtgttgaaacaggagcagaaggaaactaggcccgtgattgggtgaaatctgccgcatcatcaatgatcttcggcaacagtagctacgggaaggcagcagcagctgcagtgactggtcgatgaggagggggtggtggggagagataccaggaagaatattgttttaatgatacgtgggtctcacgtggttttgattttttttttaatttttgcttttagtaccacgtcactcaaaaccatcatctatactgccttggacccaaagtgacccggttttgaatattaggaatgcaacatatttggtattctagtttatgaatgattttgaaactcgacgatgaggagggcctcacgtgaactttttgccacgtaatctgtaatagtaccactccgggccaacaataacgggccgcgcatcatccgtaatccctttccagccctgtagttgttagtgggccgtacgcccccctgaaccccattggggccgaatataatggtctgcacatcttgaacctcgttctttgagagtttattaccgctatgtacccattcatgcactgatagaaaagatcctactactcggctcactagtattcatgtatgaatccagccacccaggcctgcaatgatcaacgattgttcttctgccctcaggaacagccacaactcttacagtctcgcgttactctcttacgtttcgagacgtatcttggtcgcttttgttgcgttgttatcatctttcgttttgatttatggacagctcctgccagaaaccagagttgctggcttctagaatagcaaaggcagcggcacgcacggaccaagccagcgattgattgtctgatgagcaaagcaaaggctggaagtgcatttcccctcatatgaacagggcattttcttcaatcagggaaaaactttcaggacaagtagtaggcttgacttggtcactttgttcgggtacaagatgctcacattgaaaagtcgatctctgaaggactgaaagcgaccaacgcgtagaagagagattctctaggaggaagaagcaacgatgcggctttgttggtaagagctgcctgctatgcaagccttcagaaaccacgcaagagggaagtggttcttagttctattgattgacagtttttctccccagagggcatatgctggattgaactatgtaatcaagtattcaagttgtcaaccattcagttacagtactccctccgtattttaatgtatgacgccgttg

SEQ ID NO: 48114 - DNA, 9067 bp, Oryza sativa
cattaaaatacggagggagtattagccaagctacagacactgctacagactctttcggtataaccttcattttgtttctctatctgaaaagtgataagagcaccggacatattacctatgttctgaccttcaggcggaactccgttaacgagtccctcgttgaaaaatctttgattaggagtataattaacacctctcttttgtaaagcaccctcctgttccgttggacttggatttctttctgatgcacttatccaaagtgcatgtacctattgctggctttgtaggggacaacactgataaggcacccgatagggaatcttattatcttggatcgatcagccagtcgcagaacatatccccccatgctgaatcaaagaggagagaaatcatggctagactcaattactcaactgatcttgcagataggttatgatagatctcccattgtgtgattagcaatctgatcttgtttattcatttggtatataaaattcagcatacatttttttgtcaatgttgctttctgatgatcccttccaagatggatacctccgcaccaagaaaagtcctagataaggttaattatgcagtgcctagatttttattttctttcgaggaatatgtagtgtcctagattattccgtcaggtgttcacatttcctctccgaatgcactagtttagtatgataagattgagtgaagacgacgaaagatgacagcttgacacttgttaattactgctgctaaacacgccataatatctcatctatcagattgctagcgacattggcttacttatctctaaaggcagatggggcgatgcctcttggaagcgattagctgaatagaaacaagtaatctatttcccttgcacaaaaaagaaatctatttccttcccctgataagcaaagagagaataacactactgtactgtaactgtcaagaggacaaataattggagctctttacaaaggcgggagacgcgattgcttggacgaaagataaaatgagccgcatgataagagaaactgaggcaaaggggaaaagacctgctgatagcaaagtcgttgcaacttgcaacctgtcgacatgggcgaagatgagggctctagtactagtctacctaccattagtttacagtggcaagcaattctggggctcatctctcgctctcgctgacatcctggcgaacgagggccatatgaccggggggtcaataatgccagaaggcaggccggtgcgaaagcagatagagtttggtcgtgcaatggtggggttatggtgttgacactttgtttgtgtgcctttggatcgaagggaaacggcacctaaaatgaatgggacgactgacggctgatgaattgcttctgggttctgatctcctccagcaatcaggaacatgtatttgcaatttgcaatatagcatgcatgtcctcctctgaaacttctgatagtcatgccgcagaaatcaatcgtccatcgacatattcagatacgagttcccagttcacacgcgatgcaacatgcaagaacgaatagtttttgttcctgcacgattgcaaaacaaagtatatcgcgggtataatatcgtccgccaccaatcatctacgcgaaggggtcctaaatttttataggcatgtacaatggctagggttttttaacaccctgaaaattcgacgacaaaaatctaaactctaaaatgcggattttcaaaaactttttaaataaattgcatcatgccgattttattcgattattttattggagtttgggttcggagtttataaatcgcgaataatggataattggttaggaataaaccctaaaaagtaaatggacaaagtaaataattaaagtgcaacttaaaataagatttggtgaggatagaaatgagtaaaatattattacgaccatatttatatccatcaaatttaaaagcaatggaatgagaattaactctaattaagttcaagtaaattacaataataatatataaaacatggaataaattaatctagaatgaatccatggattggaatggcacaaatattgagtatacttcatttatgcaaaatttggaattaaagaatcaaatttaaataataaatgggccaaaatcgggttaattagaaaacggcactgttcattgcacctgaagtgttcgacgaggtctcctagtcctagcccctcctttgccgcgttgccctcgcgccccgcgcgccgctccgcctcccctctgccgacgccgtcgccatcaccgcacctggccgcccctaaccccgcgccgccgtcgccgtcgtttccgtcgcgtctccgcgccgccgtccatcgccttgcgccgcgcaccgccgctaccgccgtgccgccgcgcgtcgctcgccgccatcctgtcgcgccgtcccatcgcaccgcgcaccgtcccgtcgccactgccgagccgtcgccgtcgtcacctcgcgccccgtgccgcgccgctcccccgagccccgtgccgccgctgctaccgcgccgcgccgcccgttccatcgccgcgcgccgtcgccgttcggccgtcgcgtcgccgctaccgcgccatcgccatcgcgcgtcgcatcacctgccgcgccgcgcccccgagccccgtgccgccgctgctgccgcgccgctgccgctcctcgcgccctgccgcgtcgcgtcgtcgtcacatcgccgcgtcgagccccgcgccgcgccaccccgccgacgccatgaggccgctgcccctctcccctcttccccattatctctctcccccctcccttatataagcccccctactcccactcttccccttcatcctcacctcctcgcctctacccacgccaccacgccgccgcctccacgccgctgcgccgtcgcatagagccgccgcgccgccgccacgaagccgccgcgccgcgccgcaccttgcgccgacgtcgccaccgtcgccgtcgccgccgtcgccgccaccgccgtcggtaagctgccgcctccaccacttgctcggccgccgtcgccgccccgggtagcagagagccgagagagagagagagagagagagagagagagaaaccgagggagagaaagaagaaggaaggaggagagaaaccgggagggagagggagaaggaaaaagaaaagaaaagggagagagagaaggaaaaagaaaagaaaagagagagagaaaaaaaataaaaagaaaggaaggaaaaagaaaaagaagggaagaaaaagaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacggtagaaattcggatttaatcactaggaattttagacgtatattatatttagtcgtttaatcctagactaaaatttaatcgtataatattataagataattttaggattccgtccgatatttagcttgtgatagaaatttccaacctattatatggatataatgctcgggtagattaaattaaaaacttatgataacaaaatatttatacccgcaaaatagtttaggatataaaaatcgaaattgggtttgccctagttcgcgaatagtaaagttaatataaaagaatcgacttacgcgttcgacttccatttggatttatttggatttttatttgaattctaaccgaattcaaatcaattttcgcacataactatagagcccgagggagttgcggatccaagtgaaggccaagacccgcaagactttgagcaaggcaagtcatcactattccttgaacatgttgatcccaattgcgaaattgttttgtttacaaataaaattgcatgcaatgatgaacatcctacttgtgattatgccatgccttgattattgtttgccccttattccttcgtaaccatgtttacgtatgagtccctagtcaattatgacaattgcttagaaatgctattctagaatcatgcatactcatatttatcaaatgatgcttgggcaattacttttgggaaggtaattgagatgcggcatgtggagacatgagcgccacattgccatgatgttgatgacatgatttgtgaaaggagaaataaaattaaacaattgttttcgactggggcggacggaggatttgggtggtatttgggaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctaagtgaggcaggtgcgctacgatgggatagccgttgaggtagggccgagaggcgtgccctacatcggtgtcgccattggtaggactgccatgagtgtgagagagagagaacttaacttgaaccataatttaatatgtgtgagacttctctttcccgggagcgccagaactcctcacactgctagaaacatggacgcctagagtgcatgaggatttaagttcatggagcggatactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaatatggacgtcctcagaaaaccataacgactcaatggcgggaagctatccttgggatcaaaatggatggtggacagaaccgtcattgtttaatatgaacactggtattaaaacttgatcagtctatgctaggtcttaggcttgtgaaaagaattacaaaacttgctttgtgcaaaagaaccatagccatcctttgaattcctttgtcatgtgcatcattgctgtggtggcttgctgagtacggttggtactcacccttgcaaatataatcagaagcgggagatgaagcttcggaggatccctatgcctactaccaggagggagatgaagacgatggcgctcagtaggtcttagttacggtcgttgcctgtggcaatggtgtgccgctgccttaactccgctgccttacctacttctgtttttggaatgtattccggaccgctcagtccgatgatttaagactgtgcatgcgggcttatgatgtaataattcgtactagactctcgtgtatgtgcacttgatatttcagctatgagttcgtgtgtaccagactacttgatccaaggaaatggtactgtttacacgattgattcctgttataaaaacgggggtccacagttttcctaggagagaagacgagggagtcacccgcggcgctccgacgatcgccggcggtgattcgtggcggaagggatggccttcgggagttgggagagtgctcctcggcgcgcgagagagtttttgatcaggggagggaggaagcccatggttttcggcccgatccaatagtgagggagagagaggtggaggggcaacacgtgtcgagatccaacgatggcgattttggggatcggtcgaacacctttgagtcgactctcctgactccgtttctacaccacctgtggggagctagtctcgaggagctagggttccaggacaggtggaggagattggagaagagggagacgcaaggggaggtgagagaagtggaggagtggccaagggtaggcggtggtgggcggcggcgagagtggacggtgagcgttcgaggggacggccggagtttcgcgaaggtggtaagaagcggctctccaatggcaaatcaaggcggaggatggaggccgcgtccacctttcaggccgcctaatcgattctggaggggagacgcagggggaaggggacatatccgccctttgcagattgggcgataggagccacaaggtccacatccgccacctccagatctaaatcgaggagtagaggatgggaaggcaaagcatgaggaaattctgcaagttgctgaggagaaggggaagcaggggaaggacacgctgaaaactgaagggaggaaggaagcgggtccaaatttgcaggaaacaagtgctaagatggattctatcagttcaggattggaagcaaagccaaattagcaacaaaatcgagatgagtccaaacattaggttggtgaatcccattcccagcagaggattttctgttctaaatgcaggagttacagtcatttgtctagagattgcaaattgtcagtgttctgtatgatctgtgcaaaagagactcataggacagaggattgctttaggaagaatcagaagaaacctgtagctaaagtagtgggatgtgctgccccaggtctggctgtgtgctgattcagagtgctaagggtatagtgcaaaaagaacatgttaaccctttggctattgtgacaattatgtgggtaggtgatcttactgagcaggctttggaggaaggattcactcaacacttcaagtggaactggacttggaaggccaggatgcaggagaaagggttgttccatatgagattcctaaataagatgaaattggatgagttagctgaatttgactcaattagagtaaaaggaacatctgtacatgtgaaagtgaagaaatggactcaagaagctgaggcagtggggaggttacatgaagtgtgggtgactgtggagggggtacctgatgaaatgaaggattacgaccctctacatgaagtgggttctaatctaggacctgtgatagaagtggatatggtagctttaaagacaaaggatgtggttagaattagagtaggaatgatgacattaaaaagcttgcctctgaccatgactctgatgacacctaagttgctggtttacaaagctcatttcaagttggagcagattgtggagttgggatggtttagagattgtgcacaggaaaagagagttgtggaggtggaggagcaaaatgaacctggcaacataaatcacatgcagaggaataagaaaccaagaaaagaagaagctgcatcaaacatgagagttttggaaaaggcaggggacaagaagaaagccatagttgtggaagaggattcagacaatgaaagtgctcaagcagaattggtgaagctcaaacagatggagatagatagggagatggctctgagagtacaactagaagaacattttaaagtcaagcagattcaacttgataaagatgtagcaggagggatgatagagggtggaatcagagaagaagcacaggctggggaggaggaaaatgagaaaacaaagaagacacaagaagggatggcagataaaagtggtactagccagagagtggaaaatgacagtgaggaggtgatttatgatgaagatgaaccaagagtgcaactggtggggagtgaggagaacatggaatcacaagaatcaagtgactttgctgtagcggtgggagttgttctgtctcaaactaatgaagacatgacagaggagaagaggaagaaaagtctaagacttttggagaaggaagaaaaaggtggccgatgttgcagctgaaaggaaagaggctcttaatgctttcatcaacaaaggtaacaaacaaatcccatctatagttgatgaaagtaatttctctctagctcaaatggctagtctgttaggtgttaatttaggatgtgctctagaagctgcggatacaaatctgaacctaatcaaaaatctggaattggctaggataaatctgttcttgaaagagaaactaaatacttctcagaaaggggagtgtcaaaatgttggggagaacttgagtgacataaacataaatatagatgaagtcttacattcagatgattgtatgtctgattttgattatgctgaaaacatgttgaggctttctcaaagcaattcatcaggtaaaaagaggaggaaaaataacagaggaaaccttgagattttcaaggtcactcctaaatgtagtggcataaatgagaagaaaaaaacaaaaaagaaatcatgaaaggtttattttggaatataagaggtatgggtgatcatgataaaataaagcatctcaatgatttaataaaagagcataaagttgatttcattggcatccaagaaactgtgaagcaggatttcactgctaaagacttggatttaataggaggagggggtaagtttagttggaattggaccattcccaagggtagatctgggggtatgttggtgggaataaatgaagacaaaatggaaattatggaagtttccaagaagaattttttgttgcatgttaaagtaaaaaatagaaatgacaaatttgtgtggagattaataactgtgtatggggctgcccagcctgaacacaaggaggagttcttgagggagttagctcaggattgttatgggtgtgatgaacccctgttaattggtgtggattttaacatcctgagacaagagaatgaaaaaaacaagaggggaggggtgaataaatggagtcttatgttcaattctataattgagaatgcaaacttgagagagatggccttggaagggaaaaaattcacttgggctaataacaaacaaagtgtaactcttgaaaaattggacagaattctttttaatgataaatgggagattaagttccctttggcatgtggaagggtcttagagagaatttactctgaccacactcctcttttgatcaatgttgagggagaaaagtggctatctcctctgtttaaatttgagaatagttggctcatgagagaagatattaatactgtggttgagcaagtatggaattctt

SEQ ID NO: 48115 - DNA, 12535 bp, Oryza sativa
ctgattaaggataacttgatggaactaatcacagatttcatgaaaagaaaaattagagttgagagattaaattatggtgttataactttgatccctaaatgcaaagaagcaagaatgatacagaaattcagaccaatatgtcttttaaatgtgagtttcaaaatcataacaaaaattttgatggaaaggctggctgaggtgattgaagtcttgattgctttgaatcaaacagctttcataaaaaatagatatataatggaaggggttgtaactatgcatgaatttttgaactcaattcatcaaaaaaagcaggcaggaattctgttcaaaattgatttcgaaaaggcatatgataacattaagtggtcttttgtgtattaaatggtgaaggccaaaggattccctgacatatggtgtgattggatcttgaaagtggttaaaggggggaaagtggccatcagagtgaatgatcagatagggcactattttacaacacacaaagggttgagacagggggatccactctcacccttgctttttaacattgctgctgatgctttaaccattcttatcaaaagagcagagcaacagggactaatcaagggtttgggaatggatgtcatgagagagggggtggctattttacaatatgcccatgataccatatgcctgatctaggattctctggaatatgcaaaaaacctcaaattctttctgtgtatttttgagcaattgactggcctaaaagtgaactttcataaaagtgaagttttttgcctgggagaggcagctgagagacaggactcatacagccaaatgttcacttgccaaattgagagactgccaatgaaatatttgggtgttcccataaatcaagtaagaatccataacaaagattggaaacctgtagaggaaacaattgaaaagaagttggggtgttggcaggggaaactcctagcaataggagggagggttgctttgattaactctagcattagcagtgtcccactttatatgatgtctttatactctcttccttgtggagttagagaaaaaattgatttttatagaaggagatttctgtggcaagaagatcaaggtaatatgaaatatcatctagtgaaatggccagtgatctgcctccctaaagatcagggagggctggggattttagatttagatgtaatgaataaagctctgttggggaaatggctgtggaatttggagaatacagaaggtttgtgacaagacatgctaagaaacaagtatttgaaaaagaaaactctgactcaaataaaacataagaatggggattctcacttttggtctagtttaatggagatcaaagagctgttcttgagattttgtgacaagaaggtggaaaatggggagagtaccctcttttgggaagatagttggtgggggggggtaaaccaattaaagagtctgctccagatctttataacataaccttgacaaaaaatgtgactgtggcagagatcaaaaggagagggttaggctcaatcaaattcaggagagacctaaatgcagttaaacagagaaaatgggctaatattggtagagccctggacaatgttagtctaactaatgaaaaagacagactgatttggagactgtctagcaaaggtttctctgttaaatctttctacagagctttggtattacaggggatcaattatccctacaaaaaaatgtggaaaatcaaaacaccacccagggtgaaagttttttcctggctggttctaagaaatagtattcttacaaaagataatctgttcaaaaggggttggaggaagggctcgattaaatgccaattctgtgataagagtgaatccatccaacatctgtttttagattgtccgatggctcatttcgtttggagtgttgttgaatgcgctctcaatgtgaagcctggcaggaatgtgggggaaatgtgtagctcctggattttgaaatttggcaaagggaatgggaagttgattatggtgggggttacaacagtcttgtggaccatttggaaagcaagaaacagagcctgctttgatggaattatgcctgttgatcctatagaaatagtttataacatttgctcaaatttaaactcttggagtattttgcagagcaaggagggagacagaggaagaatgcagtggggggcgcagctactaaggcaggtagcaaatgagatctttcactcaaaatttgaatggaggggcggcagacaaagaataggatgggaaacagaggcagtctaaactaatggcaaagagttttgaagacgacgatagaaacctatgttttgatgcttgaaatgccaatgttctagtcctgtaataactgtttgttttcctttttctctcgtcttttctgtaagaacttgatgtctggaactcttgtaatcatctgcgttttctttaatgaaaacgggggagtttccctccctttctcaaaaaaaaaaaaatcatctacgcgaagacgttgaagcctccgtcgtcgtggcgcgcgtaggaagtcgccggtgtgatcgcagccactacgcacccgcacgctgggccaggagtcgctgcgtgcgaatctccccccaaaaaaaggaagggcgccgagcgtgcgtaccggacgtgccgtatcttcggcgcgctccacaggctcgcgtgccgcgggatcactcgattcgatcgtcgcctgggtcgccgtctcgcttggattcttcgcgtcgcgcgagaggccgggagagttcgggcgccgcgcaccacgcgcgcggaggcgggacgggacgtacgccactggccacgtaacgtaacgtgcccgtccgcttccgcgcctcctcgcccgcctgtgtagcaaactagagagaggcggcgcacggatcagatatatggtgcacaactgcacaagtctgcacatgggtggagcccgtgattccggtctcggacgatctggtggatccggagcccacagatatggaagaaacgatatgggtgagaaccagtggattattatttggatttctagaaccatcctatgctgagatttcttcgtcgcccggtggccccggcgggcggcacaccagacaccaaactccaacaccgagggcggaggcgggcgaaatccgtttgcgcgcaaccgacgcgatccatccatccacccaaccagccacgccttgcaaacggccaaaaaaatccagcagacccaccgttttccgccgtctcaaagaaatcgccacggttctcctcacgcaaaaccacatccgcacttcgcgaaacgaccgccttgccaccgcctcgtgccgatgcgacccacgcgcggccgcgccgggacgagggcacggccgtcacttcctacgcgtggggatcaccacaaccaaagccccagtgacgtacgagtactcctgatgtgggtggggccagtgagtcagtgggcggggcacaatgggacccacggtttgggaatcccgggtcgcctttaaagcgagtcccctctccgtcccaagccagtttgccgctctccggctcctccacctttctgcagttctgattccattcttgcaagttctaggtatacacaatcttctctttgttcctgtttttttttcttgcacaagtcaagttgagttgttgataacttggtatggagaaggaaatcaaaggctggttgtaattttaggtcagggttagatttgtttgatctgatgtaagtcctaatcaaaatctttaattctgttaacaccttttatgacaaagagatcttgtaattaattgctcattaaagccatctttaatggtgtgcagaactacagaaagcagggagtaatggcgtccaactacgtggacactgctggggaggaaggcaggttccacggccacggccaccacagcagcggcacgacgccgaccggcgcggcggcgtcgccgaagatgcggaggagctggtcgtccgccgcctcggcgtcgtccggcggcggcggacacgggtccggccccaagtgcgtctgcgcgccggcgacgcacgccggctccttcaagtgccggctccaccgcagcagctcgcacggccacccgtcgtcctctcccaccgccgccgccgcgccggcggcggccgtgcagtcctcgtcctcccgcaccgtcgcggcgcagtgacgcaagaacggtctctcggaccaagaaacgcccaacaagaagagaggagaaggaaaaaagaaggaaagaacataatctaaaccaaagaatatttgtgtcattcataagaaaagggatattatttggttcctcccttgatgtggtgccatttggaaaaaaaaagtcccttttttcccgttctttttcccatctttttgtttgggatctccattgaagaagttgtctgcttttcctctgtcctctcgactattggaaattggaagcattttagtcatattgttaagagtatgtgtggtgctctactatgtaattaacatttcagtaagatccatgcttgttgaaggtgttgattttgttcagacgaatggatatcctggaagagcatttctagtcacaaacagatttgctgataggctgatacaaatgaaccactaaaggataacgtagtagcaaaaaaacggagtagatttgttggagtagaaggtagcaagcacaaatatctggcacaatcaagagagggtctgttggtggttaagctgacttctctgtcaattcctgccatcgtgttttgtgtcagttttttaggttatcatgtgatgcttctgcagcatgctgacaaatgctgcagccacgttatcatgttggtaatgtaaaccactagtagtattcgctgaacaacaacagaacagtttagtagtaacaatgtagtactccctccgtccacgacgtttttcaccttttatttgtaacgtttgaccattcattttatttaaaaaattagtgtaaatataaaaaaaattttatttaaaaaattagtgtaaatataaaaaaagataagttatatgtaaagtacttttgataataaagcaattgacaaataaaataaataataattctaaatttttttaaataatacgaatgattaaatattaacaaacaaaaactcaaaaagacaagtaatatgggacggaggtagtagtaatactagatcagttcttgcgcaaagttaagcaggagattgttgccatgccatgatccgcagttaccctcaattttcctgtagccttggagtatttttttttcttcctgtagactgtaatgccttatatcttatctagaccttgctttaggagcacaaatgcccttcagtgtcatcgactcatcatagtatggcactatacattagatggatgtgatttattggttgggtgctcatcctgtgttatcttggtgtctgatcaactcagccaaccactagttagagcaaggaaaatagtagagctcactttctactattagcacatcttaaagccaatatatatataatagattagctataaggttggctataattttctcctcctctctctatctctcacctatacatttaatgtatttatctaggagcttgtgttaagctagagctaacatccttgattttttgttatctctctcctctatataagtttataatagatttatagctctatgttatacttgctcttatttgtgctggtctggattttgtcttggtggtggtggtggtccagggtaagatgttaggcatagtactaatctagttcatattttcacgagataagctgcagcaagttcgatattttactttactgaaacgtggttaactcattatcgggaagtacttttgcaaaacgagataagcttcagtagaagtgtagaaccagtgaaatgagaggcttgagagcagaccagttcactgtcaacgtgctttctgcatttaggcccatcagcaaaccatgctctttaggcccatttgtaatcagcaaggcgcttttgatttgaaggaaatgcaatactccaattctatagaatattttcctttatgatcggattgaaaattattgaaccctacaaaattcctgaggtttggaggatttttaagatgaggtcaaatcttatggaaagtttcctaatgtatatttctctcattcaatttttatgttttataattttttttttgttttgcacatatattcctgttaaaattttatattttttctcttcttccgttttctaactatgcgtttgaaagaaaccctaaggccccctttgattcaaaggaaattcataagaattttaaaagatttcattcctataggaatttttcctatatagccctttaaatcaaaggaatgaatcctatgtaatcccatgaaattcctatggaatgcctcttgccatgcaagttttggaggaaatttagcatgaggttctacctcatgttaagaattctttgagtctttatctctcctcaaattcctgtgtttttcttgcggctcaatcaaacggttattcctattattttcctgtgttttacaatcctctgttttacacttgtattcatgtcaaaatcctatgtttttcctattcctccgtttttttattcctgtgattcaaagggccctaatcaggagtttcttttcttccgattcacgttgcatgagctgagcgaacccagaggcaaagccttgataagatggtgccacgtgatcgttaggaaatatattcgttatcttattttgtactggtaccatgagctgttcttgtaatcttgttggtgaatcaagtccagagaacaatgatctgggtgcgattatttggaagaaaattcaaattaagcacgagcttctgacaaaataattacacacagctaactatgatcatgcatctccctgaatatctggaacggagtttatctctgtctaactgcagtacagtacttctcttttgagcatgatggcctttgcttacagtcacattactgtctgcaaggtcagtgaacacagtggacagggcacgcctgcgacaccatcacatgactgcataatcgcctgagctgccccgcatgtgtccgtcacagatctaccacgctggtgatttctctgcactgatccattgctcaatgagccgtgaaaagagaacaagttcagaaagagaaaaggcgcaaatgctcatgccagaagcggtgtcatgtgaaagatttgttgatcttctgaacaaactctttagctcgtacttccatgaatgtccagtgacttgccatctgcatcaccgactcgccgtatcaagatctctatcaagtagggtgcatgcctgaaatgaatcattgtggggaaggaaagactgcaccttgcattgccggagcagtaataaatctgtcgatttgatcctcgcgtgctgcagaaatgacaccgggcgtcgtggctgcacagcagaacagcacaggggaacgcgatcttttcctgaaatcggatccaatgccatggttgattggttgttctactgctaatcatgctttttccctggcaaaaaggaaggaactttttcgtgcatcatggagattcgagggaggcatgctgcatctgcagttccaattggagggagcatcatttgcgtactgtgtttgcgtctggtgtatgcgccttcttttgcttctctgtcctggtggcacctgtgatcttcttggaatcttggtggtggagaagaatcatatcattctgtaaccactcctttcagaggaaagtttcagttctttggtggtgacagtcaggcgaatcgggtcttagttaacagaaaagaagggtccctgctatctctgaagatcgtgcgtccatctgtttcagataccgagtgatgctgcaggatacttcttcgattagtgcatgcttgcacagagcacagtgccatgaggccattcacaatgcgtcatgggtttttcctggacctgagatgccacgttggatggaactgctgctaagcaactccatccagaatgcaaagcttgtactccacagtataagctactaatgggtcccaccaccaaacacttttgctctctctctttggttcagattttgcagcaaggaactcggtaccaactttggtcacacggaccaggcaaagccacgatccccactcttctccctcctccacgtaagccaggaacaacattgccacacgccacatcgccgcattgtaaatggcttgaccgaggctcccttggcaggccgatctagtaatccatggcatggaatcttttgaaccacagttttttgagatacattgtgtggttttaacctcacgatctcatgctcaatccctaacatgctcataatttctttaaaaaaaaatatttgaagagatgtctctccctccaaatctccttttttttatccttaaaccctaaacccaataaattattgtatacacatttcagggcataaaaaccagggttttaaatctcctgttatagctgtttgaaaagagttctagctatttgatctcatatacaatttgatcgctatagctccatttagcccactataactgtttgagaaattaatcgctaaatgtcttagcccgctatttaaaacattgataaaaacacagattttcagaaagcacagtacatatatagcacatgttcttaaagtgttttctaatattcagacaagttcaacgcatcgcgaagaagttaggtgccatcgtccagtacatggtccttaccaggatcagctatgaggagtgggtgctgctcatgacagtgaaggtgatctctgtctgatttctagaattcttattaggcacagcacaagggctctaataggccatggagccaaggaggtagattaccaggaggataagctcacgctacacatcgtaaggaccatgccacctgagatgctcagggcactgtccaccaaacagacggcgtagtcagcatgggaggtgatcaagaccataagtgttggcgtctaacacatacgcgaggcgaaagagcagctgctaatgcaagggattcggcgagatcgagttcaagaatggtgaggcaggtcagtgatttctccatccgcatcaccggtctagccaacaacatccgcgtcttcggtagcaacctccctaaagctgatgtactgaagaaatctctgcagtggccctgatcgaacatctatctcgctggatgagtcattgacatcggggagtatatctcagttgcgatcacgacctaggaaaaatgttcgaggagaacttgtaggggttcttcaccacatcagctttgggggatcgtcgtccaacatgcagatgctatcggcgaggacagttcatgcgtatggagaaatcgtcgatcgcctcgccgtctctcattatatgttgccctttcccctcgcatatatgttgagaggctaagatcaacatgtacggtcatgatagcctcacatgccatttgtatctcccatttggtgtacatacctgagcatctcaggtggcacgacccatgggatggcggccagcgcaggactatcctgctagtagttcacctcctcgtcatcgtcaggctcaacggtctgccgtagcccttattgcctacaagttcaccttcatgagcattgtccactcctcgtagttggcctgataaggaccgggtattgacgttggcacctgactccttcacgaccacgggaggaaaaaaagctcgggctcgtgagctcagctttggcttggctcgagttttgtttgtttggctcggctcgtaagccaaacgagccaagtccaagtctcttttttatctcgttgctgaaatgaatcgagtccaagctggctctcgagccgcttgttttggctcgcgagtctaggccatcatgtgtttatattgattattttattttttatagagttattatttgtcaacttaaaatttatcattaagatttgtaagaattgatatataaacttatttaatttttacatattgatgatttgtttttgctttttttaataataacaaaatatatatgaagaggtgtttcaacaggaaggattgcaagccagctcgagctggcttgaaccaggaaacgagccaagccgaactcaagttttagcttgtttttctaactgagccgagccaagccaaacctagtttgttgcgagccacttcaagctgagccgagcctagctcgtttccacccttattcacgacgcgccgccaggatgatctcttgtgtgcgtgcatcatggttgaggctacagagtgggggccaagggagagaggtatgacgacacatgggtggtgtgcaggaaagccggttggctggtgtagattgtgccgacacggcatcaaggtgcaatttggctcttagagcaagtttaatagtatagtccactactggctccaattcatctataccaattgttacaattgagaccagaaatcacaaacacacacgtgttggaagaatgcaagaacacgcaaagggctattggtgagttgcagtgttttctgttgcattataagaacttaagtgcccctttggattgtaggattgaaaaaacgtagaaatagaaaaaacataggattttaataggaatgcaagtgtaaaacagaggattgcaaaatgcagaaaaaaaaacataggaatgaccgtttgattgaactgcggggaaaacgcatgaattggatgagagagatagactcaaaggaaagttatcaagaggttgaaactcttgctaaattttctctaaaatctctatagaattatccattccataggaatttcaaaggattggatatgattcaatcctttatttcaaagggcatcataggaaattttcttataggattgaaattctccaaaatacctttttcctctaattcaaatgagccctaaatagactacatgctaactgtttctctaggcgttccaggccacgcaacctacaattctgatatgcttaccatgccctccaacttgaccgctccatcatatcgccgagggcatgtgatgcacacaatgttgcctaggactcgggactattttgacgtgctccatgaactcgcttgggtaagaggctatcgacacgacacaacgaccaaacctaatcttactttttgattgtttcaatgagaaaattattgaaagggaaaataagaattctagaaatcagacagcgatcgtgctcaacgggaaaaaaaacagagaataagtagtaggattgattcatcacccagtgtttatgagcatcttctattctgaacttttctgaacattgctgggcctaatcaacgcgggccgtgaatttaggtgatctcaccggcaatttagcacgcctatctttaaccttcaccttcatgcatggctttactttcactggttcacaactagatcacatgcaaatcgatctaacagaaaagctaatctttctgttgcctgaatccagatagccttatccatgatctatatatctgtcacttcagagagtgttcgtttcaccacaattctatcgctcccgcgaagcacggtgtgcctcgccgtgcgattgattcagtcattcaggccatgttctagagattttgtaggatctccattgctacatatgcctccaaggtcttgacatgcattgatgcatacctaaaggtcttgacaatgtatgtgcagctcatgattgacaaagcctgcatgcttgatgaagatgacgccatactgtctctgtaaaaaaaaacccaactttttttatacaaatttggatataacataggtctagttgatttttttttagactgagggaatatgtctcttacataacatatcttgaatgctgataattttaatcagcaaaatgttcttttcactaccctctgctagtatattttaagcttgtggttgtgctcacatatactgaactgattgaatctggccctgcaagctacaataactaaaatgtgcatgacaagatttgcgacccttgtatttaggcaattaactgccctttcgactcatcaatggtcaagtgacatactgacatatactagatatttgataaatgaaagcaaatacaataccctcattccattaaaaagtaataaaataaaataaaataaaatcaacaccataccctcacagcccactagtccacagagaacatctcgccagttgcatcattggtcattatcaacatcgtttctatttggttgaaaatttttacactagcttgcattacagcattggtgaatcatctttgatggcagtatcgatcatcatttacagattaacataaagcaacttgcagtaataagtaagatcacaacaaagttgactatttttcgacgcaacttccgtgatgtcatatatgggtgcttaattcaataggaatgtgcaatatatagaagttcataacttgtttagagaaacacacgttaatgctaggagctatatatgcaggactaaccagatctctgaatttttcacattcttttatacagttaaacattaagggtcccattaaaatggagggcttgcaaaagatctttggaggattcaactttcggattttaccctatattc

SEQ ID NO: 48116 - DNA, 1821 bp, Oryza sativa
gtccctgatatcaacataactccaaaaatggagcaatgatgctaattatgcaaaatataaaaatcatcaaaggtgtaatttctttcaaaagagattattaactgtccctgcatctacaagatactatagagcttaattaattaagtctaagggtgtaataatatggaatatgcatttcagcgcaaaagaatcttaatgctaactatttcatattttaatactaaaattataaaactgataatatatttcggatgatacctgcttccttcgctgctttaagtaaaagttgctcaatgagatactttgcaggatcaccaattggattatcatgcataaattgataaaccaactgaacaacttcgtcattgctgaagaaatcaaataagccatcactaccaagcacaacaaacaaatcatcctctgtgactttatgactaactgtgtgaggatttgtgtacacataaggcgggctgcacaaattacgaactcggagaattcccatgagtgcatcgttcaacttcttctgcaaattgacatgtaaagcatgtgtattagtaaaatcataagaacagagatgcattaatgctctttcttcccaaacaaaattatagtacgttacctgttttagatagccaactccaaaagcacgagtaaccttcagcttcccctttattttgttacccatcacaactgatggctcattaggatgatcagctaaaagtttttggtactccaatggattttcaagtgagtggatctcagtcaattgaacagccttcaatttatccattcctgaagacggcactgaagcaagcacagctctactatccccaagatttaagatgcacaaatctgttccatgtagaagcacaaccagaacacaagacccaactgatactaaatctggtctatcgtccatctcttgttcaaccatgcataaaaagtcattttcagcttgctcaacagcagtagtgaggcacttaagcacaccagctcgaaatgtttcagaaaatttcacatcttcattttctgcaaatctcatggccagtgttaactcacttttaacaccattaagagagccctctggtgaaccatatagaccattttcttgtttaatccggcactctaacaaatataggtaatatactatattatcatataaagttactgccaaaaagtcagctgcatctcgtccattaaatccatcatatattccacaaatcaaccatccattcttctcagagcacacagcttggactctatcctctccagcagctccaccagccatttttatctctgtacttgtcagaaaattggatgagacagtagttggggcactggacctccagatatttttactgatttcaaatatagagctctcagtcgatacagggctgccttgtgaggtggataacaagtccaatcttgacattgatggggatgaaacaatttttctgaaagaattaggagagtctagttctggtaaaatttcttccccgataagacccttgcaaatgtttgtattggccagcgtgaaattggcactaatcgcagcaccagacaaacaagtgaaggatccattttgtgatgtcatcatggtattagtttcaagcctcttgttgggagagatgtcatactcatcagtgtctagagaaaaacactgataagaattacaatggtatccaaagctgacgttgagattgctataactcctgacaagcatgtcttcttcctcagaactgatgctgtgatcattggagctcttatcaaacagttcctcatccaccatctttttcaacagaagtataacaccgattgtag

SEQ ID NO: 48117 - DNA, 2792 bp, Oryza sativa
aaaatataagcagggaaggaatcgatgagacgccccagtagtttgacatttgcaactggtaatattatcccctaatttttacatgactgcaacaacaattttagattaattatacaagactgtaccttgttaaatatagacggcatcattttatacatatcagaattttattttcataagctaccaaacatggcaggcacagtttgcaaagttcttgaaaaatgaggacacaacccacataacataaatttcaatgagatctactcttaaaattttcttgtctcccaccaccaaatcaatcaagaacttcatcaggaaacagaaactaaggaaccacatacggcaacagaactcgagcggagggattagagacagattagccggtagcaacaacctgaagtaagaaggggttgcttctgttcaaggagtgatcccgcatacgacagggccaggcaggtcgatgaacttcaccacagcggctatgaccagtgttcccacagaaactaatcttcttggcgttcacctacacacaacaccccccgaacaacacagataagagaagaaagaagaaacagatagaagagaatcaacaagaaggaacatgcgcacagcgcagacgatacgattactcacagatgcatccatcaagttcagagcgatgggaatcgggccagttgacgcagcccctcctttccccccatccctgaaaaccccaaccccaaccagcgaaggaaaaaaaaacaagactaaatttttacccaaaaagctcccttctttctttagccgcccgccgacctgcgcagcgcacaacacggatcaacaagaagcagcacgcgaaatagggaagatcactagaacaggtcgcgcaccccctgcaacagaacgcaaaaaccagacgaaacctgagcgcgattcgcttacctaaaaaaaaacccggttcgttttttttctcttctcggttgcaaactgcagatatcagctcgcgggccaaagaacaaggaagagcagaagctgagaggcggaggaggaggaggaagtggcgggtagatgcagacgggacgggtgtggagtggagaatgggagaaattgagaggaaggtgtgggcttgcggggaatatatcgaggaggtggtggctcagctcagctggtctggtggaaaagagagagagagaagcaacagattcattctccctttccctcctctgttttctattttcacggaccggataggcttagaatctaaccacgtcgctcggtctccacatcggaatggttattaaccatctcatctacacaggaggattggggcgccgcggccgcggatgaagagagatcccgttctcctttgtacttatttttttcacttaaaccttggggtgaaaatttacgtgggtactcagttgataggtgggttcgctatattttaacttttaagggtatatatgtactttttttttgttattataggatccataatacaaactccaattgatatcataatataaattaaatatcataagagccgacacgtagattatcagttctgaaatataaaatatactaagaaagtaagaagtggtttttattgtaggtaggtttttgtgtagtattatcctatatggcaggttgagattactagtacgagtgtctctattgtacgtgccctaaagtagcttcctttttcagttttttccagtcataaaaaacacaccacgagttatgataaggaagatacatgactcattgatcaaaaatttgcttgagaagatcaggtcagatgacgagaagttgcaattgtgacacctaagtacctaactagaggtggaggaacgttatgtgttcaagcctcgatgggtgcatgacactaggaatagaacaaacataagctagattgatctatgatagattttctattggttcttatgtgcttttgccccctctggttaaataatactccatccgtactcgtaaaggaagtcgtttaggacagcgacacggtctccaaaacataaatttgacttcttttttctataaaaatatttattgaaaagtgatatatgtatacttttatgaaagtatttttcaagacaaatctattcgtataatttttatattttcaaactcacaactcgagagttattcatgatttatattcccaaggtttgacttaaacattatcctaaacgacttcctttatgagtacggagggagtagtacctaagcaagtgagttaggattcaaaactcaatttgtttggcatatgtgactagtcaccaggattcaccaaacaattttaggtggggttatcgctaccccaccgtaagacggttatcacggtaaccgtgcggttaccgtgagggttaacatggtttcaaaaacttgccccttgcctcttgctacacgtttttgcaaaccctgttagccacttgccccttccagtcgatgggggttgatggtgtcaccacgatcaataaccttaagattaacaaaaatgtattgttcatgttgagcttaaaccatctctaataaatttgtacctaaaaagtggtcgaaaacctaactttttgtagatttatgctaaaggtcaaacgcattaacgactgtggatatgcgggggcctctatattgagctgatgtggtactatatgaatctagagcatttagaatagtccacttagtccactatggattattgaccaagcaattattcttattcatgtatgaggagatcgatataatacattcacatctctatctatttagtagaaatatagataaatatatttattatt

SEQ ID NO: 48118 - DNA, 5088 bp, Oryza sativa
tgacaacactttcaccaaagtactccgaatctgtgataattgaaggggtgtattttgtcaactttttctcagcaaacagaaaacatttgaaatcactgtcctgtacagttatgacaaagctagagcatggtttgtttgtttgtttgtaatttctgcacaacagtcatgtccagaactagaacatggcataatataatgcaaataacgaaaattaggaataaataagtgatgaacgaaatgcataatagttacatccgattatcattcaataacatgatcaagaatatagaattatactactattaaatagtagtagaattcttatttgaccttattaattaagggcatacaattaaagtgctccagttcattttttatatatactaaattgatgatccattaaaagaattgaaaatgatgaatcatatatgtgtgagagggatagttttgtttggcaaagaaaactagcaaggtggtcgtgcagatcgtgtggctaacattttctcatataatggtaagtatgtttttttcacacgtaattgcgaaagaaaaaaaatattgcaagtggtaatatagttttgtgttctgccacaacttgagaaaacttttacatctgttactctgattagcagggtaattcctaatttcctatgcacacaaagtaaacatgatgactctgtttagtattttcttaacattataaaaacatgatggtatatttgcttctctcctttcctccatcttcctctcccattttatttctcaataaaagtaaatcatgtctcgagaaagaaaaatggaagaaaaaaagaaaaaaatgtctaaaattctaaaatgacttatatttagaaaagggtgaatagctaatttagtccctcaagttttaccgaagactcaatttgattcttcaggtttcattttgtccacataggtaatctaagtatttgttttggatcaaaatcatccttgggtccacttaatatgccatatggctatttctagtcaacaattctgttagaaaatatcccttttgcctttaatttgcatgcaacactagaaaaaagaaaaccaaaatgaataaacaacattgcatatatacttccaattatttcaacatgtgcacatgaaacttaagcctaatggctatcatatacacttgcaagtacataatttatttttgtttgacataaattgctatgaattatctataaaaagaattcattgcatgcaattttttctcttatatatgtgaatgagggggtataactgtcatttattttggttacgtgggttcaaggataaatttgaattaaaacaaaaacttgaagtactaatatggatagattgaaacattaagaactaaaccgattcttacatgaaatttagatgaccactttagctattcaccctttagaaaatatctctgaaggctaaatgttttcaaaatggagggagtattgttgagtgtttataggcagtgcatataatgttttatcattaggtgacgtggatagaattaagtactttaagacagctggagatagtcgtatttgtacttgtacatgtcctgagcaattcgtcgtgacacatgcatatacaaattaaatcgtgatcgtcaggttgacctagctgatcattacctacattgtgcatgcaactgtcacaaattattgatcaacaccaagtcataatttgaaagcgatccagggtgtggggcctgtggggggcttgaaggccattatgaattcaatcggccaataattcttggcgtcattagcaaaacaatttagcatttttcaatccttttttattacaagacttacaaatatactagatctgcataatgtctttttcatcgcgcctacgtcattgcaagaaattcaccgggcccaaactttgtagttgtattaaagtttgtttcaaattatactgtcagcttcagcatagctcatacatgtatttagaaaataaaggaaggatgggtggaattggcaacactaccaactcaaggattctatatcaaaagtttaaaaacacaaggattcctagttaatgctgaaggtttgtttggttataggggactgggataagatgtggcttataatatttagagtaaattacactttggtccaccttttattacctaagttttattttgaagtaccacccataaatctatcttttcaatttggaccaggtaaatttaccattgttgtggtttggactaccataaataacttttctcgtcatatctaacttccctttcggcaaacatatgaaccatacatagaggagttcgcccgtacactagcgttgatgtgtttaatgtcgttgattgtaccaaaaaaaatcgttcatggtggtccaaatcgcaacaatggcaaatttatccggttcaaagtgaaaagatatgtttaagggtggtccaaagtgaaacttaggtaataaaatatagctcaaagcataatacactctaatatttaattaaaccttggcataattacacattgcatatcgattagtatcagctagtaaggtgaaaagaaacatctcagtgttctccattaagggctaaaaattaccgagttaattaattggatcaaaagagagagatccgagtgtttaatagagtgtgctgaaattatatggtatagcctaatcgattggaaatgtatcagagttgtacggtaactataatacaacttgcttaattcagttataaatatttggcgcccacgacaaatttgtcaaacttgaaaattttgaccattaattttctgttaaatgagtttataaaatgtaaggtttatgatagcattcatcaaagctaatctatgcatatctcttttttttttcaaaaaagaactaatcatttcagaaatctatagtaaaatttgaagagtttaacaaagatctggttccagtcatcgaatattttaaccggagggagtacttccaaataggcacgcaagtgtggatgttaaaacaaatgagctgaacacagcatgcctatcctcaatgcaaaaccatgtcctgaacagcacccaagaaattttactgctactagattgagaattaatcttgctccccctcaaacaaccgcgcgtgatatatccacaaaacgcacaagagaatcaatatatctcgtcagatacaaaattacccgatatcacgatcacgatgatgtaaagatcactcctatcctaacaaaaagttataaatagcctatcgggaaaatatcttgtgaaaatgattgaagtgttaaaaactctagttttgtgtacatataaaatatattctcaccaaatctcaagtacgcacccaactttatttgagagaagcaaaaatgaaagatttcagatgaacagtgttaggttactattcacccaaaatttatagttgagtttgaacttgagattctattagaatatatttcttatctactcctatctctattaaactttttttatgaatttagagcaaaattattattcctgaatgaacaagttacacgagccgatgtatctacagacagaaacggcactgatctatagtgcagaattatatttgcattgcccgcggccgatacatcggcatcgacctcaccaatgcatcacggcacaaggacagtgcattgcacctgcccggccagttgctagtgcgcgcttgcagaaaaccctttaattttcatcctagattgcagtcgcgtttccttttctgatcgaagaggaatatatatatatatatatcgaataatttggctgcagccatattgacattgacagggacactagcctagctagatataggtttaacgaccgatatatacatatcgccgtcgctttcgcggcctagttagttaataattaattaatctctcgtatacagtatatgcgtacgtaggatgaaccttctcaattcgtgcgtatgcgttggatctgcatcgatcgatcggtgatgcattattgggtgacatatttaatggcatattaattttatatatgtgtacgtttgtatatagatataaaacaaaaatgaacacgaaagagagagggggggagaactggagaaccttgtgcggctgcgccgcggctacccgacttgccaaaggtcaacgaattctattttgcgtcgctcgcgaggaagaagacaaccgcggcggcgacgacgtcacagagagagagagagagagagagagagagagagagagagagagagagagagacggcaatcggagctgcagatttgattaattaaccagccggcgaattgaaatgagaagaatcaaaaattggggcggcacaaacaaaagatatgggacttgtggcccgtagaatccgtgtgaaatttgcaaggatctaagggcccctttgatttgtaggaaaaatgtaggaattttggaggatttcaatcctatggaaaaaaatcctatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgtttttcctgtggtccaatcaaacggctattcctgtatttttcctatgttttgcaatcctctgttttacaattgtattcatgttagaatcctgtgtttttcctattcctctgttttttcattcctacgattcaaaggggccctaaacggaggaatggtggtggggagctagggatcttgtggatctggacaacatgtgttgcacagcagtacacgttgtctgtacgaacttcacaggaatttcagtattgccgttcttttctttttatttatttttggaagctactctgatcatggtgctggtagggtgtttcttttctttcttttttggaggatggttgtgtttttttttccatgttgaacctaccgtcataatgtgtactgttacatggtactcactccgttctaaattaagtttgaacttatttttgggatagatgtagtatgtgagcttatcatttgaaatgtgtaatagaaaaaaaaacacacacacacaaattaaagg

SEQ ID NO: 48119 - DNA, 2940 bp, Oryza sativa
tggacccttgacctgccttggttgaacaagcactgatcctagcccccagccatgaagttggaaagttaatttccgattacacggcttggttaatacgcacggcgagaactcttacatgaccagatcttacatggtctttcgtctctacaggatccgacaaggccttattggctctgggcgtccccagccgaagatcccttaggttcctcggaggccttgtcaagacggcgtaaagggacagtaggatatgtttcaacgctaggtgtcgttgtggtaagggatctctgggtaaaacacttgccgatattgtgtacctgctatcaactttgttgaagtagaggtagtaggagaaatcgctacaccgctggtcgaggaccaggcagtagtcgtaactcgaccacttgaagtggaaatagtgggagaaacgctacatcgctggtcgaggaccaggcagtagttgtaactcgaccacttgaagtggaagtagtgggagagacgctacatcgctggtcgaggactaggcagtagtcgtaactcgatcacttaaagtggaagtagtgggagagacgctacatcgctggtcgaggaccagacagtagtcgtaactcgaccacttaaagtggaagtagtgggacatcgctagtcgaggaccaggcagtagtcgtaactcgaccacttaaagtgaggcgagaaagatcactacgttttactggttcgagaaccaggagtaggagtctcttaatcacctataggggcgctaaagttggtttattacatgtgcatatcatgtggccagcatgactcatatacccaacttatagcatatccggatgtccgctcgcaatcatatcgggtgatcaagccgacggcgtttgcgaggaattatccgttaacaaccttttctcgagttgtccagtgatggccggtgctatgagataggtcgtcggtcttccttagtaggttgggtgcgataactccgcatttgtcgagaatgttctcgataatggagtgtactcgaccacaacctactcgagtgctcagttgttcctgaaaattattttctagaaggcaagacatatagcagaggatatcgagtatgtactcaaaaactgcatggatcttctagtatcatcaggatataacgagcaaatgtaaatgtcagggattatgtaaaccgtaagcaagcatgatttatacggaagaaaatagagcgagcccccagcattaaattgtagtcgatttaacatcggggacactcgcgcaacagatattgtataaaaaacatgctctaggtaaacgtaataaattatagatctgacaatattgtatagactggaaaaataggtacggtaaattgcatataaattattgcatacctgtgtagatatatgccggatatatctacggaattagtagatcaatttaaaaaatcaatccactaattacctgtgttaatgttgtgacgacctcgtgtggtcaaagcatatgcaacagcactgtacgtaccaatatatatgcacacgcgtacatgcatgtccgggtagacatgtatgtgtattgtatgcataggtgttaggctctgtacagggacatctgatacgcctcctgacgtcaggacgtcgaccggttggtgacgtggcaacgcacgagtgggcaggaaatttggccatagcttcctgttatctcgtctgtcgtcatggtcggttgcgatctgctgcttctacccaggataaccgagtctgatatgagtcaacaaagaccctgatatcggactcgatgccgtcgtcggcgaatatccactcgaggtagtcgatctggccgaggcttcatgatggataacatcaaaatgccgttctccgcgtcggtgacgtcttcaaagcttggtcgatctcgagagatcgaattattgatgacgatggttccgatctcgtcggaagatgtacttggataggttggatctccccacagccgaagtcgtcgagtagcttgttgtcggagagtccatctcttaaacccaactcgtcgaaatcctgaagcaccaaaatccccctacctggcgcgccactgtcgacgtttgatgtctcgactacagtatttggacagtatggggatcattggtgctaggatatacgcgagactgaggtaaaagagatggagacgaggatttttatacaggttcgggcccctgagctgtcaggtaatagccctacatcctattggccgaagccggtattgctcttattcatgataatcacaccagtacaatatgtggggtagcctatataactgttgtcgacatggcggtctgacgatctgactcgtagtcgacaacagggtagccttcctcctcgaatccgtgcccggcgagatcagagatagcgctttcgtctctcctaacagtatccggagacaccgtagggtactagcgtgcttatccctgaagtcgacatccggcggcgtgtcttggcgtatgtaggcttctatgtcgattgtgttaggtgttgatcctccatggtgggtcttgtatttatacccataggtgtccccttatccaagtagaactagggaaaccaatatggatacaatccgagtagtccttgtcgtttccatgtagaactctggttgtctttccttatccggaactccctcgaggtcagtttccgtataagacatggtatgtggtggatcctaccgagatttagtcaactactattaggtatgtggtatccataaccctgacagtagcccccgacttcgatgcaaatgaacgaattcatattctcaaccgcagacttcggaggaactgttatcgagctcatgtgaccgttctcggtgagtttagagataacgttagacttcctttattagcctcgtgcgggcaccgaaagggtttgtctaagtcaatctctgatgtcgaccgagaaagtacagaacgtacga

SEQ ID NO: 48120 - DNA, 26048 bp, Oryza sativa
  unsure (1)..(26048): unsure at all n locations
atttctcagcatgggtacaacaagagctacggtgcacggccactaagaagagccgtcactcagctggttgaggatgttatcagcgaagcaattctgtctggtcagttcaagcctggtgacaccataatggtggacactgatgccacggggaaaccttgcttgagccgactgaatgatcagaccgtccaattatccgatccgacaccaacactttgaaggttcaaacaccctatgtatattcgtgatttactcatttattcttccacaccgataagcaagcttcttgtgcatgcataggttccatagttcatgtacatagcctccacatgctggaatttctccatgcatataatgtaaatttgaatctaacatcaactgtacatatcattgaatttcaaaaggtacttgaaccatttacatgattagatggtccaatacgcatccatttgctgctgtgtccatctagttgatttacgcatcactggaagtggacttgggttctgaaggttttcaaccttcacattacctgggaactgcattactccattcagtctacagtaatacgaaaagaccatcttggccaagcagctttagttctcttaaagaacttacctctgaagaaattgcaagatacactccacacaccgggataacttggaaaaggcccaatagattattaacttataacatacacaacttatggaaagtgttctatcttgacttgcccaattggaaatatcaaccactcagcataagattcaaccgttcaagactaaaaacaggaagctagtaattcgagggtaacttcagtgcatatcatccatctaaatttatcatagtttgatgactacaaaaacgtctatgagctatcttttccaatcacacttctgcctaaagagctcatccttgaaatagctagattgtacttccaagaacacgattttatgcaacttgaggaaaagctggtgccaacaggctgtggcaatcgatttaagttgatttcgttaactcagggtctctgcaaaagtcgtgtgacgaaaattatatcagatcaatgaaactaaatgctacataccagaaatttgtacagctgttccaaacctttgaatgtgatcaaggatgagaagtctgggaccaggggggatcttcacatctctaagtgcactggatcaatataaacatagaattttattattggtaaggacaactttttggcatatagaattttattattggtaaggacaattttttggcatatcaatattttttttaaatacttatgttttttcatctactgtaggaaataaattgaataaaaaatatatatacctgtcattgagtaggggcaatgtttgatcagtaagaagacccttcttgaaattcttctcatagttctgaagccctaattgtttcaacatatttctcccacgggaatagtatatatcttcactcggtggctgcgaaaatttctgaccaatctacaaaatagatttgtaggcaaaaagaattacaactgatatcaaatttatcgctaaaaaggatagtaccaatgggccctaaatcctaatccactgacaggacatcaaacaaaaatatcaactagttgcaatgcacatgtctaatgtcaagtactaatgaaattggtactcacatccagtactaaaatcttgagataattcaagttgtataaaaatggctttcattagaaagagaaacattgaaattcttaccatgaaaaaaccaccttgaaatactgcaaaagctacaccagttgtaattgcattagcaactggatttggagaccccattccactcacaatggagaataaagcgccagaaccaaacgctgctgccatgctatcgaaatgagcacttgtcaatcacgcaggtgaaaaaaaaatcaagtaatcaacacgatttatatagatagtcaataatcagccttccaaacttgtaatatacccttctggtgatagagtcggcatttctttttcggttttcagcactaatttataaattagtttcttaactagtaaagcatttaaagtttatcataagacccgtagatgcttttgttatgtttctatcttgagtttgttgaagattacaaaatgtactcgcaccagtgagtcaagtcttgctcattttgatttaagcagtataatttcttaggtagatttttcataaaaacacagacacgtggctttcaggtttcttacatctaatattagtcagtcatgagtggcttacaccaatattaatttgacaaaagaaaaaatcttagaaactcaaactagtagttatatcgacaactggtaagcaactcacatgtgggaaagaaagaaagggaatatagtatatatgaacagaataagatgcattcgtgcaataagtgtactggctttgctgctactaacgagtatttacatgacagtaaaatagaacttgtgaaccctcacctgccctggacatcctccactcctcttatccttctcataacacaagatattcctgcattagcaccagtcatgacggcaaagtttcgggcttgcaccagtggtccacctgccaaagcctgaaatacacacaaaaaaaagatcccgttattctgattgcttagaggagaacacagaatggttcctttgcagttctttacatcaaggatactgatatagtgcgaccttttagctctacacagacaatcttgaggaacaataaagactattgcaccagtaaaacaaatcaaagcagagtgtttgctttcttaaaatgctaccacatgcatacaaaaagcacccatcttccttttctttaataaagtttgcttccttcgggaattgcatcattattctcaaatttgaacaaaagaaccccgacattgtcgatgcataccagataaccagttaccgtcggtgctttatcaagaaatgtttggtcgctttatattctactataatcctcaacaagcatccaagaaatattaaatttgtttactgcgcccctattattcctattattattgagtatactgtataactacgagatgtatagtataggaagaagacgagacctgcgcctgcttgaaggaggcgagggcgttggggtcggccccgggcggcggctgcggcacggggaacggcgacccgccgtccggcgcgagcgtgcccatcagcccgccgagggcgccgccctgcacggccccgacggcggtggcgacggcggcctcgacgtgcgtgggctgcttcgccagccacgcccgcaggccggcctccagggtcttgacgcggtcggtcagctccgcgagcgggttggccccaccccgcgccgccgcctgcgccgacgccatcaccaccagcggccgcctcttctgctgccccatcccttccatctcgccgcccgcgcccgcgcccgcgctcgcctcgacgacgagagggattggaggtggggttgggggggcggggagaaatgggaaaagatagctgttgggttgcggggcggctggtttatcccctcggatgctccgctcggcgctcgctataaaccctccgcggcgtcgacgaattttcctcgcgaccagctcacttctacccacccgcctctcgtggatcacatgggccggttcttctgggctggggggtggcacgtttctgggctgtgtgttcatactggcctgtgttgatctgctcctggactccagggaagtaggggatcggcgtcctttgcaggaataagtctacttttcctccctcatcttatgcccctggttgaatcacatccctcggctgcaaaactgggtataacacatcccccaacttcaaaaaccggtgcaaatagaatcccccggtggttttaatagcggtttcatcctacatagcacttacgtagcgggttgacttggttttcatcttacatagcatcaacgtggcgcttacgtggcattaaattttaaaaaaaaacaaaacgggacccaaatgtcattgagtaaaacaataaaagtaaatattgggcccacgtgttagttcatctttctctttccgtttcttagccacatgtctccgtaggggtgaaaacggatcggataatatctgatccgatccgcttcgaatccgttcgaaacgaggatatggtatgggcttttcgaaatccgggggatacggatgcggatagtatgagatggatgcggatgcggatgcggatatggtgtctctaaaatccgacattatgtgataagccgtttgccggataatccgagattatcaacatatataaccactctatctattctatataacataagttggtacatccaatgccctaattcattaattaacatagatttttaagtctaaggcttttatcgtctcatgtcacactcacgtagctatattttttatattatggacatcatgtattcatgttgtttagcacttaatcatatacttattacgatgggtcatttatggattattgtattattgttcctgagattgctaactcgattttgcattgattgcatatacacgtaacatccgataaatttaatccattttcaaaccgattccgcactatttctgacatccgaaacaatccgctccgcatccgcatccgtacaatatccgcacctgctccgaatcggcttaaaaattatggtttaggatatggtatgaccattatctgtccaaatccgctccgttttcatccctatgtctccgcagagtgataggggatggatgccgtcatgccggcgagggagcgctcggcggcgagcggcggtgtatggcagcagtggcggctgtgggacggagagcaacaacgcgaaggcgaagacgaggtgcgcgaaagtggaagtgggctctgcgccgcggaagtgggatcagcgttcatcaccaccgccatctactatgccggtggcgtcgggggcaggagccccttcttccctcatccacctcgcttgcccccgcccccgcccctcccctgccgccgctcctcatctctgggacaatcctgtaccggtgcggaagaggagcccatgacgttggcgaccccggtggagccatggaggacgacgagaaggaggcgccggcgcgcgcgaccgcgactgccgggtgcacgggcggaggcagagcttgtgcagcgccggagcctagagcctggaggaggccatcggcttccgccaggagacgcagatggacctcgtcacctcgctccagcgcctcataccgacctcgtcccctccctcgaccgctctcgctgcatcatcgcctgaccgcccctttgctcccatcccgaaccccgacgccggccacggcaagagccccgccgcctcaagacccaccaccgccgctctctccgagaccaagtgcgctccacccgctgtaagacctcgccctgatcctcccctgcctctgtcgctgctacccccggcggcctcgacgttgtgcgcaccatggtcgtcgtgtgcctcctggagctcgtccccttcgccgagatcaacaccgcaccactcgcgcgtcgcctgcaacggagagctcattcgccagcgaggtctagcggactgctctcgctgacctagtcgtcgaactcggtggcttggccgcctccattgtagtcctcgtcctctggcggacttcgcctcgccatcgctgccgccatccaccggtcactaccaattgctatccacctgaagagagagaaaaggaagagggaggagaaagggtagctgacacgtgggcccaaaattttttgtattgttttacgcacttacatgtgggtccatttagatttgtttttattttagtgccatgcatgcgccacgtcgattccacgtaggataaagaccaagtcaatccgccacgtagtccgaaaccactgggggagtcgatttgcaacaattttaaaagttgggggatgagttatacccggttttacggttgagaaatgcaattcaactagagtcatgagttgtgggaatcaaaatagacttatttcctcctttgcatgttgttttggatacgctgggctggcttacggggcagctttaacgggtgtggtttataagccgaagacacgttaaaaacgaaaagtaattttagtgtaggattttataattttttaaatcataatacaaacacaagcgcttatataaatatattcatactcacctctataaactcatacacgtacaaatgtcctattgatgtgagcacatttgaaaagacctgcatatctagatattcacgaaatcactatagacgtcttgttaccgattggtatgtttcatactactgaaagaataattaagtatatttgtaattatatcgtctaaaaaacattgttgataaataaaaggtaatgaaagaaaaatacttgatcgaattaattatgttctggtatgcacaacagctgtgaagtactttgagatactagaattcaaattttaatacatattatagggttgtttattttgaaatggagcggaggtagtgcccacgcaggtacatttttagtaacaattcagtgaggttaactgatttatcattagtcctctatatattatcatgtgttggggaacagtacatatactggtaatatatgggtttgggatgcaactgctacgtgtgtagtcgttttttcaaacatattttatatagtaataatcaaagaaaagttacttttgttcttgaatttaaaattgtctgggccagctcaaacaaataagggccaatggtccaattataattagatatgcatatcttcaacaattaggtctctttatccaattgtacagcgatacttggagagttcgtaggtaccgttggaatgaattatccgcctttccctatcagcttaagcttttgggttgaactggtcagtacatgcaacttaatatggtatcagagccagaggtctcgagttcgaattctggctggcgcgcaattaaataaaataattgcagctcgcgtgaaggggagtgttggagtgtataaagtgaattgcccacctttccctatcagcttaggcttttaggtgcaactggctggtgcatgtaacttaataggtacgaattttttcaacttaggttgcgttctttacctccggtacgaattggatctggatttttcaacttaggctgcattctttacctccggttcccaacttccctccctcgttttccgcgtgcacgcttttcaaactgctaaacgatgtgttttttgcaaaaaaaaaattatatacgaaaattgcttaaaaatcatattaatctatttttttaaaaaaatagcaaatacttaattaatcacgtgctaatcgtggctctgttttccgtgctagggactcccgaacacagcctagtacttttgaaaaaacttattctataaatagatccagaaaacttattatataaatggattcttttcgtggtgtcaacgtcgttggcgccgtggtacaatatgacggcgccaatctctctcacctctcggtgaaagttaagtcgctaatctgaagagggaccatggcaaacaaattaaatggacctatttgtagcagaaaatgacctatttgtaataaaaaaaatatttacaaataggtctttaatgtcaatgacactgacatcgaggacctatttgtaaatatttttaattacaactagtcaactagatatttttttattataagtaggtcagttttttaaaaaaatacaaattgatcctcggcgatcgatgaaaatgagctaagtgttaaaaactcaggaaaatcatacctaaaagttttataaattcttgaaaaaaaatgagagatatgtgcatatatgaaatacattctcaccaaatgccaagcccaaactcaacttcattcgagagaagcaaaaatagcaaatttcagataaatagtgtcatcttactattcaaccaatttttcttgttttgttactcccaaataaagttgagtttgaacttaaaatttggtgagaatatatttcatatatacacctattttaattctttttataaatttataaaacttttaggtatgatttttataagtttctaacacttaacatgttttcatcgtatacattctcatgaagttagtgttttactcaaccgaatttctcgaacgaacacaccatgggtagtgcggtctgaaatctggaggttgcaatttgaccatacatattatagctttttccatttcttgtttaattaccatactagtataacgtaacttaacccaaaatactacgagggctactagagaacaggatactttatataggttagcgtatcagcttcctccccgtaagtctagcattatccccctcccccaacttccatgtgctcgcaccccccacgtcttgagctagtgccggtagtgtcgtaggcaacgatactggtcacaacagcaaggaacgatagttgagcctaggggaagggaaaaaaggagaggaagcgttgatagttgatactttgcaggtgccagccctagccttgatacctaagtactaggactgatacgtgtgagtaccaaccatgatacctacgggtaccaggtttgacacctaaccatgatacccaggtaccaggtagcaggtctgatacctacgagtaccaggtctaacacctaaccatgaaacccaggtaccaagcctgatacctacaggtatcaggcctgatacctagttatcaattgtgatattcacaggtaccaggcatgatacggggtaccggtccgcgataccataggtatcaggcatgatacctacgagtaccggctgctgatgatacattgtagacatacctgcacacaatcgggcgaggagcatgatggctcaccatcacgttgcccctttatcaccatcaacaacgcacgttgaaggaggaggctgaggagcacacgttgggcctcatcctcccagttcctgatgaccttgcttcttccaagtcgcccccgccgccatgagagctagatccagtgggtgccaccatgcctcaaaagcatgagacggaggaggtggccatgagacagaggaggccatgagattggtgttgcccactcgctctggatctagcagtgaggagggcatagtactctagatttatttttagggccactctatcatcagagtgggatctggaagagagaaaaaacaaagagtgggattggataagagtaaaacgttatccacttatcccgtgtctacgggatactgtacagtagattttctgaaatactacagccaaacaacatcaattggcatgtgatgtaggtaggtgacatgtggccgcattaattggtcacacacgacgacatgagagtactagtacgagacagaagtctggtgcaggctgcagccgccagccggcaacacaccaaggagtgtaaagttttggcgtctcacataagtcattatatagggtgtcgtatggagtgttcgggcactaataaaaaaattagttacataatccgtcagtaaaccacgagatgaatttattaagcctaattaatctgccactagcaaatatttactgtagcaccacattatcaaattatggagcaatcaggcttaaaagattcgtctcgcaaattagtctcaatatgtgcaattagttgtttttagcctatatttaatactttatacaggtgttcaaacgtttgatgtggcaaggtgaaaaattttggggtgggatctaaacaggcccgaactcagtcgaccgtactccctccgtcccataaaaaacgaatctaacaccgaataggacatatcttactactacgaatctggacatagtactaggatgtatgtccatattcatagtaatagaatgtgtcacatccggtactatgttggtttttataggacggagagagtacacgtttcttcaagaaaacaatattccttccatcctataaaaaacgaatctaggactagatatgacatattctagtactatgaatctggatatatgtatatcctaattcatagtattatgatgtgtcatatctagtaataggttggtttttttgggacgtggggagtactctcgttgtcccataataaacatatatataaattttcgtgttcaattttaatcgtccatccttttaaaatttattttttaaaaaaattaagaacataagtcaaacataaactgtgacagcgtcgatcgtgacacaagcctaacgtgacagcgtcgatcgatctttgtcaatgcatggccagccgatcgatcgtctcagtccttgaagatgccaaaggacgggttgacgatggagcagccgccgtcgatgagcaggttgtggccgctgacgtagcgcgcgtcgtcgctggcgaggaacagcacggcggcggcgatgtcctccacgcggaggcgcacgcccttgaggttggccacggcctccatggcggcctcgaacgcctccccctccaggcccacgtaccccgtggccagcggcgtcgccgccgcggcgggcgacacgcagttgacgcggatcccgtggcggcccagctccgccgccgcgttctccgtcagccccaccagcgcgcgcttggcgcacgtgtacgcgtgcgacgccgtgccggccaccgccgacgcgaggctcgccgtcccgatgatgcacccgccgcgccccgcggccaccatcacccgcgccgcgtgcttcgtgcccaggaacgggcccgtcaggttcacggccagcacgcggtcaaagtcggccttggtgctctccaggatgctgtggcacgccgcgccgccgatcccggcgttgttgaacatgacgtccagcttcccgtacctcgccacggcgtggtccaccgcggccgcgacgtcgtcctcgctcgtcacgtcgcaccgcacgtagctggcggtggcgctcccgagctcggcgcacagtcgcgcccccgcctcgtcctggatgtcggcgaccacgacttgcgccccgtgcttcacgaacagccgcgccgtgcactccccgatgccgctcgcgccgccggtgatcagcgccaccttgcccaccaacctacaccaacgtacacacgataacatggcagagttacgtgtaagatcaccgacaagctcatgcatcgcacacaacacgcgggaaaaaaaattaaaccgttgtgatctcactttcttgcagactcatgaacgtcgccgtagctgctacccgccatggccaccgcgagatgagaaatcgttagctctctcgatctgcgactctctgagtaagttagtttggcctgagacttgatctcttttatagtagtagagccggctactgatcagctagtttacacaactacggcaaattgtgtggttcggcatctccaacagacagattcccagcggaagatgacacggcgcatcggcgccggcttggaccttgtggtggaggctgactgtgcgagtatatgattttgcttagtagttgacggaatgcaggagctgtttagatttagatttagccaaaactggccgccccacgtcgtcgctagcggcgtgtgccattttttttaagagggtagctatacgggatcttgttgctacaggatactttaagtgattcatcccttactttttttttataggtgagattccacatggtgaatatgtgctcccttccggtacctggtaccacgtaccataatcgcgatacctatctgattcctttaactcctttcctttcttctgtataggtaagatttcacgtggtgaacatgtgctccctcctagtacctgataccacataccataggcgcgatacctatccgattcctcctcggtatcgcgcgtgcgatacctcatcgctggcaccgctcctctgcagtcggagcagcacaatataggctggtacatgatacctgatacctgatacctagtacctggtacctagtacctgatatctagtaactagtatctagtacctgatacctagtaactagtacctgatacctagtatctgatacctgataccagtatggcactagttgcatggtgtgtagtacctggtacctatggaattggagagattcacaaggatgggacaggggaatcgatactatccatataagtcagaaaaaaaaatcagcaaagaaaatcatcaatcaaaaagagaaaacacacatgaggaagggatgcaagcggcggtgaagcattgccagctgggggaggggatggaggaatcagccagagtggaatggagtgcaggaattgaagaaatggatgcgagtggcggagcagcaccgccggcatggggaggcggatggacggaggggagcggtggcgcgagagctcgcacgttgatttggcaccgcgctgtgcgttcctgagccagcgggagtagctccgcgcggcgccagcgaagaagagcgggccgagcgtcctctatgctcaacgcgccaccccgcgcagttagccgctattgtcgtctctatgctcttgaggttggtagtcacacagaggaggaaagatggaaggggaagagaaaaaaaagagaataagatacttagatatttagtgatagcagttatccgcgtgtacgaaatagtgttgagtagtttttctttttttttattaagggcggatgcattacggtgataatcggattgggtatagcagccttcgttttcttttcgatgtcaaacaagtcggcgaggccattttggccaacgcgtgggtggagatacgcgcgcgcatgtcgagctacagcacataggggacgtacgctttccaaaaattgtcacgtgtaacagtgcgagaacctcttttttctgtgtcaggtccctttattttttagtgaaatgcacacggaagctgaatagtaataagctattagaggaataatggggttggctacctacgaatgggtttgtactaacgatgtttcaaactcgacaaatgcggatgtagtatgcaaatgaaaaacggaataggccataaagtccagctggcacgctctcctcccccgcgcggcaatttttttcgttttcttttttttttgcagttttttttgctttctttactctcttctttttttttctcgattttctttttttttcttttttctgattatcttttaatacttaatctgtccgtgctacactacggcgacatttagaaatacaaattaaaatcgatggatatagttattatgttgttaattaaattgccacatgcataaaataacataattattatgcacgaacatgtataaggtcttcatcaatggcagcacccgctgtttgatgaatttttgtactataaaattcacagaaaaaataataaatcattaggcatcaagttcatatgcaaatgctatttacagctcaattttagtaaatacacgttaggggtgtctttatgacgtgtggcctaaaaatccaattatcacacaatatccgaatataatcaatattggactcgttttgctgtatatatcaaatagaaaatgatggttcgaatagaatttaagtttgatgcgcaattgaagagatatacgctagtaaaagagaagagatcaactagtgctagtgctagcagtcgttaattggtttgctgccactcgtaaattatctctagaagaaacaattcgatcaactcatataaagtgtggggcccaccgtcatttagacatgttgatcaaggattatctctatcacgtgcactcagattttatccacggcaaagcaaggctctatctgcagcagtgcgggagaagagatcagcgcgttaaactaccaacttgcgcaggaggttcggaagagattaggcaggttggttaccatcgctgttgcctatataagcgttgacccccaggacgccagcaaggatgaaggggacggagaagggaaaagatacacagtgacgagaaaaatagagcgactcgctcctgaagaaaccacagcaatccatctgccggcggtgctattagaagattaaatctcgccgacggttcgcgagcaggcgtgtcatgaaatgaagattaaacatctctcgtcattaagccaatgtcgcaggtggagatgatcgtggtagatgataagtatgatgataacctgatagtaaaccggctgttcttatggatgatcggagtacctcttttctcctcaataattaaagtgctctggaaatcaaatcacatttgctttctcgaaacataaacttgggtatgtctaatctgcggattggactatcctcgtattatttataatcaaaacacatgtttttatggtgcacatgccgggagcgagcctcaaattataaaacaaaggaggagtggagataaaaaatataacatcgatgctatgttcgtgaccaatgaggccgagcgatgcattggctaaagctgaaaagtactatggccaccacatatgtgacgaaactatggccgagcgccgacaaattataaaataaaagagattaaatttcatcgtcggcaattcgcgatgagattaaccattgccagcgatgattgcgccggcgttcatcatcaagtcgatccgtgtgtgctgcaggcgtgatgaaacatcagaggagccgatcaaaatcttcatatgctatttatcatcaacaacacagtgaggccgtagtgctgcgctgttgcacggcccggttaacagaaaagtaaagagaagcatagacgaatatatcgtggatgcgttgtgaacttgtagccatggatatataagtatcccagcggcgcatacacacgcacacgtcatctttgttaagtgattaatatagggtgcaaataaatacaaggcgagcctgaccctcgtaaaggttggagcgtctaaattattaatatcaaatattggatgagatatttatttgtataaacttgggatgagtttgagtcttattggcatcataccaaccatgatttatacatatttatattcatgccggaagagttacatatttgcctcatgcatgtcatgtacaggagcaattcttttcctctccaaattctaccggattgatgggagcaattctcacaattcttgaaggcatgcattattcgctaaataaaacaacgctagccataagggcgagacgtgcagatttaaaatacacgtcaacatcgtggccgaatgtcaacgagatgaaatggccgattcatcaatatttgtattacgtctgagaccgacaccgggaatcagcggactgcacgcgatctccagtcaacatacctctccattaagcattcctcgtgaaggcaaaagatgaactcctgccggagccctcatgtatttgtaaacattcatgttaatgaatcatgattaataaaatacagggtttccctattttctatgtgttcgttgttttgttttcgtcaaacacccgcgccaccgtgcatgcatgcttgcgtctgatgcgtgtttccaatgcaggagctgccggtgcagcagtaaggcgacacggtgagcagcctggtgtacgaggcgaacgaccggatgcgggacccagtctacgactgcgtcagggccatctccttcctgcagaaccaggtgtcacagctgcagatgcagctcgccatcggacagggcgagaacctctgcatccagatgcagcaccgtgatggcaacgagaacgagaagaatgtgagagaggaggaggagagagagagaggagggaaaagagagaaggtgctgacgtggaccctaacatgtggggtccacatggggacctacgctgactcagccgccacgtcagacaataccggagttaaaaccaccgaatgatctaaagtgaacggttttgtaagttgagggatgtcgtatatctgattttgcggttgggagatgattttgtatctcgatgacaagttgagggaccttgggtgtactttttccttttgcttgatgcttggtgccagggtaggtttgcagcccagtacagagtaaacaggcctaatctagccatcagtcaagatccattaggttcctgagcccttggtttcttttgtgaataaagtccaataaaagtcccttaaatataggtaatatctaattcaaccactcaaccgttacgactcctcgaattattaaagccagtacaaatgactctaggatgatttcgatggtggttttaactgaagtggaatcccaatcagtaagaagaaaaaaaaaatcccagggaaacccacttgtaccagaatagccatgagcccgagctcaacggggaggtagagtccaagcccgagctatgagttcttctgccatcgggcacacccgtcatgccatcgttgttgcagcctatctgtgctctgcaatgacattttggggttgcttagatccactggcaaaattatttttttccctatcacatcaaacgtttaaacacatgcatgaatcttttaagcctaattacgctatgatttgataatattgtgctatagtaaacatttgctaatgacaaattaattaagtttaatctcgcggtttacaggcgtattctgtaatttatttttgttactagactacgtttaatacttcaaatgtgtatccgtatatccgatgtgacacaccaaaactttacacccataactctaacacagtgtcagggttacggataaggcatatcttctatcctgcgacttatggaatatactaataaggacttatggaatatactaataaggtatatctttatgtacacggattggttccatgtacgctcttaaggatttgttttaaatcacagaaaatatctccacgagtcaagcgatttccaaaatcctactcggaaggggtaaagtttctgttataccgtgtcgaatcaaatatccccatatttttcttggggtcaagatgatccacggtataaaagggactcccggggaggggatcaaggcatccaattcaattgccaacacacccaccagtttacgaagccggagtacatggagtcgctgggagatctcatcgaaaccctcgactacgatctcgtcggtatcatctatttggactacttgctttgtaatctgttctcgtcatcatcaatcccatataaactggactaggactattatctgataaaggtcctgaaccagtataatcgttatcttttgtctgcttgatatcgtattatgtagtattatgtagcctcgtaacaatgtaccccagtactcaactcatccggtccatgagtataactcgtcaacacacagcctttataactcactttctaatagtccgtatatctgatatatgcaattaaacctaaaatttttccacaactaaacgaggccttaggtgccccaaacaagatctgttgcctcgccgttaggtctttctactccagtcagttcagttccatcttcagcagcagatcgcgaccgtcacgtcatttcaacgcatcgtgatacccatacagctagccaggaccccgcgcgttgccgcggggtgcttaagcaaaacaaaatatttaacatatgaacaaccataaagatttctgatgggaaaattttctatacagaacacctgtaatttacatagacaaaagtgtattcgagaaatattccatcctataaacctagaagataaatacctaagtagaaaaaacatggaggtgacatgattttacttggaagtacaaacatgacaaagtatgatatatacaggtgattggctgcaagtctatgatgaacaatggactatctatgctcaattggctgttaacctaggtagcttgattccatctatgattttattaccagtattgactctcttactatgtgacgttgagttgaaagacagatcagatttcttgcaaactcatcatcactgacatcaatatgtagccagcacacatgccataggaaagaatgaagaatccatagctatcctgataattgacaaatataagaattaatcttaatgatttgttttttatatggtgtataatacaaataaagagcatcttcacatgattcttcgtgaactaaagcatcagatgaatttagaataagaaatgtcatatatgaagggcaatatgtacttttatgaatgataattttatccttgaatagagcaaaagatcatttacaaacaaatagaatgtcaacatgtatatgagatgctctttttttttcatctgtggatcattgtggaaatggaaaccatgatattaacggtaatattcatggcaaggatattgcttgtaagatttgactgtgtttaagaaggaatttaccttcggaactaaagatggaataacatgtgcaggagccgtaggatattgtatgattttaatgtaaagtctgatgaacttgtcagtaattttgcatagctgtcatcacaatcatcaagctgcaacatttgtatcaagacataacttagcagttagcacatttgaatgttgcgatccaaaaagaaaaataatgcaaaagcttttgcatgagataaatatgagtaaatccaatgtataaattgcaacagagcatctcctatgtatgatttatgagtctttttaccattcaacatttggtacctcgaggtactacaattttttggtacctcgaggtacgaactgttggatggcaaaattgctcatgatttatggcacatgaaaatgaattgatggcttagactataaatgagcagcagtagtctaggaaagcttctctcatatagatacactaaaaatgtaactatggtttggggttttaaggtacaggttttccataagattgttgctccaagcagtaaacatcttctggcatgaaaggcggtacattcttctcatcagtcaattaggaacctgaagcaggtaaaaaaagaaagatcttacatacaacaaagcattacctaattatttaggtgcaaccatgaatgccttaaaacatatgcagttagatcgagtagcacaatgtctggcaagacatacaggacaaaaagatcgatacctgcaaggaaaagaagattagcctccatgccatcataattgctgaaccacagccagcgcaaagatcacatttagacaccactaatcaaatccacacagggccaaatcatcgacatggtgagtaagatttggtaaaagtttaaaataataccttgagctataggaagacaggcaagtgcttcccttcctgccaccatagccggaggacagcaaagccgaggttgagcagtcacacaaacaaccaatagctgcataacttgcacagatcgattcatcgttgaactgttgaaggacgtaaaacttaagtttatgcgctataccctgccgcctcagctcgtccgccgcaatgcgcattacctaccaaaaccctagctacaacatgagacaaccaaatctggatagagaccaaatggaggatggtagaatgggatgctatgtcatgtgtggcgaagccgggggtaatctagagcccagatggccatacctggacctgtggtcggttctcaatggcgcactgtttggaatcctcattgtgaccggcagcaaccgagaacccccaaccatagccgacgctgattcagtaaggagaacggagggaaggagtcggcggggaagaacggaggggcgaagctgaatgggatcgatgggcgatgaggtggagacgccgatttctgatttctccgcggtaatggggatcgatggggaattggggattggtgagcggtgggtgcgtggcgtgcctggctgaggtcttggggatgacgacgggcgagcggatcaggggctcgggctggcgcagaagcagacacgcggatgttcggatctcagcaacgtgggtgcatcggacggtccacgcgcaggcagggactgttgcactgtagcagaatcgtgagctctcgtgaagcgacgcactggtggtagtggctcaggaaaactaaagatttaatatgatatgatatgattaaccctgtgcacctccagttcccccctgcctaccccagcttccgtccgcgtcggtcgatcgggccgccacagcgctactgttggtttggctgcacctgcacatgtacgcgcgccccccgtgtcgatctcactgctgctgcactgcacactgcacgcgacgtgaaccaaacagaccgcgacacgcctggcgcttccgcactcggcaacccccccacacggattgggatcacctgcagtagctatagctcctgcaacttaagcagtcctataaccaccattggatcagaaattgatgtcctagatctttcctaaatactgtttacagaaaatcgtacacagtgtgttcctgtagcactgtttggaccgttgattatcttgatccaacgatggaaaacagtcccagctgctaaacttgcagtctgtactgtaactgcaccggatccttatcccccccgcacacacacgattgggcgatcgtcgacgtatgcaaacgcacaacgcgaggggttgggagagttgggaccctctctgtgacacaatgacaagcgaacgtacatgcacgtggccctgagcctgagttggccagatgcaccaccaccatcaccatgtgcctgtgcctgtgccagttgtgggcacgctagctgcagtgacagactcacagacacagacactgcttctctaatttaacaaggcggcagcatgagcaggtgctagtgctaagctaatctgaccggatctacggtcgagatcgagatcgagagagagagagagagagagagagagaggaggaatttgttaatcggcccatcgccatcacacatgcaacggccgagacagctcggcccacgcggcccacgcatgtacgtgcacatgtgtggcctcgtgtacggtctacttcctccgtcaaaaaaaaaaaagacaaatctggtttccgaccatccatcttgtttaaaaaaattatgaaaaaaattacaaagacaagtcacacataaaatattaatcatgttttatcatctaacaacaataaaaatataaattataaaaaaatttcatataaaacggatagtcaaagttggacacggaaacctagggtctgccttttttaaaggactgagggagtacttgctgccgcattgtctgcttcaactcatcgctcggtcactgacaagtaaaaatctcccaaaaaaacgtactcccaaatgtggcgaacagatcatcaacaaatcaaggtcaagttcatctggagatcgattgatttcatatcatagcagggtttaaccatggacatcacataacaacacgcgcgaaataaataaagaaattatggaggagtgtagttcgggtggccatcgaccgaccatgccggatgtgacttgtgtgcggtggtgtttgttgcatgttggatggctagctcgtcgccaccgcggccatcgccatgccgccgttgccggagacgccgccgcggttgtggggcgcggccatgatggatttgctggaggaggagctcgtcggcctcagcgctcgcatcgggctcgccagcgcccacgcccagctccggtggctacgcgcgccgtgggttcttgcgctgggggcggcggcggtggcgccgtcggcagcggacagccagtaggaggacgacgtgggcggcggcgcggcgccgagaccgccgaagaacccggcgcacttgatgcggtgctgctgggtggactcgtactcgtcgtcgtcgccgttgccggcggcggagtggttgccgcccaggtgggcgagcgcgccggcggacgacttgggcttgggctcgcggtgggactccacgcggcggagcgcgcagtcgccgaagccggtggagaggcgctccaggaagtcccccgagaagctgcggctgccgcaccccacggagcgcgaccgcgccaccttcctcccgaacgacgacgacgacgagccctcgctacggcggccggggctgtccggctccactatcgcctccagcctccgtcccagcgacgctgacnacgccgaggcccccgaccccgncttcctcctcncngacgcgccgcnnccgccgccaccgttggccatcgacgccgagccctggtggccgccgctcgacgacgaggacgaggagtagaggaaggaccagaagctcttcttcctcgggctgtccgcggtgaccgcggacggagcgggcgccgtcaccggcgtcgtctcctccggacgcggcgccaccgacttgctcctcttgagcccgccagccgccgaggccgggatcaccttgcgcgccgcggcggcggcggaagggtggagaggcagtgacgacgacgacgactcagcagcgacgtggctggtcggagtggacgaggaggcggaagccggcggcgggtggaaagggctggacttggacgaagacaccaacatgccgagcttctcctgcaggcagaaggcgcatatgccgccgccggctgccaccccagccgccgcagccgcgccaggcgggtacggatgctcgctgcagtacgccactccgtcctggtcccccgccaccacaggcgccaccgccaccgccgccgctgccaccgtctcccccactttctcctccattctcacacccgtcacctcacctcctgcgatcgatccccgcaagcaaagctccgcaccaccggatcttggatacgcctacgcgacccaccgcatcaccacaagaggtcaggccgtctcgatctcgatctgctgctggtcgtgcagggcgtgggggcacggggcgcagtcgcgcagaggcggatgtggcggggtgtgtggagtgaggagtgagggacgcgacgcgaggggggtggtggtgagcggcttgttattttagcgccactaccagtggcagcgcccgcttctttttgtccggctcgtgcggatgggggggcgtgacaaggagagcacgtggggggtgggggtgggggtgcgtgcgcgctgctgcggcagcagcgttctcgttctcctccccgcgtcgcgcgtggtgctccacgctgcggccgcgcgctgtcacatggcgcgcgcaatttttctgtatggtatactagcaacggatcttatgccgcgctataacccaggttttactactactactactacctcgtaagtgaccacttgatcgaaaaatagttagaagaatgggatagccgcgccgtgaccacatctatatcgctcgtttctctcgatcactcgatgtactaatgtaggagtatactactactactactactaccaccaccactactactactactactactactacgtgcaaatgggcaaatggccatgccgaaatgactgatccaaccttgccatatcttaacaacagccacatgtcttcggggagactacaacatccatgatcagtactacctatcgtatgctgcatgtgctagcatgaggtattgagcttgcagccctagctaatttgatttcatcacggatacagatctcaaatctactgaaagagcaactgatctccatcatggaaggagctataggatggaaacacgatgtagtataggggtagtgattaataaattgaggtgccacgagaccccgggacaaacagacaggatttgtacaaattctaatggtcttaacagtaactcttaaccatgctccctgggaatctatcgtttgttttagctctgtccagggtggcacgtacgcttagctacatgtttctaatccgatggagtttttattacaaaaaaaaatatatctgaatgagtggtcgatggatcatcagaggcgactggcgagagtaatttccggtccagcacattgcaacgccatgccattctgtctctacctctcacccagctacagcatcaagggatgtgcggcacatggttcccatcggtcgacatcatgtacttctacacacatcatcatcgtttcggttagttttctgagcccctgatgctacacgaggggcacttgtatatactactcctactagtagtatgctcgcaacaggagccgtccatgtgcgtgcgtgcgtgcgtggggagatgcaccgttgcagtggacatgtcgctctccgatccgcggcttgcgttttgcgtacgtgcggttcgggctgtgtctgtggctgtggccaccgtgctctcccggcgtccacgcgcgcttcccggcgcggccagccggtgcatcggtgaatggtttcgtgatcttggcagagatcttttgcatacgtggtggcttttagttccaggtgacacgaaaaggttgaaagcagcaggattccagggagcagcggttcacggtttcgagatcggctcatttcggctcgatgcgttgacatggtggtagagactaatctggggaattttttatatagattttgtttatgaactatctatacggggattagggcaaatactataaacatccaagcacaatctcctaggtgccacataagctaaaatggtgaggtggaggagagaagagatgagagagataagcagccacctctcatgcaagaggcaaccattacacaaaattcaagacaaaaggagagagaggaagagtagattgggcaaacaaacattgaggctagtgtattagaattagtatagatgtgatatattgtatatattacctctatatttattagttgatgatgtggtcaaaattagatgcaacaacctccttttttataaaacttgcacttacgtgaacgggattttgtatattcgtgcacggacagataatggattggagtacaatcttgcttttgtcattcgtgtaggatgactccaaagttagggactcgaggacatttaactatttacttcatccgtttcacaatataagactttctaacatacgttcatataaatgctaatgaatctagacacatacactagaaagtcttatattataaaacggagggaataccgttcctagatctagagcagaatgggatagcccttcagtcatcaattaacacttaatactccgtactatagaacttgttttaattgataggaaacagatcatacgaaaagtaaatttcaaataactacaagtatttattaaaactataaatttcaaataactataactattttactaaaactattagtttagtacaactttggccgtgtttagttttaaagtttttcttcaaacctttaactttttcatcacatcaaaacttttctacacacataaattttcaacttttccgtcacatcgttccaatttcaaccaaattttcaattttaccgtgaactaaacacagcctttagctaaatatttcacggaactgcaacaatagtgtatgactttatcaaaaagcttacattattcacctgaaaagttttgagtacatatatcatacacacatgcaatactttatatcagggtaagtcgagcccatatgtgataaaatcaactgttgttgctgttgttgttgcagcagtcttatgaaatacccatctgaagtaaaaggatagttttaacaaataattacagttttacgaagaatgataagcacgggtgcatacctcggccagtttcctcggagaactatagaccttccgttgctaccaaatgaacatttcttgtaaaactgaactgtagatttgcggacaggactgtgcagtactgtgcacccccagtgcctgtcaggatcagagcagccacaaacccataaactcatcgctctattctagtccttccaaatgtacatttttttaatggaaatgtacattcataatactccatcaagatagattacattcaacaagtcatgcgctacgatgtacagcatatatatacaccactagcatgtcggggttgaaatgcaatctacagtttgcaatactcgtcagttgaatcctcttgacgtttggtactggcattcccaacctgctaaacctttgtgggggtgtcatcatgaacgaagtaatcttggaccagaatttgactcaatccatgaaacaattacgtcaacaagtgtattgacatcctttgagatttgtgctcgtagaacgcccgaatccgcacctaaagtgctacctacctccttagcaacagcctcccatggtgtccctgttgctagatttgtcaggagttcacctcctctgtttactgcatcggccattgctggtggaacatcaggaagtacctgaaggaaaaatatgtgattactta

SEQ ID NO: 48121 - DNA, 6124 bp, Oryza sativa
  unsure (1)..(6124): unsure at all n locations
ttcctatttttagaatagtgaacagataccgactttgtcacttacacctacacctaacaccataagttccacttgtgatacatactaagaaagatagtacgtctccagaaacaggagatgtccaaatgagaatgacagtgcagggatgaaaagaaaataataccaccatgtggaacagttgcagaccattcaagcaacagactttgtcataaaatataaaaaatcatcgtaacaatttggcaatggaattcagaaacacatcgtaccccaaaacgaagtgttggatatgatgtcaactgggaaaatattggcccaaaactctgtgccatgggaacaattacaggcgaaaataatggaactgccaagcttgcttcctgcaaaagaaaaagaaagaagaagaaaaactacaagtaatattctactagtagcttttaaaagaattaatagattgaacggaacaaaaattcttttcgctctggttacaatagataacatcattccgtcctaacatctaaatgcaagtgtcttatgacactacgatttttgtaccaaactaacagagccgcatcacatgcttcgcagctgatgtacccgctccatgtagattgaagcgtacaaaagttcttacttcactctgaaagttgcattactatggattaccaaatttaaatatctactcaatgaggaatgtccagttatccacttatcttatcaagagatacaaactaaagcaataaagtatggatccctggtcatctacagtgtactagtatggtctttacctatatgtatgtgtcttccctaagccatgcaattttctctactacttcgaaaggacagtcatcctccttcctccccttccaatctcacgtataaaaagcgctaaaaaaagagaaaaaaaagtgccaaaaactaaccaactgagaaaaaaaagaagaaaaccaggaaaagaaaagacgattagttaacgaaaaaaacaactctgtcctccccatatctgtcccaaaaaccaggaaatgtaatctctgcctcctaaaaagaagaaaaaaaagaaggaaaaaccaggggaaaaaagaacaagcagttagtcttccggtgctttactcgatccacggtcccatccatcctaatggtatggatatatcctcaattaaataagcccattgcaaagcatgggattgttactagtgttaacaaggaggggagataacacgcaaaaaacataccttattgttaaaggccatcaatatatttccacttcgctgcacagcgtatcttgatcctaatagaagcaaacatcagtgataaaacaacatattacaccgctaactgaacaagcacaaatttaatcttacataaagaatacttcatagcccagaagataaatgaagggtgtgtttagtttacgctaaaattggaagtttggttgaaattggaacgatgtgacggaaaagttggaagtttatgtgtgtaggaaagttttgatgtgatggaaaagttggaagtttgaagaaaaagtttggaactaaacaaggccgaaatatgcacttataatctcgtaccaatgagaaggtggatcacagatcccaaagaatgcccaacaccaaatgtgggaaggtcatttacctggaaaaaaaatgtttgcttagtatattggacaatattggagttaattgttatgtgaaaaataacaacttacaggttcaaccatgtttcttaagcacctgtcaaacttaaattgaacttcatctgcgatgaagaaatgatcaaagccgctagcatatggcgttgcgatcaccaaagctcccctaaatttcaaatagactgataaaatacatgtctgctagagaagtggaatatgtagaaagatagctctataggaaatcataatagcagtgtaaaccgtgtagagctagagctaagaagtactgtatcattttcttgaaatgaagatgcagttcattgcttgtaatattatcaaaggacaaactttaaaaatgattgttgtttcactaactttttgatagattgaacatgcgtgtcttgcttagaaccacataaagaggtgccttgcagttaataatgacaaattacacaccaaagctcttattctctagattcatggtcaagcaatgatgcactagttaaacacacaacaaagggagggctaaattttcaaaggttgcatttcgggtatagaactatagtcaactctccagcgttacgaacaaatcaaatgccgcgctgtttcagtctttgagcagaattagactgttgcacacagataattttgggtcattgggcattgcttgtccacatacttgtctgcaagtcgttcaaggaagaaacgataagtgatctgaggagcagctccaacaaaaatcccaccaacgaagtgaacaacgaacgagggctcctgtgatttaggcttcagcacccacgctccctatcagaacaaccagtagtaagtaaaatcactctgcatcaacaacagtagcaggaaaattttgcactctcaattgaggtcgcaatcaccgaagcgcacctcgatctcggtccaatctccggtcgaaccccagccctcccgggactgcttcgccgcctccgtgatcaccctgttcgccggccgcaacaacaaaagatgttatcaatctaggagagagatttcgcaggcacggaattagccatcgcctacctctcgatctgcgagtagagctgtatcgatccctcggacggcgccgggggagccgacggcgtggcgacccggggcccctccccttcctcagcagagcagcatgagatggcggcgcgcctcctcctcctactcttcccccaaccccaactactcgtcgccgcaactctacttcctcttcgggaaccccagaaacggcagaccgcggaggaggaggagggccccggggtgccgccgccgccgcgcagctgcacggtggacggaggcggcggagacacaacccttatcatcgccgccgactcgacgccaccacgtcgcctcgctgcggccgtacggactccgcgcgtgccgtctccgcttcgccaacccgccccgcgcccacagcgaccgcgagagtagagctatcacgcgcaccgcgaccgacggctcggcgcggcgcggaggcaagtgtacactgcccgccgtaggatgccaccggaagcgaacgcgcgcgccgtcggattcgcttcccggaaatggacccgacccgtcgtccacgcctcgactggtcaaaaaacccaaaagcgcctcgcctcgcgcccgttgctgccttacacagcacaccacactacccctatactactagtagtagcttgcccctgcgcttgcttgtgtcgctgtggctcgattgcttgcgcggcgcggcgatcgcggccgatctatcgattcgatgcggccgtgggagcggcgtggcgtgggcgcggagggaggcgagtcggtgggccgcgaggacacggacacgaacacgaacaccacagccagtagcgcgaacgcgagcacgagctcgagcaccgccgcgagtggtagcagcggggcgaggcggaatggggcggctgcggcggcgggggaggggtgggggagaagctccctgtcgacggcgaccatcaacctgagccaggagtacacgctcgccatccacaccagctcctaccacgagatctgggcgaagatccatgtggacggcggggatgggcagcgggagggcggcgtcagtggtggtggtggtggggaggaagatgaggaggacgaggacaggtgcaccctcgccggcgtgctccagccggaggacgcggtggtggagcgcgcgctgggggacgcgccggacacggagctgacccgcctcgccgcggactacctccgcagcacgcaccacgcgtcgctgctctgcctctccctccgccgggcgctgcgccgcgcgcgggcgctgtacgggcccatcacggacctcctcgcgctgataccgcacgcgcccccgctcgccgcgccgcaccgcgactgcgcgttcgacgccttcctcctgttcgaccaaatgcccaacccgttcccggcccccgcggccggcttccagggcatgcaccggagcttcgtcggcctcaagaaccacctcgacctgcgcctcctcagggcccgccgcaggcgccggctggtgcgctgcgcgacgcgcgggtcgggcatctgcctaatcgcctgcgccaccggcgctgcgatcgcgggcctcgtgctcgccacgcacgccatcaccgtgctgttggccgcggcccccgcctgcgcggcgtcgcgcggctcctgctgccccgcaaccgcttcgatgaaacgcctgcagcaacacatggaccggcttgacgctgcagccaggggcgcctatgtgttgaacaacgatgtcgatacaatcgagcgcctggtgggcagactccatgccaccgtcgagagtgacaagctgctggtccggctggggctggagcgtggcaggggggagcaccacaccatagaggaggtggtacggcagctgaggaagaaccacccgagcctgctacgccagctggctgacctcgaggagcacatctgcctctacttcgcagccgtcaaccgagctaggttgctccttgtaaaccacctcagtgcccaatctgatcctgacagactgagtttccattgtcatgatataattcaataacagtatccgcttcaagaaaaaacttgatgttggagaactgttctaggttgccaaatgcaaaatgagatatactgaaggaagtttacacaagctcgttgtttcttgtatgttattatgcattcgatatctattgcctgaaactgtgttctcgggtatctatttaaacttgggtaaacttagcaattgtactgtttgctactctacaaatgatttttttttttacttttgcaattattactatgatgtcgtaataacttaattattctgaatttagttacaacgctcaaacctatctttcaagtttggaaatgcaacctttgctgttagacaaccaatgtacaaaatttgaagtagtttataataactacagaagattttattttaggcctttacatgcatttgttgcagatcaaagatgaaatgatttgtcaatttgaatggttgtttgcatatcatcattacaaattacatagcaatgtttgcatgtgctattcagagctaccctgaattacttaatctgttactgttgttgaatctacacctgtttgttgaaacctggagatgatgtctttcttgcagtatcggtattggttgcaagctactttaagaaaattataggcttcttaacattctgtcaagggattgcagaagaacatagttagaataatatttaactgataaaggtttgtttaaagtccagtgtttaatttgtattttgcatcttaaaggactgttgttgtgttgtatgcatttttcttgcaggcacttgactatagactctgcaaatggataagtttcatgctgataatgttcttaactgcaatgtcgacggaattcatatttgttggtaatctcagcttaaaagatgtgaatactagcaattagtattctatctcaagctttggtttgttcatctctcaattctttaaatcttgaaacattgctggtatagtgatatgtttaacttacaattacaaaatgatatttcttttagctcattcaagattgccaactgcagtacaatttcatcttcgaatccatcttaattcggtaattcccatattggacttgatctgttcattgtatctgatcatccgatatacaaacttgaaccataatatttcatttgaaccgtaacttggcagtaacctataaaaaatatcttgggatattttcaattatcttgtagtattgtgatccttccttgccaaccaaccaaccaatcttgggatattttatgaaactcatgagcctttttgggaaaaatctctctggcattaactgttgctgcatcaataacacaatccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48122 - DNA, 744 bp, Oryza sativa
gaaaagttatctcaatcgggcaaacggccatcacggatgaacctctctcaatcgggccttaattaaagcccgtcaccgatagctttgactcagacaaccagtcaaactatagcccatcacggatgacctatctcgatcaggccacaactagcgcccgtcacatatgactactcatctcaatcgggcattaactatagcccgtcatagatgaccttcatctcaatcgggcattaactataacccgtcatagatgaccctcatctcaatcgggcactaagttaatgcccgtcacagatgagtataataaaaaaaactaaattttattttttggctagccttatgtaacgtaccacctctccccgtcacagatgagtataatccaaaaaaaaattattttttggctagcctcatgtaatgtcccacctctcccttcactcgtgtgcacccaggaagaatttcccgatcggtcacccatcccaaaattgcttcaggtcaagcacatttaacctcatagttctttggagatcggtttccggagaagttgtaacttgttgatatctaatagtggcgggactttgaaaaattttcgatcggatctgagaaaccttactcatattatagtcaaacatacatctcaatcgggtataagtatagagcccgtcactgatgactcatccgtgacgggcattaagtcatctcaatcgggcattagtatagtgcccgtcacagatgagtcattggtga

SEQ ID NO: 48123 - DNA, 6778 bp, Oryza sativa
aactatcaccggccggcaagataatcgtgtgatgatttcgtgtcgatctctgaatttctcgtgtagcctaattagtgtacggtgtatggccgtagttcttctactagctgccatgtacttaattaacaaactagcttcggaaacttaattcacgcgtctacacataaatatattttgtacttattccctccgtttcctactccatcggttccaaaatactcaatccgttccaaaatataagagattcatagcactttctaaaatatgaggaattttatgtggatgatatgtgttactacgaatttcctatattttgggacggaacgagtataagaccttagggcgtgtttagatctaagggtgtaaagttttggcgtgtcacatcgaatattaattatatagggtatcaaatcgggtgtttgggcactaaaaaaactaattacagaatccctcaataaaccacgagacgaatttattaagcctaattaatccgccattagcaaatgtttactgtagcacaacattatcaaatcatagagcaattattaggcttaaaagattcgtctcacaaattagtcgtaatctgtgcaattagttatttttttagcatatatttaatacttcatgtaggtgttcagacgttcgatgtgacagggtgaaaattttagggtgggatctaaacagggccttagtttaaagacaaaaaataattattatcatcttcttgtttacatcgccccaataaatacaatacatgcacccaatataattagagatcttgaaggtaaaggacttaaataataataatttagttgaatgatgtgcttgttaattatatccatgggacatccatgtatgcacgttttatattatgaaatatatagaaaaagtagttgtggtcttatattttggattggagggagtattatatatatttataagatgttttaatttatttttgaacagtcaaactattttaattttatctaattttatagaaaaatatagtaatatttttaacataaaataaatataatattaaaatatattgaatgttaaatttaatgaagctaatttagtattgtagatgttgctattttttaataactatatatgaaagtttgtcttaaaagatttaaaatgttttataattaatatgaaacaaagagagtatcaactttgctgattttaagtttttatttatgttgtcatttttattttattttttcctgtataataacactttatctcacatgatattccatgttttgggaaaaaaaatagcttcgtgattctgaagcgtggacagagcatatcatgatatgatgacagtagttacagcctgtacggatcgcgacccgcatgttttcccacatacggcttaataattaattaacagatgttacacatgttttaaagccaacttgagtgtttctcacacggtctctttctgctggtttgatttttgacgttttttttcctaaagatgtgagaggtttattcctccgtaatcaggtacagcgcatatagtatgtataaacaagtacaatgtacacatatcattgatatatgcactcctgtcctgaaattaataaatcgtacggatatgacatatcataatattataatcagattcacaatactacaatatataaaatcctatattaagtttgtttgtttcaatacagaggaagtacaaataattgatattaactgtcgagtatgatgaggtgatctacaatatatcgtaagttatttagacatgtagagtgtatgacaacttgacaaggagatgatgtataacacatttttcttaagcgcaccgtagaaacatgattgtttcattccaagccaacaagctcgaagttccaaataacccacctacgtaaagttcccttctaaccctgactaatataactcaaaggttctcctaaataacccataatatttatgtgttcctttatctctcagaatttcaattgcgatggagaccgggaccacgtctaaatcgcactaaaattcagccttcttacgaccgaatttgactaaaaaccgaaaaccgaaaaccgagaccggaattttcggtctgaccgaatgcactccgcagtgtgtgtgtcctatcgagaagaacggatggtttgggctaactgtttgatgcgaggatggtccaactaaatggaaggacggtactatccagggcactaaagagatggtccgttttgtgagccggtatgtcctatatatatatattctcactacaccacaggatcgaacattcaggccgtgctccagatcacgcacaaatacatgtgaccgtccgggcttttgtgctggacggacgtacgtctagacctacgggaaccaatccaaatcgtgcccgaccaggccagccatttggagcccgtatgaatgatcgtcgctgtcgcgccttggcatccacatccactttgacatttgatttggtagaaatcacatatatggctcatacattccacgaaataattgttattaatgcatgatctaaaacccatatacatatatactcccgtcgtttcagcttataatacgttttgactctgctttaagtttgaccgagtttatagaaaaaattagtaacatttttaacccaagacaaatttattatgaaaatatattcaattattgattttgatgaaactaatttagtattataaatattactatatttgtttataaacttagttaaacttagaacagtttgactttaaccaaaatcaaaacgtcttataacctgaaacgtagggagtagttgttaatttagagattaaagtcaaaatcaaaagcagaagggtgcatgattcaaacacagagttttccaacaaatagaaggtgaatataacctttgtgagatccaaagaatgaagggaatggcttaattcctagattatggaatctgcgttcctcacgctactgcactactacagaaataggctagcccccctctagccatcatgcagaccgtgacatcgtccgagcacctctaccgtactcaccctaacttttaaaacctaactagcaaaatacaaatactctatgggtaaaaaaaataatatgtcaaagataaaatatattattttattaaatatgttagtatcacttgtttgcttatttacatatattgtattcacctgtttcaaacaaatactgaactactctataatatttaaaaaatatcagggctaatttataaaactgcaaagggaatggtaagatggtaccataatgtattttgaaggagcatagataaataatgctctacagtctacccatatcacacattacttgtgaagttgtgatcaatttgacagtggttttgctgccatgaacgtcaatcagctaagtttgtagtgtatgtacctaactaaggctgtgtttggaggaaccctcctcccggcacgtaaaacgaagcacatattattgcacgattaattaagtattaacttttttttgaaaaatagattaatatgattttttaaaacaactttcgtatagaatttttttttttgcaaaaaacacacggtttaacagtttaaaaagcatgcacgcggaaaatgagatagatgagttggtaaactgggataagaactcagccgaagtgaagtctacattaaaaaaatatgcgttatgagagtatacactgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgccgggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcacagtagagatcgtgcgggcgccctgatcaagcgacccttctctatataaaccgacccgccgtcttcacgcaatatatgcgaaaatcaatctagggtttgcctcctactctgtactgcgccatcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggtaaacctgaaggagttcttactgctgaacagcagaagcaattcgaggaagccactactctctttgtgggatgcattcttagcggtcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccacttcaagaagcagaagaagaataacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcggaaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggt

SEQ ID NO: 48124 - DNA, 2353 bp, Oryza sativa
ggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggtagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagttgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctgatatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttacttattctaggagagggggacctccttaaaagggaggatgccctcctagccacttgaagcatgtgtggtggagagaagaggggaaacacacgcgcgcgctcgctcgcctcgcctcgcctggcctggcagggcagggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgt

SEQ ID NO: 48125 - DNA, 2560 bp, Oryza sativa
gctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacatacactaaggaaaattgttcaaaggaaacaacaaaaataatgtttcagtgtgtgtattcgtcccattttagacgttggctatgaaaaacaattttatagttcactccaaaaaaagtaaattttaaggatacaattaaatagacttaatattcaccgatctgaatgtcgacgtcttccgtttaattttggttgttgatatactcccccgtcttaaaatataagagattttgaacagatgagacactttttattactacgaatctagatagagtagtactatgaagcgtcccatccatgtaaaatccattttattttgggacagatggaatactatgaatctgaacagagagtctgtccagatttgtaatttgtagtacttgaaagcatgtcatccatttaaaattttttatattttagccggagggagtatgttttttgctttcacaaaaatgtacggcaccaaccccttgccgacacgaggtacgtaccccatggtactagatactagctagctatttatagtctctatagaccccaacaaacacttcatgactttgtctaaaataaatctaacacgccatattccatctagaaatatgtttggcatctgttcttctcaactccaccttgaaatatgttaggagtttgttttcaatacatagaagagtacgtgtgtacaatttaaataaaggttttcttgtggttactccagatgaacagactaaacacgagagagatatgatgtcgcagcgaagacaggtcaattttcagagtgggataagttgtgtaatgtgcagccatacagtgccagaagattttattttctcgtgcccattttgctcaacaatgttggcacttttttggaatccagtggaacatcaattttgaattcatgcacatgattctcacaacacgactgtacaaccgattttttgtggaggtcattggattagtatatgctagctggaatttttggacgagaagaaattatctcatattcaaccacattaaagtatccttcctttcttggaagaatggattcaaggaggattttattctacaggtatgtttggggagcttaagattctaataagcaattgattggtagccagcttctgagaatctgaaaaagctgatttttcagcttctagcttctagttcattttctggattctataactatagcttcttagaatctagatcaaaagctggattgtttgggggagcttctgattctaggagaagctgcagcagttagaagctcccccaatcaggccctacgtatacatggagtaaagtgtgggaataaccactttggcgatcatggatggattctcttacataatttctttcttaaaaaccttttttccttgtacatacaaccagtgtactgtaaattatcctaatattaatatagtacaataggagcatgtcctactgttttacataaaaaaagtaaccatgaaataaaagtcacaaggatatacagctatacgtacgtctgtcgattttatttgtaaagcacacttcaaatatagacgctaatatgtacatgtgcatacttgtcctgtaatcatcctcgtctccctcatataacacggaataacttgatattgatgaaagtaattcgccacaaacatctccctcatatagctatagctaggttcgtgtacctagctctatatatatgcccatgcttgtgtggtgcatgtacgactgtacgtgctatacatacgcttgctaggtgcagatatgcatgcatgcagccgtccaacgatcgccgtctaatgaatgggacgagattctacgatctccggatcataacatagcaaccgaatattattatatagtacaacgaatttggatatgagctataaaatatcccattttaaccctatgcatgacagatagaagaaagtgttaacactttatttttttcacaattgttttttcaccagataacactagagttgatgtactacttataggacccaccccctccattttataaattcaaattcaagcatttttttgtcaaactattccgacgtcgtttaccctaccggaccctacaataactgcagttacggcgcgaaggaagtttcatcggctatgtgcctgcccaaactaattaaacagaaaaatgtgatttcgatcaatgaaattacacccatgtgtgt

SEQ ID NO: 48126 - DNA, 759 bp, Oryza sativa
aactattgaacctatagaatttttgtcaacatgatgattttacatctttgtccacaattctggcttcttgatctatctactcttacaagcttgttcttaggagcatttctactggtcaaaaatgcaaatttatcaccatcatttgccacaacatgatattgggcatcattttctctgtcttctgggctggtaccctggtacacaaaaagatcgaccaatgataatgccattatctacgagaccatgacatgataacaattggttggttagtttgtcatctgcgctaggatcttccttcatttcttgtttatccaacataaatggctattttgcaagatcgcattgctcttgtttgttttttctcatctaaggtattaggtttacttcgaaggtataatcatatgtatatatatatatatatacgtatacgtatatatatacgtatacgtatattagatatacgtatacgtatatacgtgtatacgtatacgtgtatacgtgtatacgtatacgtgtatacgtgtatacgtatacgtgtatacgtgtatacgtatatacgtgtatacgtgtatacgtatacgtatatacgtgtatacgtatacgtatatacgtgtatacgtatacgtatatacgtgtatacgtatacgtatatacgtgtatatatatatatacgtgtatatatatatatacgtgtatatatatatatatatatatatatatatatatatatatatatacacacgtatatatatatatata

SEQ ID NO: 48127 - DNA, 9594 bp, Oryza sativa
ttgcttctgcagtgccattcgttcgtttttgtggaatgaaaatggacaccaaggcaccaagctactattacaatggatatatggtacattcggtattgtagtcattgttccacactccatctacaaacagagtttgacgttccatatggtttatatgtacatgaatttgtgggggtggcaattgatatgacaacattgatggcactcaactaattatgctaaacatgtggttagtataattttttaccgaaacatcatcacatatattaaatggagtatcaattaattgaaaggttaatcagaaaaatattaatcagtttatacgggcataaatatgaattaattaaaaccctagaaatttaggcttcagctaaacctcttaatgtacaaatattatttgttcagctaaaccctagatctaccgagacatgtccaatactccctccatcgcaagaagaatcaacctaggagaggatgaccctcctaggttgatgtatgtggacataggggtgtctacatacattgtcctaggaggggttcctttctaggttgattctttttaggacggagggagtattggacatgtctcgatagatcagtagagcgcaagattgagcaggttagtcattattattccacaaattgagtaacatttataacagtttttcttactttatctaggaactgtggacggaatgaatttgaacttctgtcatttattttatttgtaaaaatctcaaaaataaacttcatggcaactaaaattcctcttcatctcacttacatatgctatctccatatctatagaaacagtgctttcccccagtgcatgttcaacgtccataaggataacttgtctgtacttctctatgtaggatgatctcatgattgattgaggaattctaatgttgtcatctactgataaaaagcttggagaaagcccttgggttgtttgaaatcattaagcctcatcatttctatcctgatgtctcctactcttgaggcgctaccttctttagtcccggttggtggactaaagatttccctctttagtatttgaaccgagactaagatagcgatctttagttctggatttatagtcccggttgaaaaatcgggactacaagaggttctaaaccgagagtaaagagcatttctccatcagtaatctattgcacgcgtttctccctcctaattaaggttgggcttggtaaaccggcgatgcgaggtttctgggtgatgggcagcgttgaggacacatgcaatttgcctagtgtccagtatctgcgaccgcgtgtgagcagttaaaatttgcatgcaagccacatccaacctctgtgttttttcacactcttgatactctgaaaaatagttcagggataggagtgtcaatgagagcacttcaagagtgcaactattgaacctatagaatttttgtcaacatgatgattttacatctttgtccacaattctggcttcttgatctatctactcttacaagcttgttcttaggagcatttctactggtcaaaaatgcaaatttatcaccatcatttgccacaacatgatattgggcatcattttctctgtcttctgggctggtaccctggtacacaaaaagatcgaccaatgataatgccattatctacgagaccatgacatgataacaattggttggttagtttgtcatctgcgctaggatcttccttcatttcttgtttatccaacataaatggctattttgcaagatcgcattgctcttgtttgttttttctcatctaaggtattaggtttacttcgaaggtataatcatatgtatatatatatatatatacgtatatatatatatatatatatatatatatacgtatatatatatatatatatacgtatatatatatacgtatacgtatatatatatatacgtatacgtatatatatatatacgtatacgtatatatatatacgtatacgtatatatatacgtatacgtatatatatacgtatacgtatattagatatacgtatacgtatatacgtgtatacgtatacgtgtatacgtgtatacgtatacgtgtatacgtgtatacgtatacgtgtatacgtgtatacgtatatacgtgtatacgtgtatacgtatacgtatatacgtgtatacgtatacgtatatacgtgtatacgtatacgtatatacgtgtatacgtatacgtatatacgtgtatatatatatatacgtgtatatatatatatacgtgtatatatatatatatatatatacacacgtctatatatatatataagaaatttgtgtgatgttataattattggatttaatagttaaaaacaacttattgttataaaaatacccatatgatatctgaaatacgtaatttagttcgtaaaaaaatatgcgttatcttagggagtattgattcggcgttaaatgaaaaaacggctagatgagcttttttcgtgcgataattactcttaataaaactggcggctatgtttttattagaaaccctttttcatatacatcatatgcttggtatccttactaattaaaaaattaacttggtatgacaacaaaattttgactcaacaaatacatcctcacagtctatatcatatgttaattttttgttagcgcttgctccggacatcgattgcggcgtgtcgtgggggtggccgccgctgttcctccatatccatccgagtccgagcttgccgccgcagaggtcgcgccgtgcgcgtacgggcggaacggcggccagattcgccgccgccttgcctcctgcccgcagttgcccgtcacagccgcacccaccgtcacccgtgcaatatccacgccagatccacgcgcgtggggcgcggagcggcagccagatgcgccgcctcctcaccccctacacgtagtcaccagttgccgccgcgctggcagccgtgccgtgccggatccgccgacgtcgtgcccgcctctgattagcgatggaggtagagctgccgcgcctccagcccgcatcagcccgtcgttgccacgcccgcaaccatgccgtgccgaaaccgctgacgttgcgcccgccgcagctcggcggttcaggtggagccgccgcgcctcccgcccgccaacgctgcacccgcagtcgcccgtcgccaccgcgcacgctgccgatgccgtgccggatccgcctcgtcactcctcatcatccccgaaccaccaccgccgctcctcctcgacgccagttctccgcgtccctgaaccgttgccgccgccgctcctcctcgacgccaagacgtctgttagacaacaaatttgcaatataaagaagatgcaatttttttcggtaatacaccacaaaatgtaaacaaaacaaaaatccatgaaatcagtacttattttgtactattgcacgcttatttacttcaaaatgcttccagtaattaaactatcgaagaattaacatatggttttgcatctttactggaaagcatatagacaagattacctagagccttgttcatcaggtgcttggacaagtcacattgcaggtagatgcgatggagatgacaattttcttgtgaaaagggcgatatttcctccagcctattgttctcagtgttgaaggcaaagatccaaccgtctggatcatcagccttgatcttggtcatcatgtaaacaacatcgtcacagtatagatccaatgtgggaaatgagctcacaacattgttcagggctagcttgtgctcgttgcagtcaaagatctcaggaaacaaacaagcaacacatgagtcggcaggcaaaaggctagcagagtcaacagtgccgcacggctcccattgccaataattatctgaacggatcttcctcttgaacatggtggcctcccatccacggtttaactgtgcatcattaggatccaagtacggaaatcccatctcgatgaacttgaaccagccatctctacaggtgacatcccggaccagatccacgcaaggtccatcgggactgcctccggagtcaacgttgttgatgggcatcaatgggggcagacggatcaggctcacctcggggcagttcccggggaccgagtcgagcagtaggatgctgttccggaaatcaacccaggccattgatcctcctcggacgacacacaacaccttggtgggtaggaagaaagggttgaacgcctccatgccacgacccagctttgcgaccttgttgctccaccgcttggtcttgctcgagaagatatggaggtggaacttcatccagtcgtcgtcatggaatcgccattcggggtcgacgaccagacagtggtcgccacaggataagacgccggcgcgtctggatacaacgtcaagcgggttggggcgctggatcaggagctcgagagatggcgtcccggggcccgacttgtagacgaaccagtcggtgaccatgcatcggtcagagcggtgggggaagatgacacgtaggaggaggaaggcgccgtccgcgccggtgatggagggcggcgacatggagaactcacctgccgtcaggccggcggggcagtgaacaaagcagcgggtgagggcgggtggatcggcgaacacgaaggacacctcgatggggtagccatcgctcgacttcgcccgagcggtggtcgcgttgtcgtggcagcggccggtgtgcgcaacagtgtcgaggaagacccagtcagggaagtcgccggagcgccgggaggaggtagcgggttggggcatggcgaatcggcgagaggcagaggcggcggcgaaagacatactgtatcggatcgggacaggggagaagattggatttggggattagggttcctctctcacgactcgctctcggggtgggctcgggggtgtttgcgccccgctgctggattcgtgtcggttgtcaagccctgcccaactacggcccaaatactactccttcttcttcttcttcttcttcttcttcttctttttttccttttctttcttaaaaaaaaggaataagttcactttacgtcccttaatttgccgccgagtctgaaattcgtccctgaaccgcaatatcagacatgacctcaactccttaaaccagtgcaaataatgtctcaaggtggttcggacggcggtttcggcctacatggcgctgacttggcacttaaagtccaaaaaaagaaagttataaaactggccctgatagcacatcgaaaaccaagcgtggaagatacgccataggagatccaaacacgataaagacaccaaggcacgatatttgttaacaaggttcagccgtagcctacatctccagggcactgatcacaggcgcccctccccgatccagcatatcacatcgtatcagagttacaactactcaccacccgatgccgccggcaaccgctccctctcgctatgtgtcgaccgtattccgattgtattggggtacgccgttactaggatctacacgaaaatgcattaagcacacaaaagtcaatgattatactggttcggacccctcgaaaggtaatagccatgtgctcaaggcctctggaggattcttttgtacttcccctctcggatgatgcatatggtggattcttatagttggaggagttgagtcaggaagatatgatgcttggattttcatttggggaaccgacacatatacaaccaagaggttttataagcttaatttctctgccgtgcaacctcctagactcatgatctggctgtggaaaaccaaatgtgtcatgaagataaaagtttttgcatggtttttgttctgtgacaggtttaatacaagagatatgcttgacagaagacactatgccaaagaggatgatgatctcacatgtgctttatgtaatacacatcagagagaaacaagactccatctctttttcacatgtcctttcagtgctcgatgctggcagcacctaggaattcaatggaatcacaacttggaattctttcagatgattgttctggcaagactcaggtttgcttagagaggcttccttgaggttttctttttggtatcatggcatatttcgaagcaacgtaacggatttatctttcagaacattcagccatcatttcaatcctggaagtcactttttttgttaaagaagttcttctgcatatgtgcataatgaaagatcccctcaagcaatctatttctgattggttacaaaccttgtagctttgttgcttttctttttttttctttctccctaaccttgtaaatactttttgtgttttataaaatttacactactgggcaaagccttggcagtattcctagttaaaaaaaaggtaatagccatactccagtttatacgagtatatggacaaacaccatagagattacaatagaggaataatagaagctatctagattaccgactataacccgtcgagaatggcccggcgagagccgtactactaagagaatctccaacaccctctccatcccactcaacaagccattcggctgggcaaactccttccctcaatgaccaaactttgtcagcctactctacttgccatccgtgggtctcacggcatatcgttgccgcacacctccacacccacggtggcctcctgctcaccgttgcgctaatgaagtcaccgctgtcgtcgtcatcatcatcgtcgtctgccgccgctgttatcagcgccacatcctgcgctcctccctctactccgtcgttgtggcctccgagggccttctcgccgtcgtggcctcccgctcgacgtcacccccaacgaggctgccaccgccgtcgttgtctactgcttcgtcgtcagggccacatcccacgcatctccctcgattctggcacagcagcctctgagcgcctcctcaccgatgtggcctccatcaccccacccctatgcggcctccacctcctccgctcagcgcggatttggctagcagtgtggacttggggaccgccgcctccgcatcctctgacgtcgaggaagcccgtggcaacaacggggttgggggtagatgggagggcggcgagctcgagcgccactgtgaccaagggatcaaaacacgtgtatacggtaggctcatggcttatgatacacggtgggttcaagaactcccatctgtcttatgggccatacgcactacactgacttcatccaacaaagagattgtcatggttacggataaggcatactgtcacgcccagaaatccggcaacctgaatctcaagcagattgtgtattaaatccctatccaggactagccagggtacacaaatggcaatttgatacagttccacgacttacaaaaataacaaaataaaacttatacgcagcggaaaaactaaagaactgaacttaatcttcacgtccaaagcgaagcttcctccatagaccacacaggcaaccctcgacaaccggaacaagctcaatcctcagagaactcatgatctgaaccaacttctgcttctggggtgggggaaaaataaagcaagactgagtaccaaccaccatactcaacaagtcataccaaggggaaggtatgatgcaaggataatcaaggaaatggctcattggatactttgcaataaaagcagcatttataaagaataatttgaaagaagtaaaaacaatataagtaattaagcagtattaacatcattattgtccaacgctaaatccacgttgcaacaattaatttggaatagtcttttctttaataggtttaattagaattaaattttgtaaaattcgtgactaattcatatgaagttagagtgaggccgttcaagtctataaattcatccaaaatcacgatctacatgtttgtttactttttatgtactgtttatttggagtttcttagtctttttcctcgttttacgtattagctatcgttcctgtcgttttggaggttcacaagtgtgtcggaagtgttccagaagattaattgaagatcgattattgcaaggcaagtcacacagatccgaaacacaattcctttgagaatattgatcctatatttaaattctctatttatttcaattgtgcatttattttcgaatgtcatcgggtggtgtgaacctaatctttgctgtggccaatttgcattaattaccctattccttgataccttgggttataatttgactagttggacttatatattggttcagctagatattagtataattccttagccatgcttagaaacattagcacatgattgggataactaatgtttcactattacttaatgatggatatttaatggtagctcacaatggctaatcgtgattgatcaattaattaatatgacaattaaaacttgataatagtgggttgtgagcacatggttttgatggtcgtgctcatgacagttaaggaccggttcgcgagcatcggttgtgaaacattaaccatgtcaaccacaagccagtatgggcaacggctttaccttttgtatagcatggttcattgtggggcaccagactgagaagtggcggagataagcccacgggggtcgctggggagtccatgccttgctttataagggggtgattatgatccaggaacggtgcactgctgtgaattgtgttatgcggagggtattgtcacagcctctactcgagtactttccagtaaggcggcgcatggtagacatgatgttgagactgtgtcttgtgggtacagtggtacccctctagccagagtaaaactattcgaatagccgtgcacgcggttatgggtgggtctatgttggtatttcttaacctcacatatagaatccgcaagtgcacggaaaataccgatgtagcacttcacccgggagtattctcatgtatcgatttccatagggaacgtgtgtgctaactctggatcagattcatccaaggacacgaagctatagataggcaaaggatagagaggtttcactcgtgaaaaacaatgtatacggaaagcttaactttaatcctaatgaggtacttcaggcactggctagctcgctgctcttagatatcgctctactgcgcacccggacaggaaggacttcagtatcttgagggctgtcttcagtgtcttgagggctgtcaccacctctacacccacctcacacctactgtgggatgcggagcaaacaccggaaatcaactacctatacaccacatctacgcagttaattagatgatgtttcggacgactaatttacaaagaaaacaagccaaaacttttgtctgaaacgacaaatagaagtgaccggaggtagtatatttccagcaatttggaactacaaaaggtgagaactcaccaccccacttagccttcctaatcttcaaactcctctaaagaaatagcgcgaatgaagagattagacaggagagaaggaagctcagtaaaagtgaatatggatccactaatatcaagatcattcgagtccacttcctttgcagtcaagtctgaaaacatttcttttccagatgcctcatattcataaacgttctccaatttgcaagccctgtgccttcctctgtttatcttttttttttaacctcgcggggtgtatttgtattagagtagggggaaaagctatacaatagc

SEQ ID NO: 48128 - DNA, 16164 bp, Oryza sativa
gctatatatgaaagttaaggtaaatatgatgaaatcaatgagtattttatggccttaatgatgcacaataagaggaaaattaatgtttctccattcttgccttgatgaattgtaagcatctgtaggctcatttaaaagcacctggcatagaacatccaacacatgagctcttgtcggctctgagatctaatttagactcttataataattattgctgcccctacgtaataaacagagtgtatttataatagtccttaactcataccagatagagatatttggtcaaataagttcaatctgaaatgatggggttgctttgctcactactctcagcaagattgtgattccactagacgccaccatgatacacgttgagaagcatgttgtcctgatacaaaaaatatgacctacaagttgtatgttaaaaatgttctggggattattttgtatattattgtaaaactggtagtatagaaaaagtaagcaatattatgcttactttttctaaactacccattttataatactaaaataaatccccgacccattttttcaagtcatttgttcgtgtatggggcaattatgctttgtgtcatataacaaggtggtgtctagaagagtcacaatgttgctgcctagcagctacatttgtgagagttggcagcatggcctgtaacccatacactattttcaattgaacttctttgaatgcgatatctctattttggcaagggtaagaattattatggattcatccatgtttattaagtaggggcagtatctattttggcgaggataagggttattatggacttaccctgtttattgagtaggggaagtaaaatctagtttaagttctttgaaatgagcttttagacttagtgattcattaaagcaaatatagcatggagaaacgtcaaactttcccttattgcgcatcatcaaggcgatggacacaccttggtttcacccttttttacctttcatatataacccctgaatatttccggtattttagtttcctatatgtcaattttgattctctgatcaattttttttattttaaagcagtggtaattgtatgatgactccctatatttgtatgatctccggtttatatatgatttaatcttcaatttgtctgatgttttttaatacttgtactgttattttgatttttgtaattaataattttatttgagaaaaaccgtactctaaaaaattatctctttaattttgtccatgtaggtaactggctgtgatgaaaatggaaaccacaggtggttaatggctatcaaaatcgtatagccattggtacactaataataacctaaatgacggatgctaacatcctatttctatccagcataaatggtatccattattttatttagatattgaatgccaaatgtgcaagacagggacatgttcttacttcattaataaggagatcaggagaatccattttaaggtcttccaccatcggatggcatttgacacagaaaagattaagacagagaaatctgagctgaagaacctcattttcgcatcattcagaccattttatctgatgatccccgttggtgatggatatcatgaatccccctgctaggacagccgtgatacatagcaactaagcaagtgataaaagggatcatttaagctgtttagtgttaacaaaacgaagtgctaaagcctaaaaggtgccctgctgctgcttgtggcaatgctaacacttgttggagcaagagagccatttgttaaagcacagaccaacctccctgctacaatgcagctgaagtttcctactagaacccaaggtgattcatacggagcactgatacctggtttgccagaagacttagcgaaagtatgccttgcccttgtccctcggagctacttccctgtcatgggtgcagtgtccaagagttggatgtcattcattgggagcaaggagttcattgctgttaggaaggaggtcgggaggcttgaagagcggatttatgccctgatcactggagatggaggaaagggaccctattgggaggtgctggggagcctggagcagcagaataggatgcttcctcctatgcctggactgactaaagctggatttagtgtggttgttcttgatggaaagctgcttgtcatggctggctatggtgttgattatggaaaagaatgtgtttctgatgaagtttatcagtatgatgctcgtctgaacaggtatgctcgagtcattacaagcatttattacagtgctcctttgtcttcttttcttacatcagatgaatacttcaaattctcatagtagcaatagtttcccaaaaaaccttgtacaggtaatccattagtgccatgagttttctaaatacagagtaaaaaaatttaaataggaacttgatcattgtaagttaaaatacaaaattaacaaaactaattcattctgcttaaaatactcaggtgggctgcactggccaagatgaacgtggcccgtcgtgacttcgcatgtgcagaggtcaatggtgcagtatatgttgctggtggatttggttctgatggcgatggcttgtcaagtgttgaagtatatgatccacaaagaaacaaatggacaataatagagagccttcgcagaccaaggtggggctcctttgcctgcagcttcaacggcaagctctacatcatgggtggccggtcaagcttcaccattggcaattcccgtttcattgacgtgtatgatcccattctccattcctggaccgagatcaagaagggttgtgtcatggtcacctctcatgctgtcatcaacaaaaggctgttctgcatcgagtggaagaaccagcggtcactcgcgatcttcaacccttcagacagttcatggcagaagatcccggtgccgcttaccggtagctcagccactctgttcagccttggggtgcttgatgggaagctgctgctgttttcccaggaggaagagcctgggtatcagactctgatgtatgatccgaccgcgcctgcgggatctgaatggcacacgtcgacgctcaagccatcagggctgtgcttatgcagtgtgaccattgaaagttgatgtcatcagtaggcatagattgtacttcctccgtcccataaaaaacaaatctagaattatatgtgacatattctagtacaacgaacctggacggagtcacgtccaatctaggtttgttttctgtgggacagagggagtatatatttcttgcattctagtgtctatatgttcttctggaactctgtttatatgtgattctctgttcagattattcctagccacaagcatgcactcaattcgtcagctagcttgtgtgttggaccaaacattttgtgtaaagatgcagacatttcacttcctgaataatgtcagatttctcttgctcctttatttcactttgcagtgaactgacttgtgggtgtacttgcacacttcactgttctgatgatacaagattccatttgctacccagtgctactctacactagaggacctacatcaacaaatgctgtcaggaaaaagttgccgcaaatgcttcaaagctctcaaaggtaaaagaggcatgtctttgaagcaaactaaaagttttgatttgcaattaccagccccagcttagctatcattgagttttactgtaaaggatacagtaaaatgtactacatctaagaacctataaggacgctgggttcagacttcagagacaacaaagataaccaattatcaaattgaccatagtcgcattaactgaaagttgacaacagctattttgcaaattgatcaagagcttttaagagtggagcagttgacagcagctcccttttttatgtaaaaacagtaaacccaagaaacaaatagcaaaaattctgagcataattttggagcttctctgctagtactcagtacagtactaacaatactgctccagcatttgtctgtttcctgcattagcaataggagcagcattattgccagccaacgcctgccatgagtagaataatttgcctagttggtgatggatccccacaaactagtataccatcatccagattgaccatgatgcatggcttctaaggatgatttaattaattgagcataaccaactaccttactggagtactactctggtgctgaattgtaatgtaataatgggaatgaacaaatgcacgttgcaaggacacctatttttttaaaaaaaacattccattctattttatgataaaagaaatttcaactcctttgtggtttggccggaatgaagaatattcttactcacatgtccgtcaaatcttagtgactatcctgtatggatttggtggtaatcatggaacttctttttcaagaatgttttgtgctgtttaaggtggaaatacaccaatttctcattacagaagctcattcatatcaacttttattccatcctaaatttgcaagaagtaaataaattttggaccttgagcagattatctctagggagtcaaaacaagaggaaccttaggtgaccaggcatgtcaataataataataatgcaggcaaagaggggcccaagaaaggttccttgcttgtacaaaaagaatcaactggacatggcaacagtgttacatgttgatggtccagcaaatatagtcatatatcaacacatgccaacaaaatcatcaatgacaattaacaagtaaacatgtatactttttccctacattatatttgcattgcttgtttttttacagcacaataagcggccacttcaaaacttctttttgtcgtttccagctgaagcatttcaggggtaaaaagtatatatattcccctcgctgtcgtaaaaagcaattttcacaggaagtagaaaaacaaaattcaacatcacaatgctgctaaaattcagctaatcattctgctcttttctcttcttcctgcagctcctgaatttgatcttccaaaaagagcttgggaagcagcctcccctggacttggatgccctgttcgcctttgcgcctttcctcgatgatttcagatactcttcagcatggacagcgccgttctcgatctcgctaccgacatcagcgacgctgtcatcgtcgtactgctgcttctcctggagaagttcgaggagcctctgcttcttctcgatcagagaaggctccgatctgtccaccgatattcgccccgcgaatggtgactgtctctgatgatctggggtggtgcctcttgatggagtgaaatctgtagagttcagataaacagaaggcagtaatgttaatgctttggtaacaaactccagtgatacagcagcataattttgttcactttttttttgaggaattttttttggtacctcctctcacactgtggaaatcatcttcactgtcggagtctaaccagggtcttgcctcgaagaacgattcatctttgcttcctgggacagtcgatcaattcaatagtgaggtaaatgtttcagcattagaataccataatgcatggtcttgtttgctgtcatagctgaatgcattatcaaacaaaagagcattgcaattgaatatggcacaaaatattgcctgcattcccctagagatcaattgaactcttaactttaatagtcctcaaagaactgtgacttcagtttattgcaaagaatcttcgaagaagaaacgcgtaaacagagtaaaatgaagaaacattgaacaacagagcctatcagatgtaatcagataaaaagcacttttcttctatactgtcccttgccagttatttgtcaggaatctgtacgagtgatgcaaaattccacgaacacagacaagttttccaacatgtacgaaagagaaaataaatccattcttaatcacccctgttagtatcaacaatccataatgtccaaatgacacgatcctgttgttaactccacatgtcctaatttccaggccgtcgtctttgaaaacccaatcccaccacacaagacacattaaaatccgcaagaaattaagcacatccaaggggttagaaaatcactgtcctgacactaacatcaagactagtactactacacataccacctcatcccaaaacaagagagcaatcaagatcaaaagaaggagcaaggaataaggtgaacaatcccagcaaggacattgacatttcacatttgcaatcaggtcggggcccccacggctcgtcgtgtcggactcgaagctgccaatctaatctaatctaccacatggttggcagagtggtgagtacttggcctgacgaacagaggcagagaggcacgcggtggacgccacgatgatgataattgacaagaaaagttagcaagaagattttgcagctgcacagcactgccccctgattggtatcgcaccaaaacaaaatcaattcgatgatgaattgaaacgggattaatcaattgcaagagggggggataaaagtattcgttgcctcgagacgactcaactaaccccactagtggtggtgaaggaactgaattattttgccatgtcggtgcggatgagatgagaattttcaactaaaataactaatccgggtttatctttatcacggggatgcgagattgcaagaacaagaactcaaggagcaagaaattccgcggtgaatttcgtgatgccgtggttaattaattaattaattaattgataacaacaagaacaacaataacataaggaatcatcaagaactcaagatcgtgcagcggaaggaaggggagaagagatcgaagggtgttttacgtgacgcaccattccttgtgctgtcctgatccgggctctcgccggcgacgtccgccgcccctccgccgccggcaacaggcgccgcgaacttgccggcgttaggaggagaagaggccggccggctgccgtctcccgccgccgcagccttgttgcggaacctgaacctcatgtgggcgcccgcaccgcgagatcggaaagcgagaacgcgttgcggcggcggcggtggcggtggcggtggcggtggagtggagaggagaggagaggatgagcaggggaggcgaacgcgtagcggcggaagcggaaggcggagcgaaacaccaaaaccgttgttgggttggggggaagaagaagatggtggaatgcggatgcgatgcgtgcgcgtgcatgcagcgaccgtactaggcgcggtacgtaccacggtggaagcgggacgacgcgcaccccatgtccccatggatgaactgcacgttttgtttgggagagcttctgtttctaaagctgtgtttagttcacaccaaaattacaagttttggttgaaattggaacgatgtgacggaaaagttagaagtttatgtgtgtaggaaagttttgatgcgatgaaaagttggaagtttgaagaattattttagaactaaacatggcgtaattagatagaagctcttctgaacggttttttttcgttcagattgtgagatgttatagcggtacaatttagaaaataaactagaaattaaaattaaaaaactcgttttttttcatgttctcataagctgattatcaactactccctccgtcccaagatataagggcatgcacaatggttatcaatagtggtctcttagtgttgctaattaggaatacttgttgacatggaagaaagagaaagaggagcgataaaacatcgttgttatactacctccgttttttaatagatgacatcgttgactttttctcatatgtttgaccattcgtcttattcaaaaaaaaatatataattataatttattttgttatgagttgttttatcactcatagtactttaagtatgatttatatcttatatatttgcataaaatttttgaataagacgaatggtcaaacatgtgagaaaaaatcaacggcgtcatttattaaaaaatggagggagtacataacaacggcttaacaatgactcttaatcactataatatggaaatatggttgcatgagggtaaaaaattggaaagaatattaacaaaaggaatattttctgagttaatgattagagtatttgttgtctcaactactgtaaatacgcggtctataaataatcttgtactattgtttaacagaccaatactcgtctctaccattgaacatgccttataagaacttttcggatacataatagtactatgatacattatagtacaacgaatctggacgtatcacatccaataaaaacgcttatatttagagacgaagatagttgtttctttaattttaagctcatccaaacaaccctatgtataccgtcatctccttaggtggtgtttggatccagggttaactttagtccctgtctttacacactaatttagagtattaaatatagactacttacaaaactaattacataaataaaagttaattcgcgagacaaattttttaagcctaattaatccataattagagaatgtttactgtagcatcacataggctaatcatggattaattaggctcaatagattcgtctcgtgaattagtccaagattatggatgagttttattaatagtctacgtttaatatttataattagtattcaaacatccgatgtgatagggacttaaaagttttagtcccatctaaacagggccttaggctgtgtttagttgagtccaaagtttggattttggttgaaattggagatgatgtgactgaaaagttgtgtgtgtatgacaggttgatgtgatggaaaaggactgaagtttggatccgtgcgggtataaactgtgtaactgtgaaacggtgagatctggaatctggatgatgctccctacatatcaaataagtttaatttcacttgtcccgtaaatactaataaaataaaaaactaaaatacccttattttatcaaatcaaatgattcttaattttatttactcccaatataataattctctactttcacaaactccgatgcaatgattagttgaaaataaaattattttgggacaaatgtgaggagccaaaaatgaattattattgagacggaggagtacaaatgtccatagctcccgatctaagatttttatgtttttcattacacggcacatcactacatatggaataccatgctcacatcccccgctaatacgtcccataacttataatttatgctctaatagacgaaaatcagaggtacatttttcttaatacttatggaaaatctcatttacatgtgtgtaatatttttgggtgccataatttgtattctgatggagggagtcatgcacctatgaatctatggagaggggcctacaattacactgaaaacatttggataaattattttgttattaatttttatgattatacgaaacaagcgcgcgcgcacaccactacacacgcaacactacactttatcaaacttttttttgaaagggaactgtgtcactattttagaggaaacataaaactttaaaccactataatttaacaatttaacagtaaaatttcatttggatcgggatctgaagctgtgtttttttgtataatacacaagttatataagttttatgtgtcaaatcagggagttagttacgtactatctccagtttttttttataacgtagttgattttttttctaatttgtttgactactcgttttctctacaaatattcgtgtaaatagttaaatatattatgtgtgtttaaagtaaagtatttaaatgacagagtaataactaagtaattgaatatgaataaatattgttgttaaaatttaagaaaataaatcaaatgtttattatatttgaaaatggagggagtggtacggttgctaagataaaaaaaaaagagagacaaatatacagaacacatttaaagtggataactgatgaggtgtcctgccataatattagaaactattaagagcggcgggctgggcgagcgctgggcgatgccacgtcggataggaacagtgcgctgggtggaattttttccaaaaaagccctccgattttctataattacgtatatgccccacacgaacagtatttatggaggagaattcccggatagggacttatatgtaaaaagttaaagcgtagggactttttcgcaaaataacgcccactacttaactccccaaacccgtcgccgcacccttctccctctcgtctctccctccccctctctctctctcttccgccgcctccgccttgcgccgtctccgcctcccgctcacgccgccgcatccgccttccgctcgcgccgccgctgccgccgtcgtcgcatcggcgtccccgaacgcctcccccaaccctagccgcctccgccgctcacgccctctcctccctgtccctctcccaccgccaccgctccgcgccgccgtccccgcctccgcctcgcgccgccgccgtcgtcatctccgcctccgccgtgcgccgacgtctccgcctccatgtcgcgccgtcgccgtcgtcatctccgtctgcgcgtcgcgccgccgtcgtcgtcatctccacctccgccgtcacatccattgcgtccccgtcgccgcctccacctccgttgcgctccggttcggtcaccgccatcgccgcattgccggatctggcggggggtggtcaaatccgtgtcccccgaccatggaaggggcggcctcgggtggagcaggtcgacgctggccacgaaggtgcaaagcttggatggagcagttcgtgcagccgtcgccatcctcctcctcatccctcgaagccaaggtaataaaatcgttggatccggcaatgtagtggcccgagaaggaaggagatggcgcctaggtggcccattgttttgtgtcagatagttttatgtttgccggtttagtgaaaattgagatgattcaccattggctatgtcatgaaaagagtgtttgtctgtaccaagccatcatttttactaccataatttgtaataattccgttcatatgatcagggaccatatcggttatgttgatgtccataaataaatttcaaattgatcaaattttaggttagacattaggttgaatagaaactattccgcctaaataagctattacgtgcgtgtcgttgatttgatttgttttgtctggtgtttttggctgattggtttgtgattgttgttttttaagatcggcattattggtgagtgttcgtgagcatacgattggatctggttttgttcttgttatgtggattgggcgtggatttgtgatacggcttttggtttggatgctgcagggttcggcaagcatcggcgttgcagagtgaggatgtcgagttggtcgccatcaacgactccttcatcaccgctgagtacatggtactgccttcttccctcaccaccttattaattacttgttagttgctttgagcgtgtaaaattgtatgctcattccatgggaatgatttgtacaaattagatgttatatgaagtggcttactatgctcatcaattgggattgatacttagtagatttgtctaaattttttaagactatggatttgtgatctgcactattgtagattgcactgttgttctgttctgatggaacacggtgcactctatttatagtatggattcataaatgcaattcttatatgctttgaatatctgactaaatattttggttgatccatatagttggggtaatctattttttatctggccatgctatggatacgttgcttgtattgaaaatgaaatttattagattgccatttatatatacagttgtaatatccatatctaagttctcttgtaatcagttaattcatttgcattgacgcacagacaagaacaagacgcagcaccgcggagcaagcagagcaagtgttagtagcaagaagcagtgacaattcggaggccatcgttgggagcaggagggaaagagagagagagagagagagagagagagagagagttgttgtggaggagagagaatccaggtgcagggaagggaagggtgggcaggccaagatggcaagaagaggaggaggaggaggaggaggttggtgggggtgggggggggatcaatggagatggagagcccgcggagcccggaggcggagatcgggcacagggtggaggacctgtgggaggtggcggagccgcagctgtcaccgtccgagaagctcaactcctgcttcgaggacatcaccgtcgcctccttccaccgcccgcttggctcgcaaggtatgtaactaacgcctctccctgcttctctgtgaacgaacatgtttgtgcgtattctctgatttgattagatgattttggttcttcatgtgaaagctgacatgaagcatttctgtgttgatttggagtcacctgtttagttcagttgggtgatgaaatttgctgatggagatggtgaaacaaattaaaacattcggtgttccttgttggaattgatacagccagccagttagttaattcattgattgaagaatgtgtttgctgtttctcctgattggattaaactggtggcattagtaccttgtcactgttgtgggtctcctgtcctatatatatacatttttttcagcttcttgatggaatggaggtggccactactttatattagtattttcatttcctttgtgtggttgctggggccatatttgcattcttttctgaagcaaatgcgcattgccacttcgtgcatgtcagtgctgatggcctacatcctacctccagtctgtccaatttttgttcttgacaggttgaaaagggtggcattgttttatgcaaccagtgactatgcaataggggattgtaggatttcagccttatctatatgatgaagttttgttttagacaaagacctgtatgaggagtcaggggggagcatggtgattgctcttgttgaagggtccttttcatttcttagacgcgctaaagaagaacctttctcctgtcagaaaaagaagaacctttctggacttccttattctttatgccaatatgtcgtatgttattaatatagatatgtgcttactgacaagtgacttcgctctcatgattccaagatatgttctagaacggtgagggtccatattaccgtctgatttcttaatagtgatctttgctatagaacctgtttaaacttgtccttggctctcatcttgttagtatctgtgttaaataatgttcttttcgttggtagtttctggtggttgatacagattgtatagataggtgtagcttttaccaatagtcagcattttgcgtatcttggctcacacctatttttctatgcccgcatgatgttaacatggcaacctcaacttcaaaatcttaagttggacatctggtgataacaaaatcatatcttcaaaattgttaactgaactgctttgttgtaccaatgccacattgagcgtgcttttattaaactcatttatactatacagatatgaagttttatacctgaaaattgactttaagatttttgtaccacagtttaattcgactatgttgttccatgtatatatatttttttacttgtttgagggtcggtagtttcagtcaatccacatgtccacacatcaggccgccacacctgttcattgatattttttgcctgcctgtagaaccaaattggtaattgggcggtaatttctaaatgttctaggcaaaaatgtatttctactaaccttaatatttgctgtggatgtcattccctttttttttgttttgacatgaacggtgaccatgcatctccagaaagttcaaatctttcattcttcttttagactaaacaacaggttttgtagtttatcattctcatcatagttcatgctaatgttacttttggttatgaaaagctcctttatgttatttttctgggtggggtgatggcaacacatgatgaagaaactagaaaaagttctttaagaattcttcagtcatttgtgttatttcacaacggtatgccagcatttgaatttcttatctaaatctattattatatcaatgctcagttgatataaatgaatgccagggaaataacacaaattctattatctaaatctattattatataaatgaatataatctattattatatcaatgctcagttgtgcttttggacttttggtcgttataccttttcttgtttcagtgctaagctaggattatatctgaatgtgaaaagtgacaagtattttttatcttgattaggcagagtctgacacagagttatctgaatcttttctgaacctgtgtgttgtggcacgcaatatggcaggctggctggcatacatggtgatatatacgcctctcccagggaccatatatgtgcttctctgcataactgggctctgccaatagctgacccactattcaagacaaggtataaagccagtccctacacaagaaccaatgccaagtaaatacatatgcctgctgtaatttttcccaacagattttactcctttgtttgccaaccgtgcttgcagtttgcagttgcagaggatgcatatgctttggttttgcaatggcgatgcatgcacaaatgggcatgcaggtcagagattggagttggtctcttttcaagtgactttgatgagtctgatgacccagggcaggttcacttcagtccacccttttctttttatgagattgactctctgttgctgacattggattaatgaatagcatatttggaataggaaaaaaaaaggagatttggagggagagacatccctctaaacacttgtttaggaagaaattgtgagcgtgttgagtattgaacacaggacctcggggttgaaaccacacacccccgaggataattcttgagatacacttgatagtgcagtgataagggtgtgtttagaaggacgtctctcccttcaaaattcaaatcttgttttttatttggataaaaaaatggaccagtcggcagaacataaggtggtgttcttttttaattaagacagattctaccttgatttttattaccatccttttcaaactgtcaaatggtatattccatgcgaaaactttctatatagaagttgctttaaaatattaaataaatccatttatcaagtttgtcataattaaaactcaattaatcatgatctaatggctttcttgcgctctcaagttgttgtatgactctgtttttctttcaaaggctatattatatttactctctatcacgccgtaggcttgtggagcacatgaatgatgagtgatgaattcatgaatatatataatcatatacaagcagtatatatatctcagtcctgaatacatgcatgctctctttgtgtattatgcaatatattcatatcgatttttgctggaacatgatcccaactgcctttctagctgatgtttgatcatgtatatctttgagttactttacaaaaggcattagcattatgcttatagggatttagggaggtgatcatcgttttaatcttctacttggaattcttttacaagtatctctttaaattgaaagattttgataaagggtgaagaaagggtagaaaccagaaagcactgttgaattgtcttgtattgaaaatgctttgcaatgatagatctactagctattgtactgggtgtaaataaaggtcctgtatattgtatagatccagtggaaagttacacgtagtctagctgtacttgcgaccatatggcattgactaatatttgatgcattttgtttatgtaggtcttacaacaaagatatgatctggtggtctactgaaggaaccattattcagtgttgcctacaaactgtaagtttggatgtgatcaatactgaggattcctttgacaaggttttccaaaaagaatttcttcaatggaactccttgatttgatggacactatgtttcttctgttcttgtgtcctttgatcttctttgtagtttcattacttgctcttcttgtttgtttgttatattatgtgataataaaaaaagaagaattagtaatagttataaattgatcaggaaactgttcttgtgtcctttgatcttctctgtagtttcattacttgctcttcttgtttgtttgttatattatgtgataataaaaaaaataaattagtaatagttataaattgatcaggaaactgggcagcattaggaaaggaatcaaacatgagaaggcggctctattttttgacataatagttttcagtgaggtag

SEQ ID NO: 48129 - DNA, 5903 bp, Oryza sativa
tgtggatactaaaggtctgtttgggggagtttctagctgctgcagcttctcccaaaatcagaagctccccaaacaattcagcttttggttccgattctgagaaattgtagttatagaatccagaaaatgaactacaagccagaagctgggaaacccagctttttcatattctcagaagctggctaccaactaactacttctcaaaatcttaagctacccaaacagacccaaattattgcgggcaggctctaaacggtgtagtttttatagaacttttcatataaaagtttttaaataatcaaacaaatccattcttttaatgtataataattaataattaatatattaattatacgctaattaagtgtcttctccggccagcaaaatagctactcgatcggccaaaccacagagacaaaggtgatcacgcattgtcgatctagcatatagttcaatttagtttttggattattcataataggttctctgaaatatttatatatatgaacagaaattatctcaatattcttaccatttaagaaggtggttctgtcccctcaccttcccttgtctggagagcacgctacttttatattttgcaaatgtgtcagtttggtcaaaatgttcaatgaacgccaacaaaagaggttggaaaaaagatatccttatgcaggcacaatgaaaaaaaaatctcaaattaattattagtacccatccgtctcaaaataaacaaatctaatacgaaatgctacagaatctctatctagattcgtagcatgatgatacatcacatcccgtataagagttttttttttcttaatagagaacgctgttgacttttggctaatattttgagcaacatgaataaccaaacgttatttcaaaagttagacatcatcgattaaaaaacggaggtgatatatattttttattttcttgttttagctatcaaattagtagtgctctctcctccttttattttctttatgcattagcgaagggcataatagtctttcaatctcatgtttagcatgaatttgattagtaaaaaggacaatttttaagtgagaatatgtgtgaacacacgccgagtatctatatctatacttgtttaaaagcatctagtattgtgaaatagtctaacatttggttcaaataagtgaataccaaataatcgagcaaccaagatatttgataaagaaaatatattttgcttatagtgtttttttctcttcgggcatttttgctaatacagtatgccatccgtcttaaaatataaataattttagactccgacacggtctccgagatactactttgttcaacaatatctataaaagtaagatgttttaaataaaaagagttacatattatgatagtttgtttaataataagtctagcaacattaattttgcatgatcgatattttttattcttttttatattaatagttaaagttaaaaatgtttgacttgtcactatgtttaaaatgcttatattttagggcggagggagtaaaaaaaaaagaaaaaacaaaacaaatatactttttttttaaaaaaaagaactcaacatatctccatcattctcccattctctctctccccccctctcattgtgctattaatagcccatcttctttcttacacaaaccccttctctaaccccctgctgttgctagcagaagtccaggtggacaagaacgcgaggaggggaagaatcatccccgagatctcgctgccgctgctcatggcgttcgcggcgtcccacaccgcatcgccgtcctcctgcggcggtgtggcgcagaggaggagcaatgggatgtcgccggtggtggccatggcctccaccatcaacaggtgaccggatccctctagtccctcctccctccctccctccctccccgtcgcgcgcgtgatcttggtttggtagggtgggttcttgcgcgcttcggggttcttcttggttcttgcttctctggggttggtgagatttgtgatctggcggtggatcaagtcaaatcgttggggggtgaaaaatgcatgttctgcgtgctccgtggtgtgttgtgggggattcatctcccacctcctcatcgagatcctgggggtcagaggtgttccaagattgatttgagcttgggttggtttgggttctctctgggggatgcttgattccagatttcctggcctctgatccgacccgagggtttcctccctgctcgtgatctcgatgggttcgtccgtgatccgctccggatttgatgatctgtccatttttttttctttttgcagctttgtgatatttggtttctgcatgtgccaccataagttgattatgttgatgattttgctgaaactattgcctgaaattgaccatggatgattatctaaagctttgatgcgatcttacccatttagatgtaaattattcctgtgcagttgcttctagcaattaaaaacttgtagtttagggcgattagggacttgttcgttcaaaaattggtccgttcaatttgtgtatcttcgacgcttttaaacaaaatcggtctgttgacctgaaattttcctggtgaatgatggctatgtgatggtgttgaactcttgaaactgggactgaatattaataacctgtcaatatcctctgcgagtaatcctttcgtcaggctaatccgctggttaaatagataagttatagagaattagagatgcatgtactgttgaattgttgagttgaaagcactgcttcttatggaaccaccatcaaccaactgagataggtgaaatggtaaaattaaagtgggttggtgatccagaatttttttttctccatgcttttcgcttagggtggatgcggggagaaagctgaaaactagtcgaatagctgttgagatctgaacatgttcaaatctgttgatggtgatagactgattctgaacatttaaggcctgctttgcaaccacctgtgtactccaccgctaacagtactgctttaggatttgtgtagcctcttctttctagagagcacagaagcaccttctatattcaatttgaattatgaatttaagaaattttcattttttttctgctgtttttaggtctgtgctgtagttttcttctactttactaataatttagaattatcaacaagaaagtaacgctagtgtaacaaaagggcagaaagaggatctgcgtcattgcctcccatgatttgataacagttatacatatgcggttcatgattatataccatgccaattatggagtgaattttgcattacgtttactgtttttgtttggtttatcaatcaatcaacactggatattatcatgtagagctcagagaacatggtagtttcaagcttgtcaatgtacctatcttggaaaatctcgaaatcgtagttactactaatgatattacttttgtccatctatcctgtcctaggcttttacctaggttgaaaaaatatttttgataaacactggtttgattaaactgtctatacaaacatcagacctttcttttcacatgaagatgaagatgaagttttttacgcaaaacgaggtggtattaacgtatgatcgattgagttttaattatgacaaactttaagaatagatttatatgatattttaaagcaactttcatatagaaagttttcataagaaacgtaccgtttagcagtttgaaaagcgtgccacgaaaattttaatcttcatccaactcttgttggagaaaagaacaggtgttaggtgtattttttgattttcttttcttggacaccgtaaaaaaattgcttcaaggactgaaaggattcccagcctagagatttggtggcagatggtttattatgagctggatacatcactctacctttctataagctttaattaaactactttcatatctattatgcgatatttcttctccattcttctaatttacttcaattttttgtagggtcaagactgctaagaagccctacactcctccacgtgaagttcatctccaagtcaagcattcactgccaccccaaaagcgggagattttcgattcgcttcaaccttgggccaaagagaaccttttgaacctcctgaagccagttgagaagtcatggcagccacaggacttcctgccagacccttcttccgatgggttttatgatgaagtaaaagagctgcgggagagggctaaggagatccctgatgactactttgtttgcttagttggagacatggttactgaggaagctcttcctacctatcaaacaatgcttaacacccttgatggtgtccgagatgaaactggcgcaagcccaaccacctgggctgtttggacaagagcatggactgctgaagagaacaggcatggtgatcttcttaataagtacatgtaccttactggacgtgttgacatgaaacaaattgagaagacaatacaatacctgattgggtctgggatggtaagagctaatatctatttaggcatgatgatattattttcctttttacttaagtttacaatgctattgtggataaccttgttatcaatagccatgtctccaatattcttaaaataatattttgagaactgagcgctattcattttattaaagcattggacaacataacctttcatgtacagttttacttctaaagcaagtaaaaacattgacttatatttacgtgcctacttgataaattgcttgcaccatgtcagtccatagaaaatgtgcttcattttttgtttttgaaggaaacatggttagatgattcactgcattttagaatcaaccgtggtatggttattcataaattaatttcattgttagccacgaatctaatttcacctcttgtacctaccttctgcaggatccaggaactgagaataatccctacttgggtttcctttacacatcatttcaagaaagagctacatttatatcccatggcaatactgcaaggcacgccaaggagtacggggaccttaagctggctcagatatgtgggacaatagcagctgatgagaagcgccatgagacagcttacaccaagatagtggagaagctcttcgagattgatcctgactacacagttcttgcatttgctgacatgatgaggaagaagatctcaatgcctgctcatctgatgtatgacggcaaggacgacaacttgttcgagcatttcagcgctgtggcacagcggctgggtgtctacactgcaagagactatgccgacatcctggagttcttggtccagaggtggaaagtcgcagatctcaccgggctgtccggagaagggagaagggctcaggatttcgtctgcacgttggcgccgagaatcaggcggctggatgaaagagcccaagcaagagctaagcaagcgcctgttattcctttcagctgggtttatgaccgcaaagtgcagctttgatcatgatcagtgagcaaccgagactgcatcctatatattggttctaagatatgaggttctctatatggaaaaaaatctaggttatctagctggggtagaatgcaattacctgtccatctgccctcacaaaatctgttgtcttttaagttgataacagtgtcgatgagtctggtgagaagctgatgtgagatgcaacagagtgaacttatgttgtattgatgtgagatgagtatggtgacatttatgtgtacttgcaggttttacatgacttgtataagttttaaagtaataatggagatttgtatacagacaagcgtgtgcactgtcgcatgattaagtagtctaaaatccagactatcttttgtgctctgaatttagcagtaataagattgatcggcttgttcgttttgagctctgaatccatattgaaatgtctgtgctgttcatcagctgatatccggaaccaaccag

SEQ ID NO: 48130 - DNA, 884 bp, Oryza sativa
ccatccgaaccatctgaacttacgcgctcgttggttgtatcgacgatggtcggttgccctgcacccttaaaaaattgttcatgccatctgtacgcagctggttgatgcttgcttacacgattttgcaagtaaacacgcgtttcggactgcccataataaaagtcattttcttataggagtccacgattttgcaagtaaacacgcgtttcggactgcccataataaaagtccttttcttataggagtccataactttattagtctgccaccatgacactccaactaatgacgtttctcagattagcacgactcaagcaccttaatcttgggactgaattttcaaatggttcactcacaattatacaaaaaaagaaaaagaaagagctctgaaaaagggcttaatcagtttatgttttcccatgcttttactggtcatttcttaaacatctcatgcgcacattaataaatgtgatcagacctttacaacgtgcaagcttacaaggtggtcacccggagattgatatgctacgttctccttgtcatcaagatgatggggaggctggttgggtcaagtctagtcttctaagacatgctttgctggaatggagctgctacgaccgcatctctcgaaaaagaatatcttcaattgcatctacaaacttcaccagatgtcgacgagtctgaagctccaatccattggccagttcctgaatgttttgcagaacacaaaaatttgattaggttggtggtttgtttcaacgagatataataaaaattgtgaatgctggaaatgattctttctacggtttcagaatttgtacgcataattttactgctgaaaatacaagcattggggctgagatgaccatctgtacctttgtttt

SEQ ID NO: 48131 - DNA, 1114 bp, Oryza sativa
taatcacatatctttccgaatacaaaaatatctattccattatactcttgcatatctttttgcagggcaagtaatgcataacaaaaaataaacacagtggtagcacgaacaaggtgataccttgatttcactcatcagctccttctccatcatctgtatcacacatttttcttttcaagaaaaaacacgagcagatgtaaataaacattgttagctgtttcacgaagtactatatcataaagtttttgttatctgattagtccaaagaggtgcaaatatgatgataccattctgcctgcaaatagtccacagagaaactggtctctaccatctgcaaaggcgcagcatcgatgttaagttgccataaatatgtcatgtgccacgcaccgctgataacagcagaaagagaaactctgtacagtaaagattcttgcaaaacaaagaattaaacgatttgcacctctatcaatacaatctacttctgttccatgatattacctggttttattggcctgcatacttgtcaaaagattttttttcttcacaaaaaccatgacaagaaatacctgtactaaaagaggaaaatcatagctcacatgtttcttgattaattaagacagctactctttcaagttataatcatatctaacttggcatttcagccaacaagctcctttgcaggatttggttcttcatccatgcttgttaaaatttaaccagagtctgcgtaagtaacacctcaatgagaagaacataagatgtgcacatcaatttatttgtttaacagtcagataaatccgagaagctaaaaaaaaaatgcataactaatatctacaaaagatgacaacttaatgcaatcattttggtgtctaaaaaacaattggaatccctttaccatctcagagaaaccactgctctgagaccaacacaggtctggccgaacatggtatcttcattcaccaatccaacatatgcacaaacggagatagaaaatgctgttcatatgagagctgtatacatatatatactcacattgccatggctgaggaaccacaatagccctctctgcaactgatatcttcattaatctgaaagcagtaaagcatagtagtgg

SEQ ID NO: 48132 - DNA, 6114 bp, Oryza sativa
agaacacggaatccttgcaactactaatttcaactttcaagtttcatcaacaaataaaaaaattactagcaaaatgcaaaggaatggtgaatcatgttacctggaattattagcatctttcaccaaggaacgcctcaaagtgttgattataatgtggtgttgaaattgccgaataatccatcccagtgatgtagtagaaatggtctctctacaaaaagagttcatttgagtgtaagaatgcataaagaagaaagaaacattggtcagtagaataacagagaaattgacattattgctaacatgagaaacgaaaccgtgttgaatctacatcatcaccttaaacattaattgatcacattgtttcaacaagctagctttttatttggaagaatatcaagcaagctttgtgaaagagaaggtaacaaatgcagaatacctggaggccttgagcttatcaagaagtatatctacacaggtatcatcaggaaatatctgaaaaaacataaaacaaactcagaatatacataaccagtacaaattcctaaaaaggcaaattcctgttgtgtcattattaataaacatggcatggtttggacagtgaaactgaactaagcttgcttttcttgcccacggttatgcaagagtgaaacaaaaaatcatcattatctcctaagcaatggtcacatggactcacgttattattcacatcttgttctgtgatttcaattgtgacaaccagtaatccgcaggcaatgcataaggcattacattttgctttctcaaatatgcaggaggactgcgcatcattgcatttaggacagaaaaatatatacaagcataaggcattgcatgcaaaatcaatggtagatgcataatgcaaaatgattagatcccagagataatttattttaaaatgtgaagacaaattcagttatgagattacctgcactttctttggttccatgttttctccaacttctatcagcaattcatggtctgaaacgaatgaattaacagaacaatctgactctttcccgtacattaaacattcaggcgtgagtacagcttccttcaggaataccctgagacaattgtctttaaagtctaaaacatttgcttctgataacatagattcaagttcccacattgcttcagcactggatatggtacatatgtcagcagaaaattcaaatcttcaaaccagaggaaacataaacactaaatgtaggtcagatgcaattaaacctcaaatgactataataacacatcttaacaggatggaatgatgcatgaaacctacaggtaatcatggttcaacatttagaagttaacaaacttaatgatgcaagggtaagaatatgtattctgcagttataaactttaaatctttaagtataaagccaagcaggagaccgaccaaagagttcatggctgaaaataatgaagatatgtacagcagcagaatcaccagctcaaaaccagaccaagaaatggatagctaaaacatttatgtcctcaagttaacaatataggcaaataagaatagtgctgggatttgggatgagaaggtcttctagaagattgaaatgctgaaactgaggaagataaaaaatggataaatgggtgctacaatatagtcaagtagtgcacatcacatggcttaatctccacgcatcattagataacagtaaaccaagcttaggtccattctgttcttaaagaattacaaataaaatgtgaagcaacagatttattatttccagggaatttcaaaaaagaaacatggcagagttcaaattcatgaaaacatcacaataaatgttttactcaaactgacaatcagataaagtccatgtggaatctgagaaacttcatctgtaagataaattaaattactcattattgaaaacaaatggtattaagttttgaaaatcatacagaatatgacaagctagattattattatgataaatcataatgtcatattgttcaaaatatgataaatgagtagaactagaattggcaatgctaagatgctgtaaactaattccattacaagattaagatgtcatatcattctgaacataaacaagcagtactaccttttttggttttctaacagcttcaggtcattctcatatttttccagctgttggttaagttccagtacctaggaaatcataaaacaggtatattaaaaggcaaattgcaaaaatggaaaatctcaatacaaaaaggctattaccgcatatgcattatatccatatgcttgattgtcatcgatattcgatactactctgtgtgaaagcatatgtatgactgcatgtgtttttgtttgaggaatacagtttttatataaagaggtgggaaatgctgtctatgttactatgtaggagaactgcattgagaaatgtacagtgactaccagattgtatgacacaatgttcaacagagaacaaaatctgcattcgagaaattatattgtgaagacattgcattgattcatctcatatttagctcattaaagttgtctaatataatcagcactttagcatagacagcatgatacatggaatctgtcaactattagaccatataaccacacctcatacttgtagtccttgtcaaatttaatttggtctctgcatgaatcagttgaaactgataactcagcgatgtggcttgcctccaagtgtttcaaaccctgcataaagaaagggcacagcattgcttgagaaaaaagaactaatgtaggtttcaaaagagtaaaatatttggcaatactacaaaattacatccaaccaacccaagtgataggtaaacactaacactagaatgtcattatggcaatcaaagccctgtactacttgttattaaattgtgcagctaaccagctacaaatgagattcaatggaagtgagtgaagcaagaaagtaacacaattatatgacaggagtcaaacagttgacgtgtacattccatctagggaacaatcctgtacttcccattcatttgggtgaagcaacttaaaaaatatttagcaagctcagaagtgatagagataagaaaataatgaggattacagggttaagcattcaagaacaacctgtgaatcaattttcttcaatgaagactccaattcggcaatatcagcatccaactgaatcgaatctagataacaaagtgttaggtgttgaagggagaactgcgaggagcatgctgttgtcaattaacaggaccttaaataacagagactcaagagaagcaaacctttgagagttgtctctgcaacgctgctaatttcaacagatagtttgcggttctcctcctcagccaagcttacctccttactcaaccattccatgaacgcatctagcagtatgaaaatccaattttacgagtagatttgcacaggatatgtggactaagctcaagctggtatgattatgccactgataaccaacaccacaacaattaaaatggaatcagacagctaaccaaagtcgctctccatcggcgcggcgctcgaggcccatgcgtcgaattccaacccctgcaaaggttcctacaaacacagaacccagaaacacaaaatgatttagcatgcctcgattttctcaaggaaaacaaaattaaaattaaaagcgcacccatttttctctcccctcatagtaataaaattcaaattaaccaaaccctcgacgttcacagccagtccacttaccacgtcctccacggagggaaggcggcgcaccgcgtccgccgccgccgccgccgccgaagcaacctcctcctcccctcgccgcgacagcgcgagccgctccaaccggctgacccaaaaacgaaaacaaaacgaaaaaaaaactgagatgaacgaacacctgatccgcgcgggcgaatcggaggaggacggcggagggtttagccacctaccttcgaatggccgccgcgtcgagcggcgcgtcggcggcgtcctcggctagggtttccgccattagcagcagcagcaatggcaatcccctcccctctcccgcccaagaaaaatttcccccgacttcgaaaaaaatgggtggcgattttgagaaatcccccctccaaaaactccgaactgcgatctagtccgcggccacgtcgggccaaacgggcggcccggcccagcaggcacggctcctgttgcgggccgtgccgtgctggcccacgtgctaaggcctcggaccaagcacggcccagtaaggccacgggccgtgccgtgccggcacgggcccaaatatagcacgtgggccggtgtaggcccattagcacgtttggcccacaaaattgaatatgaggccgaaaaataaagaaaaaatgtgaaaagaagatgaaaaaggaaaatttgtgaaaatattataaaaaatgacgaaaattagtgggaaatagaaaacaacatatggaaaaatcgggggaaaacgagagaaatgagagaaaataaacaaaaatatatgaaaagaaaagggaaaacaggaaaaatttggtgggccaacgggccgtgccgtgccgtgccggcccatggtctcatacgtcggcccaagcacggcacggcccacaagcgggcgtgcctgggccggctacagtggttaccgaggccttggcccggcccatttggccagcactcgccccttgcggcatcgcctcctccccgccacacaaacaagaaggcgagccaagccaagccaagcccctccgcggcgcgcgcgttatccatctccccctcgccgccgccctatcgccgctgctcgagctctcgatcccctcctcctcgctccgccggccgccgcggccgcaacccaggtcagaggaactcaggattccttgtcagttcttgcccgggctcgcatttttccttgctgggtcttgaatctttctttctcttcttgttttgtgtttcttggtcagatgatgccgcggcagtgcgggaatcgcgcgttgctagcggagggatcgagcacggtggtggtcgtccatggccgcaagaccagaggtggtatcagcactgtcacctccagcaggaggaggagccatggcggtgtcaggtaccaccggtgctgccccccgagggctcacctatggaggaagggcgatcatcttcctctccatcatgccaagatctctgctcgttgttccgaggtgattgaccgagtcctcattttcttgtgattgcacactcccaattttgctttcttattgacaaggaaaaaaaggggattgggttttgggtgatttgtttgatagatcaaggcccacacggtgctgcaaggttcagatgctctaagcagcatcagggagtggagcaggtcgcatttggtcaccatgacagggctggtggcgtgtgctgttcttgtagtcccttctgccgatgctgtggatgctctcaagacatgcacttgccttctcaaggagtgcaggtgagtgggattccctttttttgcatttgttccaagcatgattccaaaccgtgtgcattcgccttgtcgaacatcgatactgtaatttttaggaaacattactttgttttgcttaactgaagtccagcaacaccacatgccattgttcaaaacaatgatacaccagcatctactgaatctatgcaattgtcattttgtcaatacagatacagttgatcctgtttaaggcagtacatttttacaatgtttaatcagtcatacaagtgagttctgcggatcttgtgtgttcatatgtttcttataccaatgtaatggaatcaatttcagaatagagctggccaaatgcatagcaaacccatcctgtgcagcgaatgtagcatgcttaaatacatgcaacaatcgccctgacgagactgaatgccaggtggttccatttcccagaaaccaatcagttcagatcatttcctcagaagaataacctgtgctgtatcttgtcatattgtagatcaaatgtggagatctgtttgagaacactgtggtcgatgagttcaacgagtgtgctgtttcgcgcaagaaatgcgtcccacaaaagtccgacgttggcgagttcccagtccctgatccatccgcccttgtcaagaacttcaacatggctgatttcaacggcaag

SEQ ID NO: 48133 - DNA, 1450 bp, Oryza sativa
tcccactttcgacacattcgattgccaacttcacgagttccgtgtcgagggagacaaacttatagcgaacttgacatggagaattcgcacccccgactctggcttcttcaccagaacagccatacagcggtttgtgcaggacccagcacaacccgcgatcctctataaccatgacaacgagttcctgcactatcaagatgactggtatgtcccttagatagcaccttctgacgctgtacttcagatttattactaagattttctgaaatgtaggtacattatctcatccaaagtagagaacaaggaagatgactacattttcgtgtactaccgcggcagaaatgatgcgtgggatggatatggaggtgctgttctgtacaccagaagcaaagttgtgcctgaatcaatagtacctgagctagaaagggcggcaaaaagcgtaggtcgtgacttctccacattcatcagaaccgacaacacctgcggtcctgagccacctcttgtggagagaatagagaagaccgtcgagcaaggagagaagaccatcatcagggaagtgcaggagatcgagggcgagatcgagggagaggtgaaggagctggaggaggaggaggtcacattgttcaagaggttgacagatggcctcatggaggtgaaacaggacttgatgaacttctttcaggggctaagcaaggaggagatggagcttttggatcagatgaacatggaagcaactgaggttgagaaggtcttcagccgcgccctgccaataaggaaactaaggtagcttctagttgccactccagcaagtacaaggcaacaagtaatgctcaaaatatattctattcaccaaggcaataccaatagtaacagattattctacagagaacaaagaatttttgaatctgctaatgcatccccattattacaatacatttccagcttagagatatgtaaagtatcagtaactatgtaacttccattaaaaaaaggtatatagtgaactttgtacaactgttccaaatatgatatggattatgtccttttgatgacgatagtttgaatgctgttaattttcttcggtactttatggcaatttaggttatgtcaaatgcaaataatattgaattgtagtttcataatttcatgaacctttcttttactaagaggctctctagaaactttcctattcatcgttaacaatcactgttcagtgggagcttaaaaggagcttgtattttattagtatgaacttctcaagcagcagcctgaaatggttagatggagggtgagagcatatgagatttaactggttgttttcataatcttagcttactctttatgttcttgattcaaacaaggaatcatatggtagctgcaaaatacccctataatcatccaggaagacacagaagcaattctggaaacattttattatcagcaaggaaaa

SEQ ID NO: 48134 - DNA, 3390 bp, Oryza sativa
gtgccttttaagtaaaatgctgtgatgtagcagtagcattgacatatcagtaagaaggttatgctcaaactccatactgggttgtgtctgtaaatgaaattaactggatctaattgcagtatgtgtaggcgtgtatcttgttcttgagcaaggtttaacatttcattttgttcttcatgttttccccattagaagtgctatgagaaattgtgatataggagcagtaaaatatatgaatagctagtataacaagcacagaaggattatctgccgatggtcatataaccctataatccaagggaatatttctattttgtttgatatgcatcatttttctatggtagtaaagctaccaattccgcaacgaaaattggcaataatatttacagtttctgtaagtggtatccagtaggaattcaaaatcaaactaaggcataaaaatttttgttcatatcagagcctgaaaaataaatgttttttttgtgtatatatacctgtttcactttgttttcctggctgcgattagtgtccggttgcctggtagaagtgtttggcgataatttatcatccctcaccctgttgaagataccagtaaatttttcgcctgatgctgcattaccctcatcccactcaccaaacggtggaacagctacatcatcttcaggctggattggaaaaaaaaaacgcaaaagcaacatcacattactccataggcaaaattctctggattaacaagaaacaaaaagggatttagaatgtactgcatcatagcctcggccaccctgcttgtccctgctcctcctaggagtatgctggccatgtccctccgatgaagccctcctctctggagtctgcattccagatgacctgtgcttcggcttcgatgggttgttcggctgcgctggtgaagcggagccatgaaccatcctgtatgggcttctcggtgcgctaccgatgccaccgcctacctctcgctgctgagaaagcgaatgccgtcgatggggatcagcttcctgccttcttccatgctgtggattcattggactctgcccctgagcatcaggtgtgtatgctggatgcaaaggtgacttggatggaggttcagggtgcctccttggatcgttgggatgggaagaaatgcccgctttcttgtttttgcgggcattctcaaacttctgtgtgtatggtgtgttgccagtggtgtcccagttcccaaatgctggaatgtcaggttgctgtccaaagaaaaataggttggtaaatcttgtcaagccttaagccgatttatgatgattgacagagcaaataaaatgtccatatgaaatcagggaatttataatttaccattttggggaaatgaaactagcaaagatagaaaggttttccatttctctaacatgcaaaactatgttgggcactaagctaagggtactagtttttttttttccaaataactatgaactggaaccccgtaaacagtggaatatctcacgaacattgcagattgacaggtagctacacaaaagaagaatccaaatcatatgataaattctaatgaaaactatgagatggtcaaacgcacataagaaaaggatcttcagtgtagctgctagatacaagtaggttatccaagttcagcaaacgaacttcattggaaaaacaaatgaaatcaacaatgaaccatgtcctctttgcaaaatctcttactgtacatcaatgtgaaaaacaatcacctacaacatatagcggcctcgtgcatagcagaataattaccacaaaacgcaaaaagcatacattatctaactaccagtaaagtagatatctatatcatcagtacatcatatgtgtattcccgaaaaaaaatcagtacattatatgcccgtatgactctgcagctcccatacagaaatgctgcagatcaaaattgttgcaaaagcttctcccaagcacgaaacgacaaaaattacttaaacctgaacgaaacaaaggtgcacaaaaataatttactaaattggttagtctgaaaccagtggcttctcccaaacattaatatattgtccaatatgcaatttactctataatataataaaacaataaaactatatagaagtaccatatgccctaaatgaaatcaatacgcattaatgcattatgaagtaccaagatttccagcaccagctcagtaagatgaaatgcaagataaatcagagatggattattcaatcttcagaagtaagaaaagaattactcactgccattagcgacttccaatcctgtagaaagtgccgccttcttccccctcaaattcttggatgaacagacttaattctccaaaagaaagcactgaaggaccaaatatttttctcccaaatactaaactggactatttcactccaaatcctcccaagaaaggatcaaatccaactctaagtttgtggtttgtctacaaaggagaatcaaatgtgtcccctatcacctccaaccatcaaaacaagtagaggattgaaggaagctctctcaccaaatttcaaaaggaaaaaccaaatcaaatcaaaacctcctgggaaatcaagaaccaaaggcgcctaatttgacctgaattcctcataaaagcacctaaattctccccataaagccactctcccaactactcgaacaaaacaaacacaagaatccaaccaccaaccaacactcccaggagacaaccaaattgcttcaagaaagctgtaaaaaaaaatccacacaccaagaacagtcaaaggcggagtctttaacgccaaccctccaaaaaatcagccccagctcatcaacaaaatggaaaatgaaaaaagggtgatttccttcacacagcaaatcctccaagaaaacacatgaaaacaagcctctctcccaagaacatgtatctatccaagaacacaatcactcgaatcctccctcgtttttgctcgaatttcctcgagaaagaactcacccaagatcaaccccaagaaagaaagaaaccaagccaaaggcggcgcctttgcccccctctgattccgaagcttctgaattgcagaagcgaaggaggaggagcgatgaattcagaggtggggaggaagggaggaggaggctgtggggaggtgaggagaagaaaaggagaagggaggaagaagaagacaaaaccgttgacgtgggagcgccactatttttcagttcgaagcacctctctctgatctctctctctctctctcttgattttagtttagcttatcatttttttttcaagataaaattctggttctgagatattaacgccagagatgggcacggcataaaccttgaattttgaccgtagatggttttagataagttcacaaatctttttaaagcaatatactatatgaaatgcag

SEQ ID NO: 48135 - DNA, 8804 bp, Oryza sativa
  unsure (1)..(8804): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactagattcttttgcaattgatgacattgtccacaggaacacccacttacgctgtctaatgtatcaagttcaaagcttcaaatataataccctcaagtgcaatattttttcattcaagttcaacatggtttagttcaaccatatttgtgttgtcagcaatatacaagcataagcaacctctattatgaatgtaaaccatgcttaacactggttctttgttttttttatggttaatctgctgattgcttagcctttgatcaactgtgtgttaggaaggttgcctctggacttgcaatataaggaacaaaactaatgtatggccttacagtgggtcttgtgatttcattgcattaggtcaagtggctgaggaattgacctagctaggcccatggaaaagtgtgatgctgctacagatagagttgcaacatgccatttcatcccaaatcacatattgaaaaaagtactgtagcataatggatacaattttagatgacgatgaacattactgggttgagttgtctacaagtatatcatctaaaattgtatccattaaattattcggattgcttaaaaatatctccttgatagcatgcatatttttctctactagtcctggtgcaggtgccaagactaccgaaatgactaccctattggaataaacaagttttgtgcttctcacatgaaaaatacatattatagaaaaatatgaaattatatgcatcggtctgatttaacctagtcattggaaagttaagtattaaaaaacctagatggagtataaactgtatagcacattggcttctaatttcggatagttcattcttcggacacctgcatcatcctaatgaagttcatatggtatccacatattatgagaaaagttttgttttaaagacaagcttgttctaaattttctctgaagccatggtaaacaagtagagtatgttgcacataatttcatgatcgatgtgcttttgtttgtttggttttgccttttccatttatccccgcttctcttctcagagctttataatgttgaacacatacatgattatctcatgcattatttttcttttttacgccaatttattggtccttgaagtctcccttataatacatgaattgcgatttcataataccttttattgtagttctacaatcatcgggaatacaaaaaaacattccgctccaagcctgaagttgaactatttatggaaagaaccctgctgcacgggacagatatattcaacggacgtaaactacataagaaggtaggcgaacacttattttatgctcatactaataatatataagacatgttttagtacattgtttgatttacatgttgctagataaaaatataagtactaagtccaaacatccacctattatagtataattaggtatttccaaaaaaaaaaatcttggccactttacgtgcttgtatacatattgtactaaagttttttgtagaaactctaatgttgatatatatttatttttctttacagaaggcaatgggttcctatggtgaaggcagtggtatggatttgaaatatactatttcagaagcttacttcataaactaattaacattatatacatgttgtcatttggttttgtaacatggttttggagaatttacctcactctgtattacttgtgtaattgcatttgaaatgttctattttcaacatagcactgaagctagtgttttgtttttacccaatattttgcaatcaggtggaagtacatcttccatgggagagaaaaagaataccaatactaaaagacagaagccctcgagtattggagatgaccctatgatgctgaagccaactctgcctcacggttttgtttagtttcagttggaactgcatatgtgaactggtgagagggagagcaacagaaaataaacctaatactttgctacataccattttcatgttgcctttaagaataagtgcacattgcatcaaactattgatgatgctgcctagttatcggatgttttttacttgatgtttgcttatgatttcagttctgtacctttaagcttgatatattggctacattgttctgttcaagtttattggttggtagcaatcatgtgggttagtatttaatttatttgcatgagaagctattaccaataatgctgtttttttattggagatgcatacatcactttgcatacatgtggtcgcatgtactatatccatacttctttgctagatactatatccatacttctttgctagatatgtgttgtttgattgcaaggggctaaattataatttatttgaaagtaaattttacttcttgcaaacaactctttggtagaaagaaaactttttttgttttatttgttatatattcaattagtcatatgtattgtatttttacatagactcattctatacatttgatacatccaaattttgaaacctttttctatatactattattagagcgcacttcagtttatagactcattttatatactgttgttaccgtgcactcccattcgaacccccctctcctttttttttaacaaaagattcatgttgaaccccctatacaccatacaactttcactatgggccactttccttatattttttttttcactttggacccttttttataccatttttctcaagatcaaactcacggtgaaaccatgatcttttcttaaacatactcctcttactcccactactgtcagctttgcgggaaaagggggtccaaagtgaaacacaaaggtaacatggcagcagggagaggggtgttcaacgtgtattttctctattttcatctctgccctcctttttcaccattttgcttccttgcgttgcctgtcatgatcagtctcgttagccactcgttagttcatagcaaaacagtgcaagaaaagaccaaattgcccctgccactgattggctatattcatggaaacttttaaagcaccaattcactagattatttgctccacatatccaaaaatatgttttcccgaaaatttttcttctggtacatagcttatatcatttattcaaatctatatcttaagattatttttaaaatatttaatttatctctaagatgaagtggataatatgcgacaataatccagtgatagatctgtttcaaatgggggcagaagcattgcttgtgtctatcttattgataagttacaaaaaaatttaattcaattgtcttattcctctttaccgaaaagcttacaaaaaaaagaagtcttcttcctcctctgactgaaggacatcatctctctatccacattgctaccaaatccatagccagcgatggctaatcttgttggcaaccagtgaaaaccataccatcccgttgcaagtgctctctgcctggtttcccctataattaagcagcttgatcacatatggtttatccataggaatttaagcctcatttgagccaccattggaatctgctgccacaggggcactgaaccacttgagccatcatttttgctcgaatcatcatagaacatgaagggtataacatcagcattcgctaagaaaactagcatgatcttaatcggtaataatgaatggatgtgactggggtagcaactatggcatacactagaaaaaattcgtcgagtggcaaataagttatagccaattttgacaggcaaataaaggaagtcagtaactttggatgccatttaaggaattttctcaattaaatatgttgaatttttgaatgaaattttgataatggcattcattggtgttggttgtggatcagtaacatttcaccatcaatagcatgaaggtgtaaggagatattaatgcttgcttatttatttatcttttgattagaatggtggatgctctatttggtgtatgttaatgcttaattttttccttttcaattccacctccgttgacaattgtaagagtgcggccccattaggtagggctccaaaccccaattcctagctccaaactcctactctagtggaagctagctcctgttggagttggagacctattgaaaagtgtttggctagtttttagctctagatctgaaagaaaatgaaaaaaaaaaagctcgggccagggccatgtggcttcagttgcatgcatagacttttttttttagttttgttctgctgcaaagagtggtggaaaatccgaatcagttatgcgtgacctttctggtttggttccaagttatggatatcatgtaggcatcttggtcatgtatcctgatatctctataaataccgagaggccatcttgacgtgccagaagcgacaagcaatctagggttttgccatttccattgtgctgcggtctcgcacattgactactccatcctgctttctggtatgcacctgaggataggaagagcaggtctccaacaccttcggtttcaatgtcctacagcaggagatgatgaatagagtttttgggaagctttgcatttaattgctcatatttattcactatggctcgtcttcctttatgttcaggcgctgcgtgtcatcatatacgaagtctttgttttatgtaaaagggttaacctaggatatcgttgctagatcaggatcaaatcttgtaaattagacaccaaaatgaacaatgtaaactatgaaaggttatgaaaacctttaagtgaatcgtttgcctacaatgaatagaatcccttcagcttggcaattttgtagtcctttctggaaatttactatacatgcaattactgtccctagctctttttaagttatttaccagaggctcataaggttgtttagctccacaaattcagcaattcttttgagacttttcaggtggctgtacattactaaatggggtgccatttacaaggcctatataaatggatgtctctgttgtggatgggctcattatgggccttgcggtagccatcgtccagctgggtgatgaggtggaccaggcttggtgggggcaaaccttttatttgttccatcttagaaaagtcagttactcctcttgaaaaaagataagaaaagccagttgtctcactttttggtttttgctattgcctctagtgttcatttattcaagaattattccgttgggcaacacatcgctaggtaccacgcgtgtgctacagggctaaaaaaagcattagaagcttgctatagattattcatgctatcctttctccaagaggtacattcaaaacaagaaaaaaagaaggtcagaaaaatataacgaaataaatgtacggcatggacacttcctaatgtaagtgtattcgacatgcataatgagttatgctaaatttcgctctagttgttgggacaaattgctttgtaggttatgcctagcggctagctatttattgggttctaaagatgtattacaactagttccatacacaacataaatatacaataagattttaacactgcataaatataaaataatatatgggcatatattgtttatgtattttgtctaaacataattatttctaataagctatttagtgcataatattggacatctgtataagctaaacattgagtgtattaactgatatatacaagcaaggaaaaattatggatgaaaaaaaaatatatggtgactggtgatccatctattatatcttctctctaaatactagcatttgttagaaaatgtgttgcatcaaactatgaaaatcaaccatgtattgcttgaaggtacatacatccatatgaggaagaaaaggtatgattttttttaaatatccttttttccataatttgtgtttatatacctgtgtggaattaatttgcaaaaatatacctaacccgcttgctgagaatgcgagaacgaggattaagcgcatgccggatgcgcgagaccgagggtcggaatgatcatgcatcctggaaatgcggtacaccatggtggtatcgcaggacgggtctgtggcaatgcggtggttggctggaccgatcatcatcagcccgatcccgcaaagtgggcgcacgacaccggcctcggtcacatagaactgttacgcagaactgaatcggtaccgcagtttgggcctgcgggaccgaagcggcgcctctattctgcgcgatcgagggtgcgctggcccggtcccgcggtgcatagcgcacgcgcacagccaccgcgcgggactgactcggttccacaccttcggcctacgcgactgagccggtcccacacatccagtatgtggcaccacgttcccgcgctgccacgccatgctttcgtcccgtacccacgtttccaacgtgcggaggtggtatattttcaccaaatttccccacacatgtatataaatacaaattattaaaaaaataggtatattttcaaattttattcgaaaaggtatatcacattaaatggtatctccatataaggaacataataactatctcattaaatagcatatctctataaagaagacattatgtgtcatattaaatgctaggacgatgtaaggaatataatatatggcattaaatggtgtttccttgtatggagggtggaggatgatatgcatatctcaattaaatgtaaaaactttaatatatcattattatagcacggcactagctgacaaggttagctgccaaggtttggactacctaagatgtcttcacaacagttattttgaagcttatcatgtttacactatttatgtcagaataatatttctctgcagagcagtttgagagtagcagatagtctcgtcctatccccttctattgtactattcgttcgtagatccatgagtagtgaggccccgaagggcgtagcccccatgagtggatctgaatatgactctgctgaaactctgtcagacgtccctttcatagggagtgatgcagattcaaaggatgaaggaaatacatctgctatgaccttcccgcttggcaaacaaccattggatgttgcaccttaatgccattccatttaatgaagtgcaaggttcaaatcggaaagaggtttctagtaaagaagtagtttcgattcctcaatggttgaaggaacacaagctctacaaagatggagactgggaggtttcaatctctattagggccactggacaaaaagattgggtaagtgattcaatcttacttttctttatcaaatttgttacacaggcttcacttcctttctatttttctgtctaaagtaagtgttgatatacttttgaaaaaaagtgtttgcaacttatcctaagatctctagcagatttgttttttgagtttatgcttcttgattttctaccagaatttatgacgtactagcaattaataaatacctttttatttagttttctatatggacttgtacataacttccattgctttttcattctaccaatgaatatgtgctgcatctaatttggtcttgtcatatcattgcattagcaatatcaaacaaaacaggcttggaggaaattaaagctacttttattatcatttgaattttgcaagaaaaatttacacatctgacaatgtaatcgtttatactattaatataatcttgtaatctatttagaagcttccattcatacatgattattgaaattttaaagtatttgcaaggtacttgataagaacaatgctattataataattgcataataaatacattatttttaacatgtgcatttatgttcatggcactcaagaaagggttaatagaaatacacaaatgacatggtgaaatgactaatccattctcctcttagaaataagatcaacaattttggtccaatattagactcttcctactactacaaattgggacatgtggtttatttagattgattgtatgtctaatccatgccgttgctatattttgagaggagtcctaggtatggagaaagagagataagtgtaattaacacttgcccagagatagatagatagagagagattgttataaaccctagcaataaatagcatgtccaaattataccagagcaccgaaatctagatcttgttaattcacaacttgttatcaccattaattagtcattacgtcttatatctgaggtctcaaattagacatggtataacaatggtggttgaaacaataaggtagacaagctaatgcgcattgtcagacggttgatcatcgcttggattgtccggagacgtggacaattgcagttgttcagtctaatgccaattggattgttaagtcccttatagccccacggctataatattgtttgcaggaaaggttgggccatgattttggagctaggtgttacaaaatatttgggtttaggagccttgtacatggtacaaagcctcttcttatggttaatttatttggttttggaaaaaattacacacacacacacacacaaacacacacatataacttataattcttgaagaggttaattcattttgatgtttttttacatataaagttgacatcaatcctagatattgtggaactacaaagtttccattagcaatgaaggcgacctcctcgtaatatccacaatttataagccttgtcatctaattgcatctttaattgcacaaacatcaagtgtgaggaacacaaacttaagtgctttatttcttgaggaacttaagtgctttatttcttgaggatagcaagcgtgtaaagatcccaagcaaagatcaaa

SEQ ID NO: 48136 - DNA, 2295 bp, Oryza sativa
ctggcaaaaggaatggaacaagtatgaaaagagcaccactcgaaaacaatactccctccattccaaaatataaggcacaaccacccttaacacaaagaccaataaataattattatcaccttatagattggattaccctaataaatagaatacatgcacccaataaaattagagatcttgattgtagaggatttaaataataatattttagtagaaaaaatgtgctagctaatgacatacatgcatgcacgccttatatcatgaaacaactttagaaagtagttgtaccttatattatggaatggagggagtagcaagtaataattaactatatagcctacaattgaataagcaatattagcagcataagtcatttaactttttcaacgttgcttgtccaatcctgatatgcgtgcagcaggagactttgacctctaaaaataattgttctttacatgtattttgaaacagagagctttattttagatttcctgaaaatgatcgtgaataggcatcaaggacatgtcccatagtcagagaacaaaagtatgcaagaccatgtctcagaataatacttatgacctatagttagtatcatgattcatggagagaattagtgcgagtctgcactacagtgtccatgcgcatgcgttttctctaagtataatttcagaggaataaatgggcagttacctatttcatacatccaattcaataagtgtaccttcatattcacaaatcacatgggtttgataaattcagagatatagaaaacattttatatagaacggcgaaaataatacaatcatttgtatacttctgaactacatgaatatctcaagtgagtccaattgcaacgcattttgttctcaagattaaattacccaaaaccaaattaaaataagacaagtcactttttattacagtatagaaaaacaaaaaatgaactccactttggttgagagttaaccacatgaaatacaggtacacagaaagctcacctagcattaaagatgatcggtggaagcaataggttgagaagatgtcctcagtgaacacaagtgtgtgaattcttccctcaactgacaagcagaatcacacctccagtgatcagcccctgcaagcaccataccacaaagcaaaattcaaaccactacataagcaaaaccacaaacacctggagtgcaacgccacagagtttacacgctggtttctttctagcagatgcccaatcggcaagtgcataccaacgctaggaagatgttgattgtgacaacaaactcatggtctgactcacggcaattgagaacaacagctcccaaatccagcaccatttcgatcaacatctgagtagatcctccgcacagcttccacgattccagcagcctggcagcatgtaaacaaaattttcaatgctcagtggatcttttgcttagtgtaagcaagcggcaaactgctcacgcagctctctttcccaaggagagacctccgttattattgcctaaagatagtagttttcatcataacaagttttgcacgcagaataacaaacggaaaagcgcatccaaatcaaaattaatttgtagacaaaaattccccacttgggagttgagatcatcgatgaatcaacaagcatatgaaagagcatgttgtaatgggatactataccacctgaccaaccctaaccctctagtctaggatccacagatctgagctccttgacggattagcacctagaacagcagtgattagcacctcatgttcttcttccctgcagaggcgatggacaagacaaaatacatggggataaacgaagacgacgacctgagggagaagtgacgagcagcaagcagccaaaagttccattgtatctgtaccgcctccgcctccccatcgcgcagccaccgtcgtcggctctgtgaccatcgccgtttcttcgacggcaacggagggcagagttgcggccgttggcgatggcgacgaaggacacagcggagacgcgcggcgacgggcacggcggtggcggtggcggtggcagagactgcttcgcttggcgacggcgacggcgacgacgcgaggggggagacggagacggcgaggcgacggcggcggcggaggaggaggtggccggcgatggggacggcgctaggaggaggtggctgcgcgatggggaggcgacggcgacggcgatgacgcgaggagggagacggaggcggaggcgcccggagacgcagcgaggcgacggcgacggcgacggcgatggcggaggaggtggaggcggcgcgagggggagtc

SEQ ID NO: 48137 - DNA, 3798 bp, Oryza sativa
  unsure (1)..(3798): unsure at all n locations
cctttccacgatttttcctcttcaaacacacacaggacgtgaggggcacatacctgattacgaaaaattggagggctttttccgcaaaaatccgacctccgcctcccttccttatccgtcccgtctcctcgcgctgctagcagagcagaggtagcggcggcgttctcctgctcccgccgcattcgctcaccgacaccggtgagggtgaatccatcccatccggcctccagtttcgtctcctcgatcgccccgccgcttgcttgcgccgatccccatcctgcgcccggcgtcctcctgcttcccaccgcatcgtcgctcgccggtgagcatccctccctacccacacggccacacctcatcatcagctattctgcgttatccctcagaaaagtttagtttgggggttcaaccgaaactgggttagatctgcctctgcccagctccacctactttcaacttgttaattttgattttttgtttttagcagatgtaatttggttattgaatctcatccaaacactcttagaatagttgtacagaaaataatttgtactcatccaaactcacataaatttcttcagaagaatccataccacaagctactcataacacacaaaatatcttttttattaaggtatattcttataagaagttttcattccacaatattttctaaaagataacacttggtattaatctaatttaacattttttttctttattaggttataaattttctaaaatatatattgtgccacttggcatgaatctaatttagcattctttttttatcaggttataaattgaaaccatcgaacttactttatcttcccgtctctaaaacattgtgatatatctataatattttaatattttaatattaaaaataatttagactaataatatatatatttaaattaggtaattaataaattcaaatcagttatagtttagaataaaaaacaaaatgatatatgccaagtacaatctaataacaatagaatgttagaaacaatgtgaattcaatatttttataaagtttaagtacgattttcaaaaaaaattaaaaatagattaatatgatttatattaaaacaattttcgatttttttccaaaaaaacgcagctgataaacgtacacacggaaaacgagaattcttttctatttgtccgtttcaacgcaacctcaagtgatttagaaattgaaggggtaattaaatttatcttttttaaaaaaattaagtacacctacggtatggatacagatgtacacgtgtactgtgtacagctgctccgtacaaaatcctcaagtccgtataaaatcatcaagtctcacttctttgtgttgtgtcttgtgtgaacgccaagctccccatcccaccactaatggtctctctccggctcatcgccgcattcgcgcccgctccgccaccgccaccgccaccgcggccccgacgagcgccgccgtccgcggcgcgcctggcgagcaacggcatagcctttgtcactgtggcagccgtagccgctgcctcgccgccagcgatcgccgcgctggccgccgagccggccaacgcgctctcgctgcccacttgggccgtccacgtctccagcgtcgccgagtggtacgatctacaatacctacctgcctagctcttgcttccacggctgcaaaagatgaggggattatcgcctgttctgtccggattgcagggtgacggctatggcgctggtttgggactacggtgagaggacggggctcaagggttggaaaggcctctcttggggaatggtgagtgtaaatttggataaaatgatgatttatttgctgatgaaatttgtgttggataatgttaatttccgtactccctccgtccccccaataaaagggattttgatattttgcttgcactgtttgaccactcgtcttattcaaaaaatttgtgcaaatataaaaaacgaaaagttgcgcttaaggtactttggataataaagtaagtcacaaataaaataaataataattccaaatttttttgaataagacgaatggtcaaacagtataagtaaaatatcaaaatcccttatattaggggacggagggagtacaacatagtagcttcatgtactcctatgtattacttcctccgtttcataatgtaagattttttagcattgcccacattcatataaatgttaatgaatttaaacacacatatatgcctagattaattaacatccatatgaatatgggcaatgctagaaagtcttacattatgaaacggagggagtagtagtaagattcagagattgggaggagaatgtctcatatttatgagtatgttttcatcagaagaaatcttgtgttgttttcagtgaatctaatctgcaagtacccctctttacttatgtgtgacttctattatctatactgctcctatatagtacgacctccgtcccgatatatagtacgacttctattcatgttttatcatctaataacaataaaaatactaatcatatatttttttcaaataagatggacggtcaaacgaaacccacaactgcacttgtattgggacggaggtagtaaagtctttgctgatggtagttgcagttgttcacaagttttcgattgaatttttaacagcttgctttatgattgttgactatccagatttgcattttcttttctttgtataataggttccacttcttggtggagcgatgtgcgcttgcacgtggcatttcttctataattcggagtctcttgaagtaagatatatcccttgagttggaacactagtgcttcctttttttccgttcatcaaaattatcatcatttgcttccccgtggtttgtaactgttcacacttgtcaaatatcctaacatttcaattggtctagtgcctatttgcctttaaataaatgcacatgaaacacagatgattagacagtggaaccgttctccacttcttttgtgcaagtcgtatgcttgcgatttttttgtagtattatcaagatactctcttattgtaaaaacatacaataatataattcaactagtgtttttcataattcttctgctcacgttatttctcttcatggttcttttttttttgtttgaaaactatctgcaggtgcttgtagcgctccaaggtgctctaacagtgattggtaacattacaatgtgcatagctgcatttcgcatcttcaaagcatcccaggaaagctcaaaaagttcatagaggtacctgtatgcatatatacactaatgtactagtaactgattgtggtaaaatataccatctatctattaagtggaatcttcttgataatggcagttacacctgacatgaaatggcaaacggcagatgctgcgaaggaagaagataaaagctgctgatggcttgcagctacttcagaaagatgtttgtatgtatcaattctacaaatgccagctaaagccaccctgaaatttgtgtattgacttggtttttttctagacaatgagtgtatttactcagataagaagaaaaattacctcacctgctatagcctatgcctcaactcatcttcaactgttttgaacaactgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48138 - DNA, 1270 bp, Oryza sativa
caaaaggacgatgagatttttttaaatttttttgaactatattctcctaaagttgtactattgcgctattatcactaatctgcagggtcaatcaatcttaagtaatgtatggcacacatctatactccattaaaaagataagagtgatggtagcggtgaatcttccattgccactgataacccatcattcattttacagttttttacaaattagcttcttattttctgatattatggaatagtccagtatttatttcaaataaataaatacaacatatttaaataagcgatactaacatatctgataaaaaagatatatgttatctatgatatactataatacgtttttttttactcataacacagcatgagtattttgctagttatgtagaaaacgcaatgcaaccatgcaagaaccccaaggttatgtagtctagtggttacagtgatctgagtagctccccaaggatctgcgtttaaatcttcataggggtgaattttagattgggttatttgagggctaactttcatcaactaagtttctaatttaaaaatactgcatatatccggttggatgtagatgtcggttaaaaaaaatatccatctataataaataaataaaattaaaattaaaaaagaaactatgcaacggtgtacgtagcatagttaaaaaaaattaaaaattaatctagctacagtgcacgtagcgtacgacactgttacaacggccttgctttaaggccgcaagtcttaggtcgatccatccatccatatatattttgcaccgtcttttctcgatcgatctgcagtgaagggattcaacccaacgatccatcgggtggcgcattaatccgctcggaagcaagctagctctcttcgggtactgtttgaatgatacttttatcatgttttaatttttttttctcccatatgtactgttataatccactaacaaaattttttaggccgtgttggtttgggttatagtaaccattcggtacgtaacaacatgttagtatatgattaaaaattaattaagtatagattaaaaaaaacttgaaaattagattatataatttttaaagcaacttttttataaatttttgtaaagcacactgtttagcaatttgaaattcgtgcgcgtgaaaaacgaaagagtagaagttagctaggaaagtgtagtgaagaaagcaaccttaaatactcctaataataagaagccggcccatatatgatagcacgagagatcttatcaagaagctcagccaat

SEQ ID NO: 48139 - DNA, 1960 bp, Oryza sativa
ttctgtactggaaaacatgtcagggcagtgtggcgttgtgctgtctgtgaatacatgtttctttgagagggaggagcatgagagagaacgccagatttttttggcattctcaactagaatgagaaatatgaatacactgttcgaattttggaagatgtgaatctgccaagatgtttgccaagctctacatacaccatttgtttgctaaggtgttttcagtaaaattcctttgggcaactgtgacaatggtaaatcaagaaaatgatggtaatttaccaagtgcttttctaccaaattacatcaaacattgtatatattttcatgggccatattggaaatgttgttttatggctaatattagcattcttattttttagatccgataaatttcaggttgcaacttacaaggatcggttttggtaggaccaccaagttgcctaggattttcgggtaaggattatttgttgttctgatgcggatcatggaaatcgtgtgaaaaattatccagattctggtcttgaattatacttgccaaaactgacaagattatatgaatatctataaaaataactctactgtttctttttgtgtggacatatattgtatattgaagtgataatatataattgtcgatggtcatggattattattttcatatagtaataatatcaggtatgctgatttagaaagcttttggtctagaatattctgattttctctctttctaaggccaagctatggtatttttgattcacctcagttgcaaattgtaatgagttttatttgtatacatccaaatgaaaataatacttcctccgtgcagccagcatgtgctgtagagattgtattaagcagccaaaatatcatgtgctcatcatgtaaggcggtcggagtcagagaaaagaagtggatcagttaatataacatctctaagcatttttgctttttagttgtttgctagcataattactttttgtattttgttgtttcctagatgtttcgaaatttttgatgaacgatttcggtcgcgacttatttgcgaatatgattatgtattatttgttacatacatacatacatacatatatatatatatatatatatatatatatatatatatatatatatatatatatatatatatatatatatatatatgtatatatatgcttgtaaaaacgtgactacgtgcattaccaaatgttaccgtagctttagtatgggtatgctactgtaaaaggatatgtaaaaagatgaggctgctagattggttttttttacattgaaagtagaaatttttgtattattgcgaatataaagtgcagggcgtgcgtaaccgtatttgcccagaaactcatcagtgatgtgctctctctcctgggatagaatcatcgatcatttccctctagaaaaatcaaagttgatggcttgatttgccttcgtcatagaaagggaccctcttcgtcgtgttccacgatcaaacgagtaggttagtcgatccccgacgagacctcaccaaccactcgaataatttttgcgatctggctcctaataactctcagtgctacagctgctactggcttaacaaatatcttcatggaagaaacatgctcacgcgagtcacgagccaagaaccaattccaagccatggatagctttcagagatctccggtgtgctgctgacacgtgggccccgcgctagcgcactcctgagatctctcgcccatgccgaacaaacgggaattttttttctctctttttttttctatatctaggagagaaacagacgagagaaaagaagagaaaaaaaaaacaatggcgttttggtggtattaatttaccaggatgtagagcaccgaggcgaggaggatggtgcggtagcggccgagccaggagtcggcgagggcgccgccgagcagcggcagcagctgggagacgccgttccaggcgttgatggccg

SEQ ID NO: 48140 - DNA, 8573 bp, Oryza sativa
ccagtgcgagcagcgggtcgtaggagccggagtcggagccggaaggcatcgtcgccggccggctttgacactatatatatgggcagctcgctctctctctctcacgcacacaactagccgcagctcggccgaaactttcgcagtcaatgcctactcactcacaccttggcttggcggcggctaaaataagcaaagcagcatgagaatcggccgggaatggatctcaacagaaaataagcgccaactggcgcgctcgatttatatcccatttatattatttttgtttattaattagcacattgttcataaaaaatatagaaatcaatttaatttccttgaaactcataaaaaatcgtaggaatggaattttttgagtttaagtttaacataacgggtcatattgttgagaaaatcatcaaattttctctttttttcaatccatactattaattcttccattgtttttctaaaattataattaaattgtttactaatgataaaattggtgttgtttttttttaaaaaaaagtgtttcagatttttgttttgttaggagccacaatgttcatcatttgttttgatgacataacaatactaaattgggtttaaatcataaacattgtataggtgtttgtattgatggctaattagtgatgggtgacatatatacgttgatgatgagttgcatgtggtgatttcgctgattttagaagaaaaagaagttaattttaattcctgaactatttcaccggagtagttaacatactaaattgtttttttcttattcaacatttctttttaatttttttcccaccgtttatgcaggttgaaagtacataggactgatttaaacatcaaaattttaagttcaagcaaacaaccacattttgaaaaatatttttgaactttaataatattctaatgtatgactccaacaaatttcagcttaaagtaagaaaactacaaaatattattaaggagtaaagtgaaccattttttacagtttaggaggtaagatgagccaaaaaaattagattttttaatagtattcatcgaattagttcggagaagtaaaatatttttttttattttgagatatgctaactcaatttttcaaagatgctgatatgtatgaaaactgagtagttgtatatgcattcaacattttttttgtaatactaatgtactacctcagtacttatacatatgtagagcatgtgagctctattgacataggcattcgctgcttttgcctaatcgatccttccagaatagcctttcatcggcataggaggactggcctgccacaaccctgtacttccttcgtactcctagacgcacaactgctcaattcctttttttttctttgtgctcttcggatttatgtgccatgtgagagaggacacgtggaccaatcactgctggcagaagcagccagcattagaaataaagatccgcgccgcgccgcgccatatcggatagagtcggatacgattatgttgatatgtgaatacgattatgttgataatatttggataattattttgcgtttattttaaataaaattttaaattactattctatcgtggatctgatatttgaaattgcgctaagcaagacggaatagttatcactactagtactatggaacgaggggtcgcactcgtcacgcgtcgcgcatgttggatttgtttggttcaataccctaccaaaatactggtattggcacaaccaatattttggtagggtagagttgtatttggtttaaggccaatttaaaaactaagcttttagtggaatatagaaaatatcaaattggaccttggcattgccaatgatttggcttctaaccaaaaccaccaatacactattcaaactaccaaaatgttggtaaggcacgtttttagcactagtctaaaacacattaattttgacaatttgactctttaaaaaactaattttacaaatgaaccgccgcctatttcaaaagtaacctttttttcaacaccaaatgatgtggcgctgaacttaaacacctcagcgccacatcacctggtgctgaatgccgtgctaccgtggatggaaggctgagtcagcgtgccaacgtatattcagcgtcgtgctatttggcgttgatgtgtctaaattcagcgccacacgatttggtgctgaacagaagggtcacttttaaaataagttttggcagcagtttatttgtaaaattagtttttgcaaaaggtcaaattgtcaaaattaatgtccaaaacggcccattatacgcacgggtgcgtgaagcaacggagttgctagaaatatggcgccatatgctacagtcgattttttttcagccacttacacagtagttacacctcatttacacctcacttacatatgtaattagtatgtaattttcgaatttacatatgtagttttagtacttacatatgtaattttgagacttacattgtaaatacactaaaattacatatgtaatttagagacttacaatataaatacataccgactattttttgatgaaaaatatggcgccataaatataatataactacaccctgaagcaaagcggccagttgaccaggtggccggtgacggggccgtgggtcgccggacatgcatgcatggctagtcttggcgggcgccggacatggctcattggctggctggtgttggcgacgttgcgtgcttaggactcgcgagctctggcagtacgctgtcagcgtcagctgcggtacgcatcttgggtgcctcggttctccaccacgaattttggtcaaaatgagcagacgccagacgggcagattattctcgttttgaacgtttttgtaccgagaggaaggtcagttgggctgtatgtgcacactaatctacagtagcagtactacgttgtacctttccttttgagaggacgtacgatactccagtcctactgcggtgtacatcctcggacaaggccggggttccctcggcttcgatctaaccagtgcaagtctctcattcgagttaccttagatatcacgtaggacaaatgcatatagaatccactcatctcacagtgcaagttactttcacgggatccccaagccaaacaccctaacccaactactgctacatttcccttttaccggcgcttctctctcccactttcctcgcattctctctcacacttcccccatttaccggcgcccagcggagaggaggcgacatcctcgggctcgtcccagcttcgagcggcggaggggtgatgatggcgccacggatctggagcggcagcgcggatctagagtggagcggcgacggtgtcctcatgctcgtctccaggaagcgcggagcggagccttgacggcgcggatcggagctgcgcaagagctcaccggggcctccgtttcgaggcggagaagggtggtggttggggagctacccagcagcacggcgacgagctccccggcgacaccgaggtcggcgaagtggagtagagcatggggacttaggacgacgccaccgccactcgagatctgcaaccggtgcgatggctggcggtgtagagatccgccaccgaggccgcctcttgaagcgaggaggaggacaaccatgagcggtcatggcgagcggcggtggcgtcgtcgacgggatgacaggagggaggtgcgatcgtggcgggcggtggcgtcgttgacgggctaacgggagggaggcgcggtcgtcggcggctgcggtggcacggtcatggcgggccccggtggtgactccaccagctccacgagctcccccggtcggcgcccctcctctcccttcatgacagcacttcaaaccgacgaggcggcgacggcggtctggagcgccctcgtttcgagcggcaatggcacacggtcgatctgcttgtggcacccttggcaacggcaaccccgacggctgagcagcttcaccggctttggaggaccacggccacgctcaccaccaaggctgcaccggcctttttgcagagcaaggcgccaggctctcgttcctctagagagatgcgaaaaccaatcatagctatgcggcccactcgctttttcctccacgtagaccaggtaacgcgccacgaacttgcactgtgaaagggctagacaggtcttttcaaggcatggccagatggccaggtccagtccacgaacatagtaggaactagttgataccccgcactttgttgtaaaatatgtagataaaatgcatgttatacattataaaaagagataatccattctatgccgtagacaaagcacggattctacaatataccactgacaaagctcagttctataatataccatcgaacaactatttttcttccttacataccatcaccgctagtcaacagctagtcaaattccgttaagaggaagaaaatgtccattttaccccctagggtatcatgcgtactcagatttcattggtcaagatccactaattcttctcattgatgaaaaatagaaatcacttgtctttttatcctccaagattatttaatgagtcatgacattgtgcaaaatctcaattttatcctaggggtaaaattgtcatttttttctcccttaacggtgtatgactaacgactgactaacaccgatggcatataaggaagaaaatgagtcgttcaatggtatattgtagaaccgagcattgtcaatggcatcttgtagaacccgcgctttgtcgatggcatagaatggaaaataatgtatatgtttaaataatgtgaaaatgatctggagataatgatttaacattgcttgcatattgagttctaaaaaataacaaaattataaatgatttgtcatgtttgcattatatttaaactactttagataataattgttagtggatgatgatgtggcacacttgtatgtgatttaaaatactttagataataattaatagtgagtgatgacgtggcacacttgcatgttgatctttagaagttagtgggcatcaactatatagatagtatagataagttaattttttggtctcttaacttgacaccaagttcgattttcaaccttgaaccaaaaaccagatacaacaagcctcccaacttacaaaaccagtgcaaacgagatccctcaacagtattgttaccaggtttggctgacttggcacctacgtggctactttgactagttcttcatctcacatgatattgatatggcgcttacgtgacagtttgatcccggaaaaaaatttaaacccatggagcccacatatcaattacaacaaaaaaaaattacagtggcgaccatgtgggacccacatatcaaccggttgagttagcgtgagacccatgcgggcccccgcatgtcagccgcgggtgaatcctcaaccagtcgacgctctcctcgtgcattagtggcggtggcggctggagcagtggccggccctagggagagtggattcgttgggcctcaagtggatctcgtcgctgggatgccgacaatgatttccctcattgcgatggtcatcggcagcggtagccggttgatgatatcttttgtctgactgacatgtgggccccatatttttattttattttttatttttttgcttctagtgccatgtcactgtcacgtaggacaaggatcaagtcgaattagccacatagatgccacgtcaatcaaaaccgtcattcaaaccgtattgggatcttatttgactggttttaacaattgaggggagaagaccgaacttgctgtcaagttaagggagctaaatgaacttattccaacgtactatatgcgcatgaggcccatattccgatagcaagtccggctaggaattatttgggcctcactcctcaggctctaagtagactctcctcctactggctagtggctacgtactgcccttccctttgcgagcttgtacttacttcctgaattgatttggccgagattattaaatcttttgacggcagctagtgatgttaacagtacaagtgtataacacccagaaaagatgggcagaacaacacctgtaacaaaagttcaggtgtttggcatgcttaaaaccaaaggtaaacttgctgaaatggtgaaaccacatgacacatattttcaggtttagtggagtccatcgcgttgatggggtatatctttggccaaaaagtgaactcactcttctccgttcagcagcggggagcgtgtagattacagcacgcatgcaagcttagtgctcgtcagagaactaatcactaatatatccagccgctgatttctcatcgaagacataattaaaattgttagcacgttgatctgatcacagaagcgattcatgcatgcaaggtgtggctacatggagagcccaacacgcaaccaccaaggatggggcgcgcacgcagagcttgctgtgctgcgtgctgctgctgcgtatgcgtgcctcctggcatacaccgtgtgatagatctggcagccccatccgacctctcgccctataaattgggctaccggccggcgtcttttgttcatcacctccacctcgcaaacagaaccagtactttaatttcaccttgcaaattcagttgaattcggctcgttcaggttcagtcgtttgatcatcatggccagtatggccaagtcgctcttgtgcatctcgctcgtcgccatcctgctcctcgtcgaggtaattaatcagatatttcaaactgatcttttaacctaaacgaaacggtttcctgaattgtatatatttcagttactgatccgatcctgtttatttcttgtttggtcttcagactactgctccacatggacaagcttacgccatcggtaagcaatgcgtgatctagttcagtttttcttttccctttttttctgatctgtgtgagtgtgatgaactgatgagttgcatgcaaatgtatgtaatctcgtgtagattgcggggcgaagtgcgggtaccggtgcagcaagtcggggcggccgaagatgtgcctgagagcatgcggcacctgctgccagcgctgcggctgcgtgccgccgggcacctccggcaacgagaacgtctgcccctgctacgccaacatgaccacccacaacggccgccacaagtgcccttgatcatctcgaccaatatatcaccgctcgatcaccgcgccgccgctttgctatccaaccgaccggtgatgatacatggcggcaaccttgtgatgatcctagctagctagatgtgctacctacttcgtgcctgcatgcatgtagcttgcatatgcatgctagctttgctatatcgcgtatttgctacttggaatatgtatgatgtgtgtgcatatatatgtggcgtgtcgtgatcgatcgatcgatcgaccgtgtacgagcaaataagtaatataatgaagtatttgcttttatgattaaattgcgtagcaactttttcagttttgccttgctatgcatggttgggaaaagcttggggtatagtagcgcgattactagcaacgatgcacgaaaaccattttgtgcgtgtgcgtgcgtgtcagctattcagcaagagaaatcatgactggcacggcttacaagggaagattgctcgtacgtacgctagctactctcgatcacacgggtgcattgtagctttggcacttcgctgcatgtgaccaatatatggcagcaaatctgggtgcagacgaggcactagaagagtaggtgcagccaaaacacgggtcggcgtcgtcagccaccgatctaccaaacgcctgacagtgttaagccaaactaaccacaacttaaacgacggcgcagaagtaaactgtcgcgtgctcatgcgtagcagggcccaagaatgcactaacaaagacagaggcctaatccatcgggcctggcccagctagcaacggaagtgaacgcggtaataagctgcttgtggaatacgttcacattaggtccctcaatttgtcgcccagtctgattttcatcctcagttcgaaaaaccggtatattgcatcccccaacttacaaaaccagtgcaaacgaggttcctatgtggtattgacctcggttttgactgacgtggatacgtggcatcttttgactaagtcttcgtcctacgtggcgttgacgtggcacttatgtggcagtttgatccggaaaaaataaaattggaaaataaaaaattacaacaaaagatgtgaggcccatatattagtcaaacaaaataaaaatatgtaagtgggtcgtactacctccacctcaccccctctctctatcccctatgggtcccaatgggggtcaatggcgacgcaaggcagcagtggcggaagtggcctgcgaggcagcaaggagggagctgcggcgttccggtggcggagaaaaggatggaggtgagggagccgatgagccgaaggaggaggccgagccgcatcggggcgacgcggctaccaccagcagtggcgacggaggaggagaaggcgcgggtggggaaggcggcgagggcagtagggtcaatgctagcagtgccttgcgggcaagccctggtggacggggaagggtcgggttttttttttttttgggggggggggagggggc

SEQ ID NO: 48141 - DNA, 1595 bp, Oryza sativa
tgcaagtacttcatcatgacacgttgttgatgcgaaaaacatacactttgcttttgaaaagcaaactctctccaaatcctcttcgattttaactcgaatccgatctatgatttgccaaatttggtcgttaacacacgtaagcgccatgtcaatgccacatgggatgatgacctagtcaaagggagccacataggtgccatgtcatccaaaaccgagcataatactgctgagggacctattctgcacggttttgtgagttgatggatgcgttgtatctggttttctggactaaggatgaaaattagactaggcgacaaactgagggatctagagtgaacttattactaaacttgttgaagcagagaggggggggggtgttaaatgtcgtcccccctattcggcctaaacagtttagaggacaagggtgaaacatgcgactatagtgaggtgcagggcgagagaggaaatgagagattgagtgagagagggatgcctgcgaaaatactttaagtgattggaatgtaacttttaaacttgtaaatgttgagaatacaaaaaataattgataacagtgtgattatgtgagctgtagtacctactttcgtataaaaaaataacttataggaatgaatctgcgcaagcattatgttcatccatataaattggttttttgaacggagggtgtagattctagattaatgtgttagatgtcgaactttatattttctttaactttaactatagtaaacagtaattttatggaattcactcattttttctcattgagaatttgatctgcgccataaaactgcaattgccaattgcatgctggaattcacacaatttatttagggcccatttgattcaaagaattttatgtagaaatttcataggattcaaatcctataggaatttttcctgtgtgaccatttgattcaagaaagctttcaaattctataaaattcctatggaatggctcattgcacatggattttggaggaatcttagcaagagctacaacctcttagaaaattttcttcgagtctatctttctcatccaatttctatgttttttatgtagttcactcaaacggcaattcctgtgtttttcctgtgttttataaaactctgatttacatttatttttttatcagaattatgtgttttttatacctttatttttttcatcctaccattcgaagtgcacttagttgcgaagtgtcattaaatttcgagaaaccacagatcgatcagatccaagtccaacgatcaactactccacctcccgctacaagccttcagcgcccaaatcgagtgcctacctttatctctcacctttcgcaaatcgcagccggccgccgctgtagtagcaaacatctccttcgtcttccctacgcgtccacccgaaaaagaaaaaaaaaagaacaggagaattatccccacttccagagtccaaacctccccgtccatggcgacggcgagctcgatccggccgccacgcgcggcgctagtcctcctcctgctcgcgctgtccttctccctcaccctcgccgcccacttcgagggctttggctccgacgacctccactccgccc

SEQ ID NO: 48142 - DNA, 12720 bp, Oryza sativa
gaaagtcggggtactgttcctagctgttgatgttttgcacatttggatagcgaagaacttagggagtaccttgaatttttgactgctagagttctaccaaagtcgccatctatatcttttttaacgactgaagtagcctgtcttaatgctatgataaagaaaattagatggaaggtttagtaattaaggattgacatagctttgctcagaattttgtcatgggctggctcaatatgatccgcatgtctttagtaagactgagcaatgctatacagtggcatacatatataatgttttacaacctgtttctctgcaggtccttggtgacaaagcttttgagaaatttgggaaatggttcatctcacttcatttttcagatcaactggcaggctcttacaagaaagtcctttctttcaagtttgtactgccagatgcaagcaacatggctgagatgacaagattagttgctctcgtgccatactacattgatttggtggggcgttacaagctcagcaaccatgtgagtatctcctctatctttgttttaggccacaaccatttttcggttacagtgtctaattcttcttattcatggtaattgcaggctcgttccaaaactgaagctgcaagaacaaaagcttcccaggaggctttcagggagcaacagggtctaaggcaggaagcccttcaaaggaagaaggctgagaagaaaaaacttatggaagaggcagaggccaaattgagcgccgaggcactccgcaagaaagaggaaaaagaaagggctcgtcagatgaagaagtccatgcccaaagttaaaatgctccgttccaggtaacatcaaagatatatcacagcactggctttagctattcagttgctgattagcttattgttgcctgccagactcttttatgttcttctgggccatcaacttttctttgccatggggggatacaagcgaaaggaaataggtgaagataatcttttgctgttgtttcagcttgtcgcttgttgggggattaatttgaaacgctgttttccttgtattaatatacgcaggctggaatggcgtcaagtttgatttgcccccacgatcgttcattttagttcatctgaatgttgttatgcagcagctcgtttgtaagagaactccatgacttgctgtgtaatgcgtttatagatacgctgccagaaactcaagactagatcacataatttgagttgatttatgagtaaatctcatctatgcatgtcttctactggttgaagcagtaataactgttgggattgtcgtatactgtgttatgcagcgctgtttggcaccgctctaactcgagtttttatggagctccagattaagatcatcactgttctttactttcgtgtaaaatcagattattggatttctttattcataataaactctattttctgcaaaagttcttgagttgcagtcttgccaaacagagcctggtcaccaattgtcaaataacagatctgcctactcatgctgtgtttttcccctttgctacctcacagttccttttttttttgcacgcgcgctttcgcttttcaaactattaaacggtgtgttttttttttcaaaaattcttaatatgaaagttgctttaaaaaatcatactactctattttcaagttcttttagactaatacttagttaatcacgcttggatttgtctacttattaagatatgttctttccccttctttctcagctcatcttcctctttccttaagcatgccttttcaaacggctaaacatcctctttcgttaagcatgctttttcaaactgctaaacaatgtattttttgtaaaagttttctataggaaagttgtttaaaaaaatcatattatctatatttaagtacttaataacaccgggcttgtttggtttgctatcatgccaaaatattggcaataccaaatcattggcaaattttggtagtaacaaatgttttggcaacttatgtgtcttattggcatattttggtagcaaaccaaacactaccaaactactatttaaaataccaacaatttggtagggcatcattttagcatcaaaccaaaatggcccaccgtttctcgtgcggggaactcagccttactatgtgtgtcatccaacatctctatgataaattttggagaaaatttgcgaaggtaaacgttgcaaatatgcaggcaaccgaatcatcgcaacaactctcggcagcacatctcccctcttcttcctgagtactctgggccaatctgccgccctccgccgcacgcgccatccgatggaggaggcgcaggccgccgtgatggcgcacctggaccaggtctcgggcctcgtccaggcgctctccgccgagctccgccgcgggatcggccccgccgccgacagccttctcgccttcgtccgcgccgtcgactggacggtaactaactccccgatccccagattagcggagatcaccgatttccagccgccgcgccgcgccgcctcctttctcttttgctgatgattcgcgtgccttgtgcttgtggcactgaggctatttcaggaaccatggctgatttgcttgatggtattccatgcgactctgttgctcacggccgtcgggttgaggaggaatgccaatttccagctcttcatgctgtttcttgcctgtgagttttcttgtttctttttgcatatttttgcagtatgtttaggactgagacattgtcgtcggagaagagaggctagggtataataatattttggtagtataatcttccatttgcataaaccgaaccttgtcgtagtaattgggtcaatagcaactaacagtttaaccgagttactgcatttgcttaaactttagcacatacagcgctcacctagatgctgctttgagcacaaagaagttaaagcagaattggccactaaacctttctaaagatgtgatgccttggcagttggcacaagacaaatattcaggatatcgcaatgcgaactatgataagggtttgagtggaaagaatgtgataaaattatgtcaggaggctaaaacttgtaatgtgaaaggaatgcataaggctgaaacttgtaatatgaaacagagggagtgcactataaatgatcaacattttattattctgtcaataatgtagaattagagtattcttggtgtctgctagtgtgccactcaaagtctactacagagcttgagtttgtggctattgtgagtttctataattggtatcttctcaattctgatattaggaagagacaacggatatctcaggacgttaggtggcagtaaattatctagaataaaaacctggttgtttgattgatcagagtaggctgcttggtttgattaattgtctgattggttccatggttgcctatctgcagattcaggagtttatcttgctgaaaagataaatagctatatggcagagcactggaagagcattgccacacgaaattacttcgaccgcgctggagtttttgtttctgtcgtctggtcgggtccccttatcttcatatctatggtcattgtggttagtaaaagaccttccattccctgttattaaagtccttattaattagttggtgttatgctctctatctatttgcagttcatcttgtatgcatattgaacactttttactattccaggttagctcccttattacattatgtcggttgatggtgaaatggaagagagcagaactaaggcatcgggctcagcttgctcgtgacaaacaggattgactgaaaggttccttagtctggtagaagaaatgattagagacatgcgtcttctagaattgtaactgttggtgtttaatcacctgatgtttttcagttgcttgctgctagtaacttactgcgtcggttatattctggtgttcatgaactctagtaacagctaaaaacagaaatactagacccagtatctgatttcatcatgttttggttcagtagccacgaacatggatgtgtaattttatttaaaatcgattgtgataaattgcaaactgcatccttgtgctagctgtatttaccgtgaaattatacatggcgacctcttatagttataaactaaatagagacaagttagtgggggtacccgtgggtggatccacttccatccctacctctccacagaagtttcacattagctaaatccctcactgatcccctataaacattgtaaatgtagttagaataacaaagtagtgcagagtagaagaaatgcagaaccagtaaaatactgggaaatgtttagtaattccaactacagaaaattacagaggaattgaatcattgcatgacagcatgttacacctatataatttattttcttaggaactgatacacaaatatgaactgttgttgccagcattttacatactacacgtgaaacaattatgtgtatgtactgtaagcataattgccttagtttcataaccgtttagcaggcaaagaattcctgaactttttcctaaacaagataaaacccagggcaccaaggaaaggccaagatgttacaaaagcaatgtaagtaagcaaccaaacagatctcccctgcgatcgaatgagctgattaatggatatctttacaggagcaatagcatcctggattttatctatgttttgttttggctgttcctgtgatcctacaggaccttgggctggcgtcacattctcttgtgacctattaccgtcacactcattctgtatttctgtggcgattccatcctgttgcacaccaaccatgccattgcggagttccatttcattggaaataggattatctgagtcactattgttggcatcatcatttgtcaccgcagttaccatcccatcttccatgaaattcacatatgggcttttatcaatggatgattccaacgaagtgtgcaagctgtgttcttgtgcctgcattcaactacatgttatatcatgtattcatgctatcgtacgccagtttgcgatttaataatctctaccttttgccgatgcatgcaggggctatcatgtagagcaagtagaaactcagaaacagctcccacccacctaccaaatattcataaaggaacacactgacttaatcgctattggataataatgtatattgaagaaacatcacaagtgaaaaatggaggtgtgagtggaaagcggattaaagaattgtcttttcatccctgcccaattatatccccgcacaaaatagtataatttagccgcttgcacctcaaaatacataatttttgtgtttataaatgtatattacttctacttatctaaaatatcctacaaattatcaactacaactaaaacaagctttccccggtaatcgcaattccttacaaatatctattttcaagtttcttagaccatgaacagaaaggtaacggtactttgtccttactattcataataggggcaaacaacataccacagctttccagcagttagcccttgaaaaaaggcaagatggccaccgttaggtgcagttgccaaaacaatgtttttgtttgccctgaatcacacaatgtggacctcatcaatacacaataaaactttaggatggtgatcttttgaaagaaaagtaagcttacctgcattcgtcccagggaatggcctcccttgtgcaaagtgggtcatcaagagcactgatacaaagcaggggcactgacacattactaatgtaatttgcactgctgcaccgacggtagaatgtgtccactgtctgacaaatttatactgatgcaagttagaggcttactggtgttaaaagtagattaagaggcttactggcagttcaatttgaattttgcttatttgttacaaaattggatttgatgcactagcttatggtcaattctgatcacatccctttgaaaatcaaaggtggtaaattaatttggtccatttatgtttgaaccaaatagttgtatgttgctttgccagtccacctctaccttcaaatgtaattggaacagcacaatgctatttgatttgatctaagtatctaactcatgatattaagcaatgctaaaatatttagcaggtacactagcattagaaagaatacctcatattttgcaaccacacaagtggcatgacggtcgaattccctgatagatcgtgactgaaaaaatgaaatagaagatgataggataagtacaaatttgtgtaaccagccaattaatttaaagggacaattgctcttttgacccttaaaagtaatctactgtagcctctgtgaactacaatatataacccttttttatggaaactgaaacaacactcaatactttgtcatggttcacagggaaagttccaatgtacagtacatactatatacacatgagataatagaacaacagggtcagtcagtcaatgtacctttctaatatcttcccagttagcaagtcttgccaagacgggttggtgtctgcaaaaacaaaatggggagaaaactcagtagttgagtatgaagaaaaagtgcattcaccatctttggttgtcattacgcagcacgggcttatactacatccgttgctctggatgatggtgcgagactgctaagcctaaacattttatcaggacatttgcatattcggtatattatgtatcaattaaattcattaacattgttagaaattacaaaaagtaagaaaaatcagagttaatgcagatggaaatgggtttaatggtctgaatgtaaacatgtactacctccgtcccagaataagttaatctattactagatgtggacatatcctaatactatgaatctagtaaggaggtagtacttcaagttattgtcctctaatcagattatcagtaaatggagtgtacattctgcagttgtggcacttgtactagaactgaagatggtaactactcgagagttagtgctgcaagaatttgctacaagacctagtatcttcttacggcacagatcagttacagatcacaatatgaaataccccgattactccaactatcacataactatgagaaaattccttcaatgtagtctggacctcactagaatagtcgagtgccttaacagttcagctagcaacagctatttgctcttcaagtatcagatcacaagtttaagcaacaattcatcagaaaggtccaaacatttccttagggctcacatgggattggaaactcatcagtcaccatcaaagcaaagccataagggagatgtggtctacagtaaatttctcgagagtaagaagaaatacaaaaaaacaactgttcagggaacataaacttcatatttactaatttaatcattcttggttgactgcaagcagaagttctttactggacgtcccaccctctcctcattctcttatttgatatttgtcaattagtgctggtttctctcctaccacttaacaaaaagccctcttgaccctccaaatccccataagacagcacttgacgataggcaacgagtaagaccattatgtgggttctgtcgcaatgagcaacatgatcacaaagccacactaatcaaactgcttgtacctaacatataaactctaacccaggatactagtctacaattgtccacaagattgtatgggatgcaggcccttgataccatgagctcaagaatagtgtctcatcttgatttgtccacaatgaaattaattttaacaaagatcataaacacacatttcaattgatataggcaagaacttggatctttagctaaaggtgcaaaacgcaaaccatcattgccattgtattttatttgaaatgcaaatcaaataaattgaaaaaggatttatttgataatcactaaaccttgattagcacaaactatagtaattcaatgaataaaggttgtggcaagttgtatacaatgttagtcttgtttaaatgcttagctggtaaagaagcgtaatgagaacatacagttttgcatatcctttcagaccaattgcaagagctttgtcataacatcgttgcacaagcttgcgctgaataaatctgttggtcacctgcaatattgattgatataacaaaatattacggatagatgtaagaaaacaattaagaagtattggtgtgaaatgaaacactagaagaggatattatttgctatttgttatttcattaagtgagacacagcgaaattgttagcaaacaaaaatataggtatcataatgcaaaattgtgtttcaaaacaaataaacaattatttatgcataaaataatatctatagaaccataaaaaaaaattcaaaaaaaaaaaaaaactgtagacgctgaccagcagatcccagggtgagcaaatagatacagcaccagccacaggggtaccctcaccttcttctccgagatacttaacctaaaagggcaacagatgaaaacaacataaacaaattgcagctcacttttacaatatcaactacagtgtatagcagagtgcgtgcatgcgtggagtgagagcaagcaagagagattatgcaaaacaaaacagaagatcttaagaacagacaaagtctaccagaatattggcacctatgcttgtcccaacagcaaataatggagcctgtggatacttctgatgaaggtaattgacaatctcacggaaatcttctgtccatccagcattgtagaagcaatcagactgcaagaataaatactaggttgaggaacaagtaccacctgaacatttttcatcaactgctaccaaattgatgattctgggacataattttcctggagtcagaacatgtattcaaggattttctaatttccacatcagcatcattgattgatggtttaggcctaacaccatttcacccattttcactttcatgcacatatcatgtaatagactgggaatatggaccacatggttcaaaagcttaataaaaaaaaaatgttcaagtggttcaaaacaggaatatgcagtgtctttacatttgctatcaatcctaatatctaccttataagacaaacatgaatcattcagctaacagaatttaagggagcacaagtaacaaatgtgctttccaccatatttaatcttatgacactggttaattaattgcttgtcctcgtacggaaggtgcagatcgacagtaagcttcagcaatgcctctctcgaaacttctgccctgtagttcattttatcatccttttgtctttggactttagtttagacaagcatggctattaaaaccaatcagttaaagcagatgacaccatcgatttttcaatgctgcatatcactatagaataggaggaaacttacagttatggagatgccacccagacccctatgattgcctacaacaacattccaccctttgcttgccatagaaaagaccaagtgcttcacatactgcaacagacagctgcatcttgtttagaacaattagggaaggtagcccaaatacctaaaattgattttatggaaaattccagattgtgtttaaaccaaagtttggtagagaaatcatagggacttacagcagcagtagaatcactagttaatccaggtatcacaacaacaagaggcgtcgaatcatccctagagataactccatcacaaaaaccaacatcttcttctgcaacatagaactaactatcaggcatctctagcctattgatctgaagctatccaacaaaaacatcagcaccttcacaatcagaggctagtaaccaatccaaagcaatggtcccaccatcgcgaactgtgtacagctgcctgtgttatagagttcaatgaatatgggaaactaatttcataactaagaatttaataaatatggcaaactaatgtcataactagctgcagcaccgttccaagtttaatttgtaatgtccaaccaaaacagaacatgagtctctaccttatagtagctgatcttactgaacttggaactggaactcatgagaatactaaataccaatatatatcatataataataaaggaacagcatgccgcaattctgcatataccagatttcgcacaaaagtttattgccccttatttttatacaaaatggtgcgcaacaatcataacttcatagggaaaaaaggaagctaaaaccgcacaagcatatccatattgagaagtttcaagtgataccgttaggccattgagccatcagaacagtccattaacatctcataccaatgtacaatcaaacaaatactcacgttggtgcagagagaccgtagacaaatgcaacgagtaaatgcacaattccaagacatgaatttactcctacctcctatacgtgaacgaagggggtctcccagagatgctcaggaacagtgtctgcaaatgagggctcgcaagccacggcgtcgccaagtacctacgcgaccgaccagcgttcccgatgttagcgatgacatcgcaaaaaaatattccgacgaatccacacaactcggagttctctcatctcacctgccatggagggagcggcacttggatgcgacgcggtggtagacgtgggaggcggggtggaaggtgagcgcgacgcggcccccgcggaggccgcggaggaggtcgccgatgaggtggagctcgaggaagcggtacagtaaggcgcaggcgaggaggagggcggcgagggcgtagtgcgccggcggcaccagcgccgccgcgcggagcagcagctcggcggccgaatcgccggcggccgcgtttcccatcgggttgggggggagggagggacgggacggagttggatgccaacttgcgaattgcgattgcgagcgatggtcagacacgtgagcccgtttcgtcggttaagaaatgggcgcttggtggggcccaccttgcgagaggtattccccactgtgcggagctgggaagacactgactagtgggcccatgcgtatttttgtcgtaaacgattattgttactacttcctccgtttcacaatataaaactttctagcattgtctacattcatcatataatgaatctagacatatgtatgtgttagattcattacatctatatgtatatggacaatgctaaaaagtcttacattgtgaaacggaaggagtactacttttgcgaatgtgaataacaaagcaaatacgaagacagggaaggtcttccacaggtgcaaactcagcaacatgaagacccaaaattctaaaagagaataacattagatcaacacatagttatatatagtatcaaatgatcttgttatacattagtgcattacagccttttttttaatactcattacaaacttaggatacaagctaaaagatcattgtatccactggggatgtacaggtgttgcatctcttattgttactaccatatagtattacaaccatgccatgagatgcacacaccagaaacacttgcattacactaccttatcagctaggccggtacactacacaagactaaaggtgttcattgtgccagtgccagccccgggtccatggagctggtatgtctggcttggtacaacctgaagaacacctggttgctctgcaacaaaagaggcaggagccaaatcagacgtaaggatacaaacagaagtgcaaatggcccaagtacgattcgcactattggcgactttagcatacatacttcagaaacttaaccaaaatccaaagaaatcatgtgccgtattgtaatctataaccacacgacactggcatgtacattagataagttttacttgattaatgataaaaagaacagtacactaagaaatccggtagctgcttggtcatagatagcgtatatgtaagatcgaatcatgttagaaatataagttaaaatggtattaataaaatccacggtgaaaagaaaaaccttgcatatataatcctagaaaatgaacagatgcaagtccagttcataaggaataggttttatttgcaaatatcttatcagtttggcaaatacttacaataacagctaagagcatcagaattcacaaatatccttcaataggattgttcatactatatgggataagtaggatgtaaattgatacatcctggtctacaaaggaaatattgtacttcctggttccaaagtaccaaatattacatgacaaatatgactgaagcacattattatggggcaatgaagaattagttatagttataatgtacaatccccgaacaggttcttagtagcttacaatcctatgatttgtgagtgtgcacttaagcctgaacctgggcttgtgagagaaaagaatgattgctttcgcaattattgcaacggaagactacagtgtgaaagaaactttgataaccatcaacattaccacagaacatcaccaatcaatcacacctaagtccaaagatctaaaagcttaaggatcatacttaattttactcaacaagatggaagttattcagtacggccgctgtattacagattgacaaatgatacatttatgttccaataagaatttgagactccgatgttcatccattggtttggtgccagccaaaaaccagatttattcctctcgtttcattttccagatatagaagaacggtaaacgggcataattctgaaagaaaaataggatagagtactcactcttgagctcctcgacctgctggggagtaagttttgcagagaaaccgcttgcggcgtgcttgtagtggtagagcaccgcctcctttgccttctcctcggtgcaatcaaccaaccccaaaatcagcaaatc

SEQ ID NO: 48143 - DNA, 6459 bp, Oryza sativa
ccccctataaagcccagtccctcctctgtgaaatttcattatattcacttaaaaatccaaaaaaaacaaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacacacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcattgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctatttttgtacgaaaacatcaccccgtcataacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatctctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtactcccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctatttattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcacccttgcggagggcggcaagggggccgcctgcaaaattccatgccccctcgccgcccatttgcaggcagccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatggaaaattatttttgtaaaacttttaataaaaaaaattaaaaataaaaaaaattccttactcgccatcgaaatctcgattcgtagccgaacggattacgactgacgggggtcggagaagaaaattccgaacccccaccaaccttcgcaaccacctgcgtggctgcgtggtttcccatgggccatgggccatgggcaccgaggaggtataatcctgctttggttaaagaccacaacagagagactccttagctggttcaagtgtctccaatttccatcggaggaggttacccatcggacgtctaataaaaaacgaaatatcggccgcctctcacagcccttagtagcagcgcacctagcactacatttaaagcgcaagagcatgcagctacatgtgctagcctgtgtatgcagcatgtacggctactagcactatattataatgtacacatatatttttattctttgaactcttttctcttaaaatatatatttgatatgtaatttgattgcatcattagatttgttataataaaatctttataacaagatctcatatggctatattttgatataaaaaactactgaaacatcatgaaatgcttattgcaacaacagctatatgtgacatttcaaaaacccattgcaacaaaaaaaaactttaaagtgcaacatagtccatatctaattgaaacatttgtttctcattgagtgaaacactgaattttaacagtagaaacatatatatttttttcgtcagaatataatcatgcaagatttaataacaacaaatataccacaataatcggatcatgaatcgcataattagtttggaagaaaaatagttttaaagatcatgtctcaatttgcatgttcctatatacttgcatgcaagttgtgcatgcatacggctgagtaaaagtaacttggaaagagaaaccaggaaaaacaccaggaaaggtaaatcaattttagactagtatagaggaggaagctggcgtccgatgtttgtcttcccgtcggacgcgcgacacgaagcattttccatttccatctggtgttcagttgcccatcgagatattaatgccatcgataaaagcaacttcctagtttctagaaatgccattgcacaagcctctttctcccaaaaataccatcaccgtcaattcaacaccattacaaccgttatttttttttaacaatgaccattttcccctcagtgcagaatatacccagtttttatggtaaaagaaaaagagagatgaaacagtgaaaatttctaaccctaaccctagaacgatcctgatccaggcggctctcctagcggcagctcggtgcagggctcggtgacagcgatgaggcgtcggtccacggtggcggcatggcggtccatagcggcgatggggcaggacgcggcgaggaggtcgcaggcggcggtgcggctatccatagcggcgatggtgcggggctcggcgacggtccacggcggcggcgcaacggtccacagcggccgcaagggagaggcgggtttctagcggcggaagcccccaccgatggctccgtccctgctcctcctcccagagaatagctactggacctcggagtggagatggcaccgccgccgtactcgcctcacgaaccaggagcaatgacattggcctcggggtttcttctttctctttgtgctcgcttcccgccgatgtccagtggtaggttaagtttcttttggatttctcttccgatgcagagatactgagttgctgcctctgcagtggtgtttgccagttgctcctcctcgtgtggaggtgcagcgcgtccggacgaggcgaatgtgtgaaattggtttgtgaatttgatttatgtgaatttaattctaaaataatttgattgatagcaaaattgatgtctgtatttagatgctaacagaaatatggatcaatgcaaaataatgttgtgtgagcaaacaatgcaaatgatgttgtgtgagcaaatggttgcctggggtaaaattgtcttttcatacaacttaacggagagatgttaataacagtttgactgtgatggtatttttgggagaaagatgcaatggcatttttaggaagatgcttttgtcgatggtatttctgggattatggtgcttgtcgatggtatttcatggattttctcttaaaaaataatctaggaagtcggtcgatcctactgttcatggtcatgccaaccatggcaccgaccattttggatggacctgaaaacatggtagcgatctatcttctttaggcttttaaccaggcaaaagctatgttgatgcacagatgcactccaaagagtactgctatacgtacgacccagttgtacaacgatagacatgcaaccatagatcaattaaaggagagcatcttcatatgcactgtggccgtttacaactattgatcaaatccaatcgtacgtgaatcggacaattgggtcgtatgcatagaaaaatttcactccaaattatccagattattaagagatgctttgccgcacacaatggaaaatctctttatccaaaagacaatcggatggattcatgtacaaaacatctctccttcagagtgaatcttaagatcacacatacatattcgactaaaattatgttccaagatgcaaaaaggtataatttagactacattgtatctgcagccagaattgcatacaacctaccaaacgcaaactacatagcgatgcaattatcaacatgcccgaccttacaagtagcaccatctagccgatgctaagtgctttcatattcggagtttccttctcttggacctcccttagaatcttgtcacattcatcttcctcttcctcgttctcttctggcccctcctcctcttcctgcatttcctcttcatctgatctgtaatcaatatagccatcgccgaatgatttgggtattttctgcgcttcttccatgaaagtcatgatttctccactagtttgggctgagaaagtagggaaatagtcattctttgtgaagtagatagattgtgcctcttctgtgagctccctcgggaaattcttcaagaaccatggatggttctttatttcctgcatggtgattctctatacaggaaaagaaaagagctcatcgaacttgagttctagagtaagaccacagctcgatatggctcattcactagtatggtttaccacatgccataattaatcaccacatgaaaataaagtcacttatggatatcaatatggaaaccgagataaatgttaacttgcgttcattaccttcgatggatcactgacaaagattcgtgatatgagttctctgcaatcagtagatatgt

SEQ ID NO: 48144 - DNA, 1806 bp, Oryza sativa
agaggcgggattcaaaaattgaatcctgaacgtctcgagcgcgggcgcgggcgggaaagagagggagtgggcgcggggaaggcgggcgcgggcggcgatgtgggcaacgttgcccgggaggcacgggagcgagggggcggcggtggttgcgggatgcgcggcggcgactggaggttgggggaggacccgacaggtgggccccacttgtcggtgaccctgggagagaggaggggggctcgggcggccggctgggccgtggccttcggccggcccagcggggagggggaggaatatgggctggcggcccattgggaaaaggagggaaaaaggaaaaagaaaaaaaaaagaaggaaatgaattttcctgggattaaatactgcttgtgctcgtttttaattggttaaaattatttctagagctttgaaaattccactaaaaatcttgttagcatatttcgacatgtagaactcaagaaaaattccacatgccaattctgattattatttgcattaatttattagggtttctctcttgcttttacactgatattttctctaggcgatttataaattcaatttaggcttgggaaaagaaattcagggtgtgacacaggagtaccattgtaaagtaagagatatatcttctatctgagttttcaattggtgataacaaagtatgcaaccaatcagttaaatcattactaaaagttcatttcagccctgcagtgcttatctttccaaaactgtgtaactgtactatgaattaagagatcatagtagagtatagcacactaacgctggttgaacttctctcttgtttacaacattactccaaaatcatcttcaagaagaatctaacatgctatacacacaggaactaaacctatctcaaagggaaaaaaaacaatgacaaggtcatccacaatttgtcaattttagttagtgtaactagtaccatgattcaatcaatagtaactgtgttgaaactagaaacgatatcatactctgtaagtcaaaactattcttgtgatgaaagcacatgaacgtataccattattcgcatatggcttgctaatgtgatggttcttggtacatcaaaccatatctgtgcaatagtctaggttaattaggcaatgccaaagtgcttagaaagtaataattctatatctaaataatcaacttgtacttccagttccaggtttttgctgacatggaaagtattaatatgcatgccataatgaaaggaaaataagaaaataagccatatatggaaccaagataaatgacgtgcttctgataaatgttaccaaagaaacatcaaagtacatatcataggtaaacaagaagctatttaactcaccttcccatcatactcctggaggtttagtatctctggtgcaataatataccgaagtcccaactgctgatttgggccttgaatgcaacattgatgactgttagaaatggcaaacaattattcctgttcaaactaaaaaagaactaaaagcatgagcaaactctgaataattggagacaaccttggagtacccaaaatcacatatcttcaggcgcggagctgcgctgccatccaagagaacattctccagcttcaaatctctatggcatattttctagaaagtagcgaagatggttgcaatatttaagcattttttcaggtcccactcacgttatttgagaaaacatactagcagtttctactacacatactacagagcaacatggaacattagattattgaatgtgctgataagataagaccaatttattgtttatccataccatgtga

SEQ ID NO: 48145 - DNA, 6568 bp, Oryza sativa
tttagatcactaaaaacatgtatataaaaattttattcacaaatcatttcttgtttgcaattatgtcatttggcttttttcctcaataagccaaacaatgaccctatagatttggatgggacatcacctagtactttgttgtactcgggctctttatattcatcgtttacatgatagcatctggtaaggtgtacactggcccgtcgcgccatttgtgtccctcaactaatgaattgttcacttcacatccctcatcaccgattaggattccacatcagccaaaattgcccacaaaccactaagagagtctatttgcactggtttcatcagttgaaacctgttatatctgttattatggttctaaggatgtgatttaaactcaacctcaagataagggatacaaagtgaacttattcctgtttaattacagatgaagttgtgggccgatatgtgcataagttgggccttcaattcttttgcattcctcgataaaattataatggcaaaatttgctgtaggacacctaaaaaatgtgtaattagctgtgggacatcgcaaaaacgtgaattgcctaaggacactctaaaggtgtggtaatttgctgtaggacactgcacgcattaaaatataatatccacctaattgatgagagagaaaccacatcaaatgaccattttgcccttatctttatcttgcttcttccgacgtttctaaaaagaacaaaaaccaaatcacatcagcggggtgtaccactgtgaccttgagcttgagaacctgctgcttaactaggctgagaacctccgacttcgggctcagcacagtctgctaccatgcgcgccccgacgagctcctccacaccgcttgtggcacgccgacgtacattgtccccgacgtgctcgccgggtggctacgatagcaccaaggccgacctctagtcctgtagcatcatcctctattgctcgccggcgcgctactgttccaagacgagaacctggtgtgcatctatcacaagatgcggcaggtgacttcagctgcccgacgtggttgacaacggacgcacggaagctcatcaagatgttgttcgacctcaacccagacacctgcatcaccttcgccggcctccacaagatgcagtggttccggaagatggcacatgttctgtgacccatctcaccaagctcgcgcaggagccagtggacatgcttggcaatgtcgacaacgacaaggatgaattgcgcaaggtgctgaacgccttccacctgatgtcccttccaagggctttgacttgtcgccgttgctcgtgcgtacgaccctgccgtgtcgcaagggcgagccatggcgcgcatgggtggcatgtgattcacgacgcgcgagccggcgagcggcgtggtcacgcgattggaggcgctcgcgatgggcaacaccatgcccgtgcacgtgataacgagcagcgtgttcagggtgtgcctcaagtgtgaggagccatggggcggctcgccggcgcattttatttggtttggtgtttattcttttcggaagcatcggaagaacagcaggaagaggggaagaagataagggcaaaacggtcatttgatgtggtttctctctcatcaattaggttgatattatattttaatacgtctagtgtcctgcagcaaattaccacacttttgaagtgtccttgggcaaatttacgtttttgtgatgtctcatagctaattacatattttttaggtgtcctgtaacaaattttgccaattataaaatgctttactattgttccctttccaacttcgccgccatctgcgcgcgcgtatggcaacgtactacatcactgatcactcagcgcgatactgcgtgcagggcttggccatgttagctttctcgaccttgatctccaccggcggcaaccaatgcagcagcgccgccgtcgccggcggcaagacctgcccaccgtcgactctgcgggtggcgttcttctacatctccctctacatggtggccgtcgcgcagggcggccacaagccgtgcgtgcaggcgttcggcgccgaccagttcgacccgagcgaccccgaggagtcggtctccaggagctccttcttcaactggtggtacttcggcatgtgcggcggcaccgccgtcacgctggtgttcctcagctacgtccaggacaacatcggctggggcctcggcttcggcatcccctgcgtcgtcatggcgtgcgccctcgccgtgttcctgctcggcaccaggacgtaccgctactacgtctccggcagcaagaagggcgtggtcgctcgcgccggcgaggcactcgcggcgtggcgaaacagggcgaagtcgatcccccttcttccgccggcttcgcaggagtgccatccaacggcgacatcggcgccggagttcaggtaaaccagtaatgctcgctgcaatgcgtcttcacgcatctggtaatcttgcacatatggtgttcgataacatgattttttttgtctgcaattttgtagcacgggagtagaggaggacgaacaggtggtgggcaaggcgggcctcgtggagcaagcgaagggcatcgtccggctgttcccgatctgggcgacgtgcctgatctacgccgtggcgttagcgcagtcgtcgacgttcttcacgaagcaggcggggacgctggaccggcggatcggcgaccatatacaggtcccaccggcggcgctgcagagcttcatcagcatcaccatcgtggccatcatcccggtctacgaccgcgtcatcgtgccggtggcgcgccgctacacgggcgtcccctcgggcatcaccatgctgcagcggatcggcgccgggatggtgctgtccctggtgtccatggtgatcgcggcgctcgtcgagacccgccggctgcgggcggcgcgggacgccgggctcgtcgacaaggcgggcgtcccggtgccgatgagcctgtggtggatggtgccgcagtacgtgctgttcggcgcggcggacgtgttcaccatggtggggctccaggagttcttctacgaccaggtgcccgacaagctgcgcagcctcgggctggcgctctacctcagcatcttcggcgtcggcagcttcatcagcagcgcgctcgtgtccgggatcgaccgggcgacggcggcgaggggcggcagctggttctccaacaacctcaaccgcgcccacctcgactacttctactggctgatcgccgcgctcagcgcgctcgagctgctcgcctacggctacttcgccgtcacgttcaagtacaagaacaagaacaagggagctctcctcgcaacttctacgtcctgttgatgatgcacacaaattgtgctttaggtatgtacatgaatcagctgggtacatatctacatatttaaactttggggagatgttcttaattatgttattagtgttttccgaatatcagcctttgatctatcacagtaaagatgaacatattatttttttatgggaggggaatgtggttttattttcgcgagcttttgaatgggaatggggccgtaccacttcgaaaatcctaaacgtcgggcgccggcgcggctgcaaaaaatcgggcgccgggcgccagccctggcgtctcccaccgcgcgcgcgcgccccgccccgccacctgtcctctgccgccctcgtcacgtgtccctacatatactctattacaacaaattactcatatattttcgaaactctcgattaagggaattcgttttattttttgttccataaaaaatatttcacctagtgtacttacaatgttttactatgtatagatataatgttacagcgaattgaaacattcttttacaacaaatcacccacatattttagaaaccctctattaagggaattcgtttcattttttgttccacaaaaaatgtttcacctaatgtacttataatgtttcactacgtatagctcaaatgttgcagtgaactgaaacattttttcgctatttgctgaaatattgtttttatataaagtgaaataacgcccaattttttgagaaactgttgtttcatacgttgtagcaaaatgttttacgaggtgatttggttgtgtttcaactttttaaatcattgaaatatttttgatctacctagtgaaataattactatctacttagtggaacaatttctatatacttggcggaacagcgtgcaatatttaaaaataattcaataataagctaatttttttttcatcggattatattaatgtgtggtcttgttttaaagatttaattgcaacgagtttagtggtgcaatcggatcgtgaattggataagtaatttttgagaaaaattagtttaaagtttatttaaaaaacttgacacatgcatggctgcatgttctgtgcatgcagtgcctaaaaataatctctctgtgcatgcgtgtagtagttttgggtcctgtgattttctttctcccggatcggatggctgggacggccggacggccgcccgattttttgtctccccggatcgggcgcccgatctctagtgccctccgtaccacttcgtcggtcagattgcattttttttcctttactagcaattagcagagtggcccgcataaatcgggtggctagcatcgttttattttttttccgtataatactctgcataaaacatgtggctagcatcgttttatttttttctcatataatagtttaaatattttcacgttttatgattaaaatatattaaaactagcaacataactttaaattatgtactaacttaaccaaactaaccaatcacgaactaactaatgcgtgatatttatattgtattgtatatatgtgatatattcatattgtattgtatatatgtgatagttattaattatttttaaattttgaattttagatatttctaaaatatactttttatggattctagattaaaactagctaggtggcctgcgctattatacggctagcacccatacaaaattatctttttttacatatgattttattaaataactatcttatgttagaactttaaaagaccgactttatcatccccgtgtttttaatagtcatgccaattactacgccttatttcgttttcatcgctttatttgctttctcgatctaccattgttttcattcatcctcgttggaacctttactgttggtgatatgggcccgggggtatcaggtttagagggaggaggctgccccccgatgccatgtggccctcccccaaggggagtcaggcccgaggtggggtggcggccactccttccccagatactagtcggaggaggctgccccccgatgccacgtggcccatcccccgaggggagtcaggcccgaggtagggcaacggccactccttcccagagactggatggaggaggctgcccttcaatgccacgtggccctcccccgaggggggtcaggcccgaggtagggcggcggccactccctggccgagactagagggagaaggccgccccaggcaccacgtggctcccccccgaggggcgatcgggcccgaggtcgggcggcggccgccccctcccgtgactaggggtcgggctcccccgaccccctctctaggtcaccacgtacggtgggttaggtgtccacctccaggtgcccacctgcccgcatttatggcatcccgagcggtcgcgccacgccgcgttttatgcggtgtgcagtgcacttaaccggtctgtgaccggtcgaatgactgatgggacccaagatgttaggcgcaccatcacgtgtgccaggcgacgtgcagcccgacatatcccatcaaataatgatgatgagaggttctcatcctcttatcccagccggagttggtcctcccgctttggtcaaagcaaagctcccgtttcccggtgtaataggagtccagaagtcttcacccgttaaatggtgactgacaggggcaccccccgtgtcaggcggcaagatttgacaggccccatcatcaagacgacgtgtgcttggcttcccaagtcaagagacaagacatgcatttaatgcaaagattataatacttctccaccggagctaggttagattgttgggcccatgtggtaaccccttgaggtataaaaggaggtccaggcctagtggtggaggggggggatttccgagcgaactggcgcttgggtctcgcaaccccaagcacttgtgttctacattcaatcaatcatgcacaggagtaaggtattacgcatctcagcggcccgaacctatataaacatattttgtctcatcgtcttggaggggcctaaccccctcaagatcacacagctccgctcaccaagccctcgaatctcacccgctgcccctggccgaactcacaaaggggggcctcacggttccctggtggaggagttcattctctgacatctggcgcgccaggtaggcggtgcgttcgtgatttttgaggttcttttgagtgctggcgtggtgagtgtcgcgccaccgctacggggaaggcgcagcatccttaggagtgtcgtgccaccccaggcagggggcaaggccccccacatccccaccaggt

SEQ ID NO: 48146 - DNA, 21334 bp, Oryza sativa
tccgagggagaggagcggcgcccgacggagtgtagttgggcggccccttagtccccgcccccgccgccaacgtggcgctccccttcccgtcccggtctcccctgccgccctcgattcgctcccctccccttcccccgccgaccgccgctcccatccccacccccgccgccgccgctctgaaacgagccggtgttcctgaggatgaaatggctaacctaaaaaggcaactagcgccaggaccttccacagctccaccagctccaagcactgctactgctcctgctaaccggatgatgaactttgtcagtgctggagtgcaggcataggctgagagcagcagcaggcaacaacaggctgctgctgctaacaatgaggatatcgagctgcctgatgagagcgacgaggaggaagacgatgaccaaattgcgaagaagagtgttcccgctgcggtgtttggagagcttggcaacagagctgcagagaacagggaggaggaaagctctggtgcccaggagaatgggcagcttggcgcccttgagaggatcaagcgaaggcgtcaatgatctgccactgtcaagatgcccacagagctggtgcccttgtaacaacttgtaaacatgattttgagtggtgtttttgctcttgtacaagaatttacgggagttattaatccgttattgatctgcgaccattttttcgtgtactaactattgggtacattccccgctttttattctctcttctaggctagaaggcaatcatgcattattcaattctttttcatttttgcgaggaaacattatttgatttcgagagtgtacactgctactggagtgttgaaacctgaaaaatggaactaggagacttcatttctgttactgtctcatgtggtttagcctttcatttgcaaagttattggttgagctacggttttataaaccgagtaatataatgatggtgatatgtaaacaaaactagaaatttcgttaactcggattattcgaagtgaaccaaaatagtgtattcctttgatcacaaaataaccatcacaaaactgtcagaaattttgaacatatatttgcaatttgagctctgaaggtaatgaatagtggaaaagaaaacatgtagtgaagaaggccagaatagaggaaagcatgtacaatttgatcacaaggtctctcattcgtcgatgggccggaacacctcgagcgactcgcgcagcagttcgtcgccaatggtgctcaccaccttagccgcgccgatggccaccggaaacgtgaagccgccggagctcacgacctgagccggagccgggcttcttgccgcggtaagcgcttgcggtggcggcggcgacgacgccaatggcaccacccatctggagcttagtagtagccaccgatgcggcagactaggcgtggccggagagcagcccggagcggctggtccagctcgcctccgacgagcacgccacggtgcgcccgttctggctagccgcgtccacggccatctcctgccgcggctgcctcttgtcacactccttcttgacgacgtcgtcctgcgtgtcgttgacggcgccgcctcctccctctccccagcgttggcgtcggcttggcggtggtggcgaggcgggaggaccgtgtcggcgtcggcgctgggagctagagcggcaggaggcagggacaaactgcgttgcactccagctccagccccggccccgcccgccgccgaacccgatcccctgctgcttctgctgcgttgtcggcggcggcgtgaggatcgtcgacggcagctgcatggcgagacgtggccccaccgccatcggcatcccccgcgtcgagcccagcggcgcgcggtggaggaaaccaccgccagcgactccgctcagcggccggaaagaggcgaagaagaaggcggcggcaacgaggacggcggcgttgcctccccggccgccggaccccccgcgccgcgtggcggcttcgtccccactcgtcggtcgccctgccgcttgccctgagaagagagagaggatgggaaataagagagagatgatgacatggcatcttacatgtggggtccacacgctgactcagccgtcatgtcggataaaaccggggtcaaaaccactgaaggacctcaagcaaacggttttcttagttgagagacgaccggtatccagtatctgattttatggttggaggatgattttataacttgatgacaagttgaggaccttaggtgtactttttccaaggaattaccttaggagacatccaggtggtggcaatgggcagaaggcccatccgacctaggaagaagcggaattttttttatttttagattttttttaatatttacagaaataatctatcggtcaaaaaaattataaaaatagatcctgctgtccaccacttgggcggcaagctgacgtggcaaacgggggagggacaggcggtgacggagggagggttttttgcaggaaaacccttgccgccctctgttggggcggcaaggggtcccaatgcaaaaaagccagccgggaccggccattttccaggcggccccttgccgctctctggtcgggcggcaggcctcgctgcctataaaaggcatgccgcccagcccctagccctcattcctccccccacaaatctagtaaaaaaaagaagaaaggggaggagaagagaagaaggggcgaagccctgccggattcacacgccaatttcaggtaatattcattgatcctatatgtgactattgagttaaatattgtgtattttttaaaactttgtttgaataaatgcattatatttttagggttttagttgtactaatctagaagtgcgtattgtagatatcggtaactacgtagatctgctagtttggaatcagtactttaccgttgcattgtcatacacaaggagatattacgttgtaggtgtttattgcatgaaagaataatatgatctagttatttcgttgacagatatgtcgaacaaacaaatattccaagtttaccatggcccatgaaacgtccgttacgggccaactggggtagatctgtcagaatttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatgtggaaaatgcattgcaacgtgggtggtctctagctatggttccgtttgttcacccgaaggatccaggtgtgcagatgaacatgaatgatggcgagggaccaagtgctgaagtaaatgagacttttgtggaagaggtcaacgcatgagaggacgggggcgtagtacctccagtgggcattcaaccaagtggagtggtcgacgagggggagactgtcggtgccattgtggatgaaatgaagagggaggattctgacaacgagcgtgtagaggaaggtgattcgtcagatgatgagacggataatgaatacgttgttgttatatgtgcacgatacctttcgacgcatgcacgatacctttcggcgcatgcacgactactttctgccgcaccgatgcagcctcctttattcgagtgcgatacgagtatttgcccgccatttgccgcatacgaccaatgtaactttcggcgccaatcaggcgtacccaccatgccccgccacattcacatgtcagggatatcactcgatttttggtgcctatataagtcgccttaacgagcgaggcctcacaatctttcagaactcagtcacattcagtactttcttccccacttgcttcattacaaatcctaccggctttcgtcaatggctagacgcctgggcgttgaggatccgaactggcgtagcgatccttgtgtatacctactaccaccttggtgccagcgtcctctctgcctatgcagtgatcgatgccaactaatggcttcgaggaatcctgatattcgaggaaggtgcttttttaggtgccctaactatgaccgtgaggtattttattatctgcatatgcttattcattccgtatgagcaatcgttttattcttcgtaacactactctattcggcagacccgcactacggcttgcgcatatatcaagtgggtcgatacagaaaatcccgttctcgacctaaccacttgtttacaagaaggtcgctggtatttcgcatccgaaagtactgagcaatacttgcagagaaaagcggcttatgaacgacaatgtcatgaacaacggtgcgactagcgggtgctaactacggcactccctccatgggaagcccgtccaggatgcaggtgtggtgatcgttgtcaagttcttcgttccataaagcctacaatattgggtcgaaggttctttgtttgtccaaatattcttgacgacgatttcatgataagaatattttgattacatgaatccttattttctcacaacatttactaactttgctcgcttcatatctattctttcctcccaggaaccaccaaggagatgtcaatatagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatactgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataattctccttgtttaaatccatataatgtttctacgaccgagactgcgataggactatatcaattctccgagtactaatacgtcaaataagttacaaaataatatcttacttaacatatgaaattacgaaacaaccaacttcaatacatttttataacaatattaacaagttttaccaataaatacttctttaattattattaacataacatagaaaaattatttggcagtactttttgcatctgggtcccttgccgccctctaggggcccaaatgcaaaaagtacgagccccaagctctttatgggctgccaaaattgcatttagccccttgctgcccgggctaaatgcaattttggccgacggcggcagacgacgcggtcgacccgccgtctgccacatcagcttgccgcccacctctggggcggcagggtctatttttgtaattttttttggccgatagattatttctgtaaaaattaaaaaaaatctaaaaatgaaaaaaaattcggtagaggcgaggctccctcgcactgtcgcacaacacatgctcatgcctgatctagcgggcatgtggaatatacgagattgacatgattatggctgacataccaaaatttttgatagaggacgtgcatggcatgcgcttgcgcgcggatagtggatggacgaaattcccaccgacaaccttacgtatattttaagtaggtatagctagataagagaccagctcgagggatgatttcaaaaaatccatctctttccatattcatggaggatgagaacccttttgctgtcgatctcgccgagcacaacgacggcaagctcgttgtcgccaaaagaaagcaactaattaatcagacacggaggcacccaccgaacaccttgatgacgatgacgacgtgctagtgtgtgggtagaaagatttagtttggtggcactctgtgaccaggatgacagacacggtagctggtgttgatggcatcgacatatatatactgacatgctgtaacgacattgtgatgcatggtcttgttggatataggggcattttgcccaaattgtgaagatctaacaagatcagtgtaacacgccagtacccacattcccggagtgctactccttgaaagtctccaccgcacttacggacatccatatgttaggaaacctatgggcttgggcccatgaagtcccagcccatgaatcgaagaaaaggagaagaagcaaaggaaggagaggagcatcgccggccgcgccatggaggctgcgacggcgatgccgtccttaccaactccatgccagatcactgcgcctcgtcggctgcgatatgaaatagtatacaaggaagaacgatgagaaattgggggagggagagtcgatggcaccatcgtccgcccctcgtcggccaccgcaggtcatcccgcgtcgccgccgcacggccgcacccagtcgccgcctgacctcaccgcccccgcgccaccccgcacggcgtcgtgccatgagccgtcggctcgccgcgcccgcatggacgcatggccgccgacgccgagcccgcgcgcagcccgtgcgccgacgccacctggccgtggcgccgccgaggctagccgccgctccaccatgacgccgccgaggctggccgccgcatcgccgccgccacgccggccgtcggcctcactgcaccgcgccccgacccgtcgccgcacgacaggtccgcgccgtacccctacacgccgccgcgcgccgccgccggacgcgctctgcacgacgccgcccgcacggccgctgccaccgcgccctcgccgccgcgcgccgccgccggacgcgctctgccctgcgccgcccgcacggccgctgccaccgcgccctcgccgccgcgcgccgctgccggacacgccctgcacggcgccgcccgcacggtcgttcccgtcgcgcccccgccaagcagcgcagccgcggccccgcatggcctcgccgcaccgccaccgcagcccggccgccgcgccgctgccaccctaccgcagcccggccgcggagctgcccagaccggccactgccacactgccggttgcaccgttgaccactgtgcgccggcgctgcttggccgccgcgcctcccgcacaaggcaactgcggagtcaacgggaagagaagaaggaaagaggaggagaaaaggaaagaaaaaagaaaaatggaaagattcccgtgattttgcatgaaagcccctgaagttttgggaaactaggtgcatcctcctctgcataggaaatcttgccttttaaacccttaacttttcaggaaactcacaaatagccctctgtatttgggatatttgtttgaatggcattcggaatttgcaaatatcaccggaaatcatattctcgcataaaaagagaccacggacattgacctttgacctcgactttgcatgtgccttttattgctgatgtttatgattatgaaatttatttatcgcatttacgattattgattatttgtgatgcttttattacttttagttaatatcgttgaagttgaattttgtgtaccattatattgcaacacatgtgcattttaccggcatttaatttgcgcatattttttaataacgaaagatgacaggcatcacgaattagaaaatttgcaaaaactagaatatctctgacatatttatttaatgtcgaaattacgatagagcgagaaactctatggtaccattaatctaatcgcgacatgtgcattgactcgatgagtttgatctagcatttcaaatctctcgtcagtgcctccaagctactctcatgaatgagtacgaatgagcgcgttagaagattatggaccctatctctcgtagagcaagtactatgagcaagagtgggtatttttcgactatagttcactgagtaaatgacccagagagtacggtaatacggtgcaccgaatttgcactgaatactgtagaaactcttaatgttctgcccgaacgcaacaaaagtcgcacgcaaacatcactagtgtacatacaaagaagtatgcctaactagtcgataatagaattgcgtaacgtttaggataatgttcactacaagagcattatcttccaaaaccaactagcacagttgataatgaattcaacacgagcagctagcccggtgcacttacctcaatgagaaaagaggacaaggggggagtaaaacacatgtcaaggtgaataatctatgaacatgaaaaagaaaaggacaatcctaatagcacactcatcatgaattgagggggagagctcctagcctattttcatgactatgggcatagaatctcctatgctagataggataagccctgaaatttatgtcagagtgccatagctgttgagcaagaagctcgctatgaagttaattgaatccgatgtaccagaatactttgttgaatcaatacacttcgtcatcaattgttgcaatttttgaatagagcattgcatcgaataaatggttcttgcccaagcagagcacacattttccctgcaatagagaattatttccagtataaaatagcatatttaaggcatttactattttgttgctcctttctagcacatagttataatgctttgaattttgtgtagtgtccaaacataaaagaaaaatgaattgtggtccgcataaccacaaataacactttaagagaaagagttatttccagacccatagaactggaaatattatgactgttgctagcagcaagaactgaatttgtcggcctagaatgcgccacagtcatattacctatggaacaatcatgcactttatagaagcatatattgtccgtcaacccctttgaactctctaaaaagtgtgatgatttgggctacacccttttagcaatggattttcagctattttcggtcttagaattataagaataaatattacaactcgtatggtcatagcacatatatgcataatttttctaaatcatgaagatttgtgtgcaagaatgcaccgacaggagatcaatgcataaactgcatatagttctaacatccttgaaccggattgcgaagaatatatgtggctcccatttggtactatatggataaatgcgcttccgaagcagcaaacatccagtgtctcttagacaccgtgtctttgccaaaactgatccggcaagatcacgtgaactccaatagaactcactaaatcatcttcagaagtccacgaggacaatgctagcattgcatttgatgattgatgaattggcagcacgaagtaccaaatattcgcataagcggactaagtataagctatgaatcacaatatttcctatatcattgttgtaatacctgcagtagaaaaggacatgtagtcctgaaagcagcggacacgtattcagaccatcggcatgaacatccatcctgcaactagtgctatcgcatctgtttggtttatgtgcatatcccactatcataatacgttgcaaaaggctctctccgaaagtcggaaaccttttacggagatagttatgaagcctaaattccttgacaaataagtattatttccagtcatttagggggagagaatgaacccctagataggaaatgtcaggaaatatgatagtagaaagggactaatgcatgttacaccgcactagtgaatgcagtttgcataaagaattaaaactgccaaatcactttgtaaatacttttgtgatttcgaagagtttgactaagttgcatgaatgaaatgcaccggaggagggtgataccaaagaaagtaaaggtacccctcatcttgtctagaagcctcgaacaaagaattggacaagaaacttcggatcctcacacccctaaagtaaccggagacgtctggtgaaaacagggcaaaagggactatcatactcaaagtcacaaaaggtaccctaccaaatagaaggggagccagttgagatctggcaaacggtacggaacctccgaataggcgtaccgcaccttcccatcaaggaagaaaactagctgttggagtgcacactaacgctggtacatgcccacatcaagaagtattaagcaagaagaagaagaagcatatgaaaaatgcatctcctcgtatatccatggatacttgcatagagtctcatgaaaccaatagaagttggtaatgagattgattatgggcaatgtctcctttagacaacaaaactcaatggtagtcaaccaggagttgaataaatgaactagaagttgaaaagaagaactcaacctgaatattaacaagcattgaagatgttgaagatagaatcaatgaatgcatttcaggagtttggattggacacttgcataatagtacatgaagaagtattaggtcccgaaccaacataaaagaatagaataaaccagaaaagaattgaagaaaacaaactcgttcgttttgaatttgaatttgatttgaaatatttgaatccaaatcatgctgacgcttgcagctaaaggcatgcgatagatggaagtctagtacatcagtccaactgcacttagaaatgttcatggtgcatggctttggaatagtcaattatcgccaaaatgggacggaattcctaaacatgagtgtcatagcagcacatgaatacttggctaattgaactaaaccgaactaagcatcattgaactactcagagccttagcatggctttgagagatggttacccgcgacagcaatcgcgatttgaaaactatcttaaccccccccatttatgaaattaaagtagcatatgttgcacatatgagttatgtgagaagcaaactcactaagcatatgagcccccaaactcttctatgtacatgaattgcatagaagcaacgaactaagtcatgtggaagtcttgcagattcatccactaactcattatttacatcttcccttgaataggtgtgcctgagaaatcggaataatgaaacttagagaaatgcaaaattcagggggagaatttcgctaactcatttcagaatcttgatatagaaaatcaagtacccaaaatcaatctagaaagattgaatgaagaattgggtgaattgtactctttttcccttggataagttttcccagcagtttcttatcaaggtttttaatgaggcaatttgtgcaacattgcaagcatatgctatgtactctttttccaaatttttcccactgggtttttgtggagttttaatgaggcatagacatcacgcggtgagtgcccaagggggagtgttaggaaacctatgggcttgggcccatgaaggcccagcccatatacactaattgggcccacaccgaaaccttccatatatggaggaaggctatataaggaggagaggggtgctcatttgtacacacttgtgcttgaggtgaatagaggaatgaatgaaaagagagtctcgcccctacattttgtgtctcctttttgtagaattacgggaccatcttggactacttcgtgtagcaggagggttgcgtaataccataaacatcaacgataatattcaggaaagaccatatggactatcagtctatcacggtagcagaaaacaacttatgataaatctaaacacgatgtgagctagtctaataccaatgcgaaactaagattaattttaggggttgctatatgatgggatgataccaatcacagaatcacatattatatatggtacttcatagatatcaacttgtgcctacactactacaaacccctcataggtagtggcttatagatattgcttcattacacgtattgacattttttcaccttcgcgtagtgaaaaaatatagaatgggtagatgctggttctaagaaaaaaagtaccaatattatttataccaattttttaaaaaaaaacagacacctataatatactataggtgccattcagttaaaaaactggcaccaaaaatatattatgtctcggttttataaaaaaaataggcactaatataaccgagccgagccatccatagggcagaggtttttttttagcccaagtcaacaatcgttcttatcatttcgcccattttccccttcgctctcaccccttctctcgttttttctcgcccgcacccccttgctcttggtctcaccctgccacccccttcactctccactgtcctcctcgacgtgcagtgtcacccctaccccaaatcgcgtcggcgcgccttagatctagttggacaagcgaggagaacgacacaccagatggtgaggaggttgaggaagttggcgaaggcgaaagcaatgagcacgacggcatcggagcggcaccctacatctcataatataacaacctataaccggatgagacaaatcttagtattacaaaactagatagacactcaaagtttatggtctttaggacattcaaagaatgtgtatttgctataggattaccacgaaaacatagtgaatagctataagaaagtgtgttagggttatggataaggcatacttcctattcttggggtcgtgagatatacggatatgttataccctcaagtatatgggaaggtacctctgaattgaggaaatcggatgatctataaggaaatcgtctctccggatagaaggtgttagagttctattcagagaatataaggatttttgtgatatcgtgtgaggacatgtatctccaagctatacttgaagaacaagataatatacggtataaatagagaatccccagaaggggtaaggcatagaatcttagtgcaagacacccactatagcagaagcaatccagaggacttgaagccaactcgccgataggtctcgtcaagccgttctcgacagggatctcgtcggtgatctcaggattatgttgttctctattatactctatggttttcttcataatcccatataaactggaatagggctattatctcacaaggggtctgaacccgtatattctttgttccctgtgtgcttgatgtcgtatcatgtggatccccatatcaacgtaccccaataccctcagaatacggtcagtgggtaccacccccccccctcgacgccgtgaacgtgttatttttattatctactttttgaaaagacaagtttgtccaaaggagtgagaatggactggatcgatcaggggggagataagggtagggcaattaaggcttgcgctctaggctgatgaccaaattcccattaaaatcttatgcaaaatactgtaaaaagctgaagatataaagagttttgctaagaacacatcaactcagctctgctcggccctagacgtgatcaattgttggctccgccacttagatcgatcatgggagtaagaatcatctagatctggttcgaacaagacccaatcaccttacaaaccgatggacgcatgagcaaattggtactttccacgctatttctttcttcatttatatcggatataaaataatgtgtttgatgttcagcagctaattaccatattttcatggtatcacgtaacacatattccctctatcccaaaatataagcatttttagaatagtgacaagtcaaacatttttaactttgattattaatagaaaaaataaataaaatcaataatgtaaaaatgatgttattagatttatcattaaaaatatatcataatatgcaactctttttatttaaaacatcttacttttatagatattattaattaaaatagtatctttaaaactatgtagaagttaaatattgtttatattttgggacgaaaggagtaggtgtttttatatcttgcagtaaatatcacggactttaagtgtcttcgcaaatttttccaaagacttataaatcaatactcgtaataaatacagagattacgccagggagctaatcgcgtacaaccgcgcacctacagttgtggccagaaaacgtttcgcgcgcccacgaggcacgtgtttcagttgatactgttggacgtaaacccgtcggcccaacaaccagacaagaaccaatcaaaaccactgcaaaataaagccgattttggtatacgtctcacgacagattttttgcctcaaatcacccgaatttgcttccgtcggatctcttgggcatggtttaatttgacggtcatgatttatccccctaccaccgcggcaccacctagcagtatctttaccgggcacacaatgaacaatacaaataaactgatgagtacgggcaaaaatatgaacaccatggtttaatttacagtgtatttttattaaaattacagtgcatctacatgctatatctactatttttacaaatgtaattttagttataaagcactgtaattttagttataaatgcaacatttaacacttcagatacctggacggtttctcaagcagtgcatttgtactaaaacgacaaatattctagttaccaaaatttacagtgcatttgtacttaaaattacggtgcacttacatgccatatttattgtttttacaaatgtaattttagttataaagcaatgtaattttttgttacaaatgtaacatttaacacttcagatacctggacggtttctcaaacagtgcatttgtactaaaacgacaaatattctagttaccaaaatttacagtgcatttgtattaaaattacagtgcacttacatgccatatctactgtttttacaaatgtaatgttagttataaagcactgtaattttagttataaatacaacatttgtgttaatctctactaaatactactctattaaccaatacaatcacaagctatacctggacggtttctctatatttttttaatggttagatgtaaatataaggagagaaaaaatattttttctcgaaaatcacacgacatatgtctagacagtcccaaataaagcagtagaaagcgccaaacgcctccgaatcagtaccccttccactactactgctcgtgctcgatcggccaaccatggcgtcgggctccaccgatcccctcctcccccgcgccggcgccgcacgccgccgccccgccaccggcggctggaggtccgcgctgttcataatctgtaagcacagctgccaccccagatcgcgtctcctcgatcgaaagctttgcttgaatcgtctccgctggtttttaggggtggaggtggcggagcggttcgcctactacggcgtctcgtccaacctgatcagctacctgaccggccctttcggggagaccaccgcggcggcggcggcggccgtgaacgcgtggtccggcgccggcgtcgatgctgccgctgctcggcgccgccgtcgccgactcgtggctcggccggtaccgcaccatcgtcgcctcctccgtgctctacatcacggtcagttgagtttcagatgctaaccgaacagcaccgtaccctccagccttatccattccgttctcgatctcatcgatgcgttttctttggggattttgttcaacctgctcaattccctccgtacatttgctacttctacattttaacctattgttttatttgttcaacctgctcaattcctccgtacatttcctacttctacagtgatccttgccataatttatcagtttattctaaaaaaatatttattagccatcttgcgcagagttcgatatagtatcaagggttacgcctagtgacctgagtagtattccaaagatcctaagttcaaatcttctatgcagctaattttaaattgggttatttgtggggctaagttttttatttcaatggtcgtatatatctggttggacgtagatgccagttaaaaaatacccttctcttaaaaaaaaaaggatttgagagatctcccacgcaatggcattatccgcacgcggttagttggaagcattttccgtttacgctgcgctgcggatggaaagtgactttacacgcaagtccaagcgaacccgttctgaattgtgatttactgaatttaacaagactttgcgtgcagctgctatcttattacgcccaagtcaaatgggcatggtttttcagttgatattgttgcacgtaaacagcatttcctgacgtcccgggagaagtttcagtttcaattggttaatttaattgtcccttaatttatagcctgggtcgtgtagtttccagtggccggtagtgatcatgctcaacacgttcagtggagtgagaggacgtatcaggcatgtgtttatttgcatactagtctccaaatattgttttctaccaataatagggttgttgctttcaatttagctagtagtctattttcgaaggaacagggtagtagagccagccacatcaataatctttcatgccattgtgtttactgtttagtgataggatcacaccgcgtcttgcagaaaatatttatgtacctgcccattgcaattgaagttcttcagctcagtgtctgtttggaacacattaatttcacatggatcagtgtctgtttagatcccaccctaaaattttacaccctgtcacatcgaacgtttgaacacatgtataaagtattaaatataggataaaaaataactaattgcacaaattgcgactaatttgcaagacaaatctttttagcctaattgctacatgatttgacaatgtacttttacagtaaacatgtgctaatgatgaattaattaggcttaataatttcgtctcgcagtttaccgacattatagatggccatctgggccgcccggcacggcacggcccaagcccggccgtgcctgggccgaggcttgtcgggccggcacggcccgaccgatgcaccgggccgtgccgtgccagcccacgggcggcataaacggcccaggcacggcccaatactagtcgggccgtgccgggccggcccgaaggcacgatgggctattgtgctgcctcacagaaagagtttatatttggtccctcaactctgtgggctgtgtttaaatggctggaaataagtctatttttgatccctcaactctgtgggttgtgtttaaatggctggaaaataagtctattttgtatacctattttcttgggccatgccttatacggttatataagtctattttttgtccctatattttttttatttgatcgggccgtgccgggccggcccaccgtgccgagggtgcagcccaggcacggcccagctatcgggccgggccggcacgggcacgaccctagtcgggccgggccgtgcttgggccgggccaaaattgcgggcttcgtgccaggccgtgggcctcgggccatatggccatctataaccgacatactataattagttttttttattagtgcccaaacaccctatgtgacaccctatataatacctgatgtgatacactaaaactttgcatcccagttcaattcttgtttgaatccggtaaaataccgacgttacaattacggttttgcatgagaaaattcctcggaacaggacctaaatatatttgatctcgcaaactgcgctcacctattcaccatggccaaacaacggcagggactgggcttgctagcgttgtcgtccacgttctcgtcgcctcagagccaacaatgcagctcctccggcgatggccggcaagtttgccggtcttcctccgtgcagagggccttcttctacgtctctctctatttggtggccatcgcccagagcggccacaagccgtgcgtccaggcgttcggcgccgaccagttcgacgcgacggaccccggcgagtcgtcgtcgcggagcaccttcttcaactggtggtacctcgggctctgcgccagcgcgaccgtcacggcggcggtgatgagctacgtgcaggacaacgtcggctggggcctcggcttcggcgtgccgggcatggtgatgctgctcgggctcctggtgttcctgctcgggacgaggacgtaccggttctacgacggcggcggctccggcgcgttctccggcgtcggcgaggccgtcagggcgtggaggaagagccggcggcgaggagaaggcggcggcggcggcggcgccacggttgaggcggagcacggcgagctcgcggaggaggtgagggggatggcgaggctgttcccgatatgggcgacgtgcctgctctacggcgtgctgttcgcgcagccgccgacgctgttcacgaagcaggcggcgacgctggaccggaggatcgggccgtcgtcgtcgttccaggtgccacccgcggcgctgcagagcttccttggcgtcagcatcatcccctgcgtgctgctctacgagcacgtcctggtgcccgcggcgcgcagggccaccggcgtcgccaccgggatcaccatgctgcagcggatcggcgcgggcatcgcgatgtgcgcggtgacgctgctggtcgccgcgctcgtcgagacgccgtgctcgagagatgaggcggctgagcgcggcgagggacgccgaccccggcgcggcggtgccgatgagcctgtggtggatggtgccgcagtacgtgctgttcggcgcggcggacgtgttcgccatggtcgggatgcaggagttcttctacgaccaggtgcccggcgcgctcaagagcctcggcctcgcgctctacctgagcgtcctcggcgtcggcagcttcatcagcagcttcctcatctcggccatcgacgtcgtcacgaggagggacggcggcaccagctggttcgacgacgacctcaaccggggacatctcgactacttctacctgcttcttgccgcgctcaccgtgctggatcttcttgcttacgtatatttttcgatgtcttatatttacaggagaaaggttgtcgatgttcaatgatccatggatcgatgcacgcaatgcgcttgtatagatgtatattaacctgctgaattcagcatggttataacagtataatggcaatgccaggggtaaaatattggtgtaaaattccctctttacctttattttccttctagttacaaataaagaagtgagaatcgaaattcattgcctgcactcttggtggtccgccctttaaaccgtagtacaagcacatcttctatcccttggattggtccggagataaaaaaaaaccattcagataattatgttgaacaactaatcggcctaatttgaccaatgcatttgtgccctcgccatgtgacagttttagtggtgaaaagttaaaactgcagcgaaccaccaaactaggtgatgattctcgtaaagcatggccatgggcagagcatggtgtcgccacgttcaagcaaataccgaggaacgtgatatagcccgtcttaggggaaaaaagaagtacatatggacaagcaagtccaatggctacaaactaaaaaacacgggcacacaacatgaatcttgattcttggatttgatggcattttcttttctactatctgcgaagtggtgcagcagaatccctcgagttcgtcaatgtcttccctcaagtgtgcttttttaaagttagaacgaacactagcgtggcgcctcctgggagtcatggaccatcggaaaagcctctgaaacattcgtggcaccaatttacttgttactggcatcaaatatgtcctaacatttttatcttgaaactatcttattcccagttcgatgatacgatgaattgctctcgcagcagcaacagaagggatctactagcaggaatgcaggacaacagaagtggtctctgcctctctcaactgagagaacaggatccggcaggaagcataaagcacgaaaagaactcttttggctgaaagctgtgtcccaaacaaattgttcatgggtcaaaagaagtcttaaatcgtggaaagttcagcattagtaagattttaaaaatcgcgtggagactccttcaatcatggcaaagtctcagaaattgatgggataataactgccagtagctcaaggcacacaagcatctgatgttctcgactctcaagccaccacagcataaaacgtgtaaagcactggagctaaacatacactcaaacagggatttggatcctctgatgcctacaaaggcagaggagccggatccctcaaacagacactggagctttatccctttatcccctctcgaaatagtaattcaacaccggataaaaattgccctgatcaaatatactgaagtagtagtagcaccaaaattccatgtccatacaaattctgatccattgcctaacattacgacggatgcagagaagccgtagagcatagcagagcagagctgacctactcgatcactcactcactcaccagtgtgaccagttcactcctcgagctctacgaccggctcgggcagcgtgggcagcacggggtagttgcgcgagaagcaggcgtcgcagtagccctccgcctcggcgccgtagatgctgtggagcttgccgagcgagaggaaggcgagcgagtcgctgccgatctcgcggcggacgccctcgagatccatccggttggagatgagctccccctcgctgggcgtgtcgatgccgtacaggcacgagcccaccaccggcgggctcgcgatccgcatgtgcacctcgcgcgcgccggcgtcgcggagcagccgcacgatcttgctcgaggtggtgccgcgcaccagggagtcgtccaccaccaccacgctcttcccgcggatcacgccgtggaccggtgccagcttgagcttcacggcgaggtcgcggatcgcctgcgtcggctggatgaagctgcggccgctgtagtgccaccggatgaggccctgctggaactccagccccgacgcgcgcgcgaacccgagcgcggcgtagaaccccgagtcgggaaccgggatgaccacgtcggcgcccgcggcgggggactcctccgcgagcgcgcggccgaaggcggtgcggcgctcgtggacggcgtgcgagaagacgacggagtttgggagggcgaagtagatgtgctcgaagacgcaggagcggcgggggcggtgcgggacgaggcacgctgaggagacggacatgtcgcggcggtcgacgacgaccacctccccgggctccacctcgcgctcgtaggtcgcctcgatgaggtccagcgcgcaagtctccgacgcgaacgcgacggtgccgttgcggcggcggccgagcaccagcgggcggaacccgtgcgggtcgcgcacggcgaacatcttatcggccgtcaggaacagcagcgagtaggcccccgcgaggcgctcgcacgcgtcgcagatgcgggacagcagtggccgcgacagcgacgtcgcgatgaggtggaggatgacctccgtgtccgacgaggtgttgaagatggagcccctcgcctccagcttgttccgcagcgcctggtagttgacgaggttgcgttgtgcgcgacggcgacctgcccgaacctgtacccggccaggaacggctgcacgttccgcagcgacgcggcggcgccggcggtggagtacctcacgtgcccgatggcggctggcccggggagcgatgccagccgtgcggggtcaccgaac

SEQ ID NO: 48147 - DNA, 10790 bp, Oryza sativa
cggcggcggcggcggccattggtgagtgggggaaggggaacggcgcgagggattgggggggaatggatgggtttcccctccgagggcgaggtcaaggggcgggatttaaagagggttttgctcgtcgccgtctctccgccgtaggatgcgatgtacggtgctgaatacataccatcggtatccgtatcgtatctcgtacgtgtaccggctgctgttgcgttagaaaaaaaaaaggaattctgagtgcgtagtggccgagctcgaggctcgaggagaatgggccactgatgggtgggccctgctatggtggagtagtagtagccgcctcgagcgctagtggatttgaccaggccgtgtgcaggtcggcatatggcggcggctggtccatttccggtccagggttggggtcccacgtgtgggtactgtgtcggtttcagacttttcagtggacacacacgggtgtgggctgtcatgcgatctcctttttgggctggagttactgtgggctgccatgagacctccttttgggccggagttactgtgggctggataggcggccttgtcggagacagtcacggctcggcccgtcccatttgtttgatggacccgaatactgtcgcatattgctgatttgcagttcccctctggtaaagtgcaagatgacgttgaggaggtggatgcgaagatgcccgtcagcacacaccatcacttttcaccttatcacatcactaaccaccgctaactaaaactctgaaaacacactaaagcatagaaacacataataacactccagtccaaggaatcagtcgttagcacggaggaacaaacaccacgttagcaaatacgggaaaaaaaaccctccagtacagcgaagaagatgaatgacaaaagaaaaaaaaaaggacgcacgagacagcaagatgcagagacgaacacaaagcaccagcaactaataaagcaactactgttaattcatacggagtataccccgaacacgacttgaagagtgacgaccaatcggcattcgagcgaccggctctcacaagtgacaaaaccgggagcaaaaaaaaacaatggaaaaacacaaggcggccacgcgggaggtccatcggccatcgcaattgaagcacggcgatgggggtatctgcaggttgtcccgccccgcagggaggtggggcctacgactacgatgaattgggatctggatcgcggcagaggcggggggagcgcaggaggcggcatgtgagggggcgtgcgtgcgtgcgctgtcgcggtggtggagccgtccgcgagatcgtgccatcggtccttcaccgtggatgctaaccacgctgcatttatatttgctgcgtaaaactcctctctgcttcccggctccctgctacgcgcacccgaccgtgtgattgatattgatactgataagcagtgacatccgtctgtaaaacatacacactccgtcccataaaaaacccaatcttatttacgaacctggacatatacgtgcccaggttaatagctggggtttgtcttttttttttggacatagtagtatttttttcaacaaaatacgtactaacacgtaaaagaaaaacagaatatgtagggtgacaactttcatgtctaccgaaattccaccgagtgtatttaatggtatcgcgtgatctctctttacatgagaacctagccatagtacattctcattttaccgtcatcaccttttctaccctagtgcgtgttgtgcatctaggggtgggcagaataagaccgaaccgaagagaccgagaccgagatcgaaaaattcggtctcaactattgaaagaccgaaatatattcggtttatttggtcatgggccttaattaaccgaattgaccgaaataaccgaattaggctcaatagatctagttggtccaataaacccactaataagaaatcctaggggcaggtgcgtcacagcctcacaggcatcgacgcatcgtttcatccccatccatcctggagcggcgccgtcccgactcccgtctccatcccatccgcatccttcttcgctccatcgtcgggcgccgcttccgcctccaccgccggcgccgcctccagccggcccggcgccgcctctagccagcgtgccttcacctccaccgcctggcatcgcccccagccggcccggcgctggctccaccgccgggcgccgcctccactaattgttgatttgctttgcttttgctgtttttacaaatagttttgttgatttgctttgtttttgctgtttttacggttagttcggtctatgaccaagaccaaaccaaactaaccgaagaccgatttgctcagtcctgagatttgttggagaccgatcggtcttgagattacaaagaccgaattttaaaaagaccgagaaaccgaaccgaatttttcggttagaccaaatacccacccctacgtgcacccgacactattggttcaatggcacacacttccgttaacaaactctatggacaattgtaggttggacatttgaaatgttgagtaaaaattcaagatcaacatatctttaattcaacccaatggcctactccctcaatcccaaaaaaagccaatctcccctcctagtacaacgaatttggatagccctttgtcacatcccctcctaggttgtttttttttttgggatgaacattatttaaaagtctgaactttttttatttaaaagtgttgtggcaggtttgttctaaacaacccggttacctccggcatttccgtccttggtgcccattgtgagtacaccaagcaaaatgtccatgcaaattgaagaataagatactcatttccacctcttcctctcaagttattacacttgtttccccccatttccctccaaccccggacaccccgcacacgtacgaacaggccacaaatcctcaaatatcggacagcgcagggatcgaacgcagaggaaatccaaaatccaaaatccgatcccctcgaaccaaagaattcgaagcgcgcaggcgggcacacgccccaaatgcgccggcggacgacgcgcgccgccgcagaagcagcacggcgccgatgagtcgcgcccctccggacgccgccggcgacctcttcgccgccaacctcaagggctccctcctcgccgtcgcctcctccgcgttcatcggggtcagcttcattgtcaagaagaaggggctccgccgcgccggcgccgccggcccccgcgcaggtccgccggccttatatttttcttggttctcctggtttgcagcctttgggcagcgcctctcgcgttcttttggtttcttgggcgttgttatgaggtcatgtggcgaggaatgtcctaaaggcgccccattttatggccaatctggtgctcttcgtcaacgatgcgctgtaatcattgtttgttcatggtgaatttcaggtgttggaggctatggatacctcttggagcctctctggtgggttggaatgattacaagtaagttcttgctttcttaggttgcttatttcttgaggggctagtgcaaaattattcgaaattcttgataattttttttccgaatttcgtagtgctcattggtgagattgcaaatttcgtggcttacatgttcgcaccggctgttctggttactcccctcggcgctctcagcataattgttaggtacaactgggatgtgttccctttgcttgtaaaatttcctggttagaacccatggtttgaattagttttaatctgtccatgcacatgcgtggtgaatgcgtaatctttgtggagcagtgctgttctagcccatttcatcctgaatgagaagctgcaacggatgggagtgctgggctgcgtgctctgtatagtcggatcaacagtgatcatccttcatgctcctgaagaggagacaccgagctcagtggagcagatttggcacctggcgacacaacctggtatatccttgtagtttccctttgtactttattatcgtcagtcatcacaattgtactttgtattttctgcagcctttctttgctatgtggcctttgcactggtggtctcactgatcttgatggcgcattgtgctccccgctatgggcagaccaacatagcagtgtatataggaatatgctctgtgattggatctctgacggtaagtgatctctatggactatgaaaatgcctttgttgttagcttggtctggtgtttaataggtttgtttatcttatttttgttatgctaggtaatgagcataaaggcagttggtattgcaatcaagcttacaattgagggcataaaccaggctggctatttccaaacttggttatttgcaactgtttcagctatatgcataattatccagttaatttacctgaacaaggtacacctgtagtcattttgtttaggtaacagaaatattgatgttaatttgcatgttcacatcatgataaactttcaggcactggacactttcaataccgcagttgtgtcccccatctattatgcgatgtttacatccctcactattttagcaagtgccataatgttcaaggtatgcaggttttagtaagttccacaaatgccagttagtttaagtccatttactagaacaaaaatttgagaatatgttttatggtttccaggattggtctggacagagtataagcagtattgcttctgagatctgtggatttcttactgtgctttctggtaccgttgtattgcattctacaagagaatatgatcaaactatttctccaggtaattatttctgagttttagtcaatcaatgcttggctattcttatatgagaagatgaatatttgttctgtggtacatcatgctgataatattattcatgcaaacataaataagtggttttcccaaagttgaagttatttagtcactgcagtttgagtttccaatctccttttactagccttgtggtaacaaagctggtgtaagttgtggttgttgagagttggtgctttactttagtattaaaatcactaccaatttgataattcctactgaaaattgtttggtttcttttagcagtgaagttactttaatcaaaagtcaatagtattttgcctcaaggagatagacttcgttctgttaacagtagttgtcataggcttactcattgccttcatagttatggatcaagaaagaaatggcctgtggattgaaaagtattaatcaagcctactatttatggtgtcttggcatatctgtccttttcaactgatttaaggcttgcctctagatagttatacaatgctaggaatccctcactttttttagtgcatgttctttaaaaaaaggaaaagtaacggcaatgggatttctccaagatattactagcacttcacaatgtctatgatattataggttacccaatactgttatcatatatatagagtggtactgtaataatttcctgtttttatttttttactacagacctttatactcctcttcccccaatatactggcatatccaagggaacggtgagacggtgaaacaaaaagaggatgattcactctctgctgacttcatcaccgtggtgcgacaagattactttgtctaaagaatagagaccgtcctgaatgctcggtaatctcctcaatatcgtctttcagcagtgacaagaccaaatcaactgcaaattgtaggattgtaggattagctcgtgcatgatcatgctgcatccaagccaacaccctccaaaggagcatcgaagcagcctggcttttttttgcccatttgcacgaaacaaggtcttctgcttgtttatcaaggtggtgtgacatgatctgttatgtgtatctgttcctttgattcgaggagcaagtttatgaggctgctcttgctagtttgacggatgtttttttggcttttagtttttgaggtttgtctgttgatgcatgtatattgtacagtctaaatgaatgtaagaagctagatctaccctctttcggtgaggttgaaaccattcatgtagcctactagcggttgctcaccatattagcgctgcagagtgtgaaactctgctgttacagttcacattggcatagcattgagagtcttggtatttacttacagtgcacattagctctttaagcttttctgctgctgtcctattcaactcctgacatgtaataattactgttcccgtgcaaatattgctgaaacttgaaatggttattgctgctgtgtgctgtccaggaaaagcacaattttgctcatctattctattatatactaaaagtctattaaacttcctacaaacgctcttaaaccgccacatggcatcctacaaacgctcctaagtcgccacatggcatgctaataaataatagaaattcctagaaattctaagaaaaaaacaaaacatctgtccatccgttttcattaaaatcagtggacccaatgtttcaagccgtcagatttatcttaaaaaaaaaagctttccacctccacctccttcctcccacacgtaacatcactttccctttatatgtagtcacgtataataaatatataacaattgatttacacatgtacaggtgtagaatagattagatcaaatcatattaaagtaattaatccctctcttctaatctcatgtgtatttgcgagagataaataaatatatactattcatccggagaaaatatatgtatgtatatatgcatgtacatgagactattatttggaaaaaaaaaaagaaaacatgcatatgtccgtacataaaaaaaaccatattttcctacaaatactcataaaccaccacgtgtactcctaaaaacacttctaaaccgtcatgtggcactctaattaaccggtggacccactattttagatttttcagctattagatttacaattatatagtggacctgatattatacgtcattagatctatttttcaaaaaaaaagaaaaagaaaatagcatcgatcccctcccatcccgcttaagtacatttccatttacgtgaactccatctgtgtacgccctcccctctgttccttttctctcctattttcatgattttcatgctattttagttagatggaaattagaatttataataatattttttctaaaaaaataaaactaaatcactgtccttttgtagaaacggacgtatgcctcctccttcgtgttccaaggccggtgtccaccctcctttttttatatattatttaaattcaaactagactgaatatttttaaccattaaattattaaattattattattatatcaaatagatttttaaaccttttgattaacaaaatgcactaaaattagaataatttaagtagtttaattagaaaatacagcacccaaagtattttaaattagatctaatattaaatgtatttataaaaatagataactctaaattatagtgcacattcgatctattttaaaaacagtaatctcctcccatcatcctgtctttcgtaataccactctcctcccactctggctcttgcatcctctcctctccaatgcaattatcgtctcttttattttttttctaactaacataatataaaaatagtcataactattattttatttataattaaacattcattagctatattttgctatataaaagttaaaatatatcatttgaaggtggaccctatcgtttgcatgaacactaaataaacacgaaaattaattgaaaatatgtatcgtgttatactaaatcattgtacacaattaaaatcaattaaatgccctcaagagtgttcgtaagtcaccaactacataattaaagcaaccataagctacatatatggaatactcctatgctttttaaatctgtgaaaccattatttctaaccattagatctatcttatatataaaaaaacaagcgtgtattcatggtacatcacattttaaaaatattactgtgtaattatatttcgtcgttatcgtattcatgttaggttgcgtggagcctctcactcactctatatgaaatgaatgttcaatggatcatctctcaaactacatcaatcattttagtctatataaacctgtcccacccaattcatcctttagtacactatgataatatatatgcaactaaaaaaagaaaaccaacttacttttactgacatgttttctaaagaaaataagtctaccttctttccaaatgatgaagaagattataaataattgcttatagatattacttaaatatgatttaacataaagctaataggttataaacttataaaagcaattaatgccatgaaaacaatttatagagaaatcatgagaggtgttctccggttaatatttcacttttataagtatcttaaacttagcgtacgacacatgcccgcgcgaatgcgcgggctaccttcctagttcaaatttaaaacacataagttttctacagtgatgtgcaattgccatggttttattgtagaactccatataatcgtgtgcacagaacactgataaccatttcattctcctcaaatatgaccagataattgttcagaagctttatttaaccctttcattccactcaattaggaacaaaccaatcaaaaaatttacatcaaactgcttatataagtacttgtaacctacaacgttattaccaaatttttttctactacaacttatcaaatcagatgctactctacattgtaccctatgagaatgtgttctatcttgatgcggttcctttcaaggctcctctcgtgtcgtcttccgccatgggcggcacgggaggcaacgacccggccatcccttcaccctcacctccctcctccgcctcgccaccgcccgagtggccaccagcaaagccgcgcggtaacaaggacggcggctacggggcccctctctccttgcgctccggtgaactggggagtcatccagggaggcggcggcgataaccgccagatcctcgccgctccggccggatctggcggggacagggacgacgtcgacggcggtggggatggcgatggcggtggggatggtgatggcggcggggatggcgatggcggtggcggagtttgcggatccggcgacggtgcggcgtccgacagtggaaggatcatgcggcgtcggtggcctgtccatcgcccgatgctgccgcttgtggcgtctgctggcgatggtgatgcaaggaggacagccggattctgctcctctaggtccagatctggcgcgtcctcagtcggaggtcaggtggtgtggagtccggtcgtcgtgcaggtggtgtgaatagtgccgatacctttcggtgtgcagttggcatttgggagcttccgctatggatgctttggttaacagggtctccgaggtgaaaaccttgctccgcttctggtgctagcaacggtgactccctcgagtgccgttctccttctttaaggcgttgcttttggagccctcgtttcaactccacttcaagggaattctccgggtgaaaactttagattcgttaggatcggaagttgccgtcgttctgtcggcgttaccttcttgaaggctttgttttaggagtttcttctctttgttggactactgttctttggttcagtttgtcaatgccgggttttcaccggttttcatgaaattaaccgtgttgttgtaagatttttgggtccagttttccttataaactggatcgactatcttcttctatagtgaaattgcaggagctccctgcatgtcccctcgaaaaaaaagaatgtgtttgaccatgaaaaatctacggaaccctaacttcagacgacccatctacagatatgcaccctgctcaatagagattgcttgcgtccgatctatcgagccccatcaagaacataggcaatggaagcatgcttggctccggcgaaacgaaggacggtccagcgaactctggcgagcgaaacgaagcatgctcatatagtccttttgctcccgccagggcccaagtcttggccttctccttgatcttggtcaccacgtttgccgctaagagttctttgtgcctaaagactctctggttttgttccttcaagacttcccaggccgttaggaggatcagggtacgtaatccttttttcggcacccccttggtggtctctagccctatccaccattcgtgtaccgttgtagctgggccccaactttccggtatgatatgttcacgggaggtccaagccaacaacgttctccaaattctcgtcgtgtaccttcattccatgagaaggtagaagatcgtctctggggtatgcctacaaagcaggcaataggtgttgttcggccatccgtgagttgccagtcagtcagatgtccaattctattttgcaccaccagccaggcaaaaattttacactttttaggtgcccaaggcttccaaatgatcactctatagtttgtactggttgaagttttgtacgccaatgccgccgtgtatttcccgtggtttgtgaggttccaagtgacgtgatctatctcgccgtcggtgagctgcattccttgaattgcattccatacaactgacataatgccactagctgagaggttgaggtcttgtaatggcaaatagttgctttgaagtccatgtgtgtaaatagagccattttttttttgaaaattttgcacagccatagttgacatgaaaaaaacggaaggacgttcaccccagtgcttaaaagagttccccccccccattttattgttgtacagtagaattgtgaatcggagtcagtgcttcattcaacataccattttacatttctttctcaagtatagcatctcaattgata

SEQ ID NO: 48148 - DNA, 701 bp, Oryza sativa
cttgtttgtcgtcagcctcatggtcatggcggcgttgcggtcccctcgccgtggagcgcgtccgcctgcagccgcttcttctggatgtcccagcgctcgtcggaggacgcgcggctcgacgacgtacgaccgcacggcgtcgggagcagcgcagggagagcggcggcggccacgaactgcgccgagcgcgccatctctcgcggcgaagcgcgggagccgtgaacgaacgaacgacacagagcccgagcttgcggagaagaaggtgcagttcgttgtgggctcggaatacgacggcccactcggcccagtacgggcccatacaggcccatctaggacgaggagtaaatccacatctcggcggagatccaacggccaggatgggagcaaatatccactacactgtttaattggagcccacccgtttcggctatctcctccactatccccccctcgccatggcagccgcttccttggctccgcccaccgcctccttctcgccggcgccggcgccggggagggttaaggcggcggcgcctttgctctcaggaggcctcccgggcggttccttctcagggtggctagcgaatcctcctcggttcgtagaccactccaagctcccgattgttttacaaccgctgtttccagtggttcttgtcttgtttctggtttccactctgctgcgtggatttggttcctgtgcc

SEQ ID NO: 48149 - DNA, 1769 bp, Oryza sativa
aggcgtcggcgcggtggctgcgcgtcgaaggggattagatggtggttctgctgaactggcatgcactttttaacgcgggagagtagaacaacgggcgaaagcctagccttcgggccggcaacggcgacgcctgcgggcgccgttttccccttggggtgttgccgtgttttctattttcccagtgggttcttcaggtgaaaaccttgtcctggttacctaggacgaacggcggcggcgcttttggcgtcgttttccttcttggagacgtcgtttagaagtcatattcctttgagagtgttgtgtgcttgttttgttttaaacaataggatcagacgtataagcgtggtgtggttgtttattttctttttcctgactatagtctcccaggactataggcttgtattttattccttctttatcaatagaaacatcatactatcttatgcgggttgtttcaaaaaaaatggccgggaaaacaaaataaggctttgcagacaatttttttctaaaccacaagatagtgttcattgaagaaaacaaatgtgggctaagaaaatgcctgagaaataaaaataggctaatatatgggttgttaaataggaatgtccaaactgaagtccaacaaacacgcatccgcacatggggttgtaggatcgtgtgatcgcgcgggacgttggaggacggtcgatcggcagtagacttattacccctctattgcccggatttatggactgtacatacttgcatacagtggcagtttcggaagcatctgctgtgtactcgtcgtgccacagaaccggtcgtcggcgtctttcttcctatacaggccaatggcagtgacagtggcccccacacgcagtgcgccagtgcctatatataaggcacacaggctcctggcacgccgcggcatgcaccgcaaagcgacacacgcgacacgccgcctccacctgtatccctcaatcaccgattcgtcgatctcccctcctcctcctcctctcctctccccgcgcggtggcggtggcctcccccagcgtgagagacagatcagagtgctcagctccccactaggtaggtgcgggtgtgttgccgcgtgcgccggccggcatggacacgtacgaggaggtgcggagcatcgggtcaggcaacttcggggtgacacggctgatgtgcaaccgcgacaccggggagctcgtcgccgtcaagaccatcccacgcggcaatcaccgggtccgagtccttctaccctcttcactagcgtaatagggttttggggttgtaggctggggtttggtgggtcttgctcgtgtggatccggtggccaacatttggttgttctgatggggctttggattggtttttgcgcagattaacaagagcgcgtaccgggagatcatcaaccaccgttcgctgcggcacccaaacatcatccagttcatagaggtgtgtatctattgttgtcttgttgatgaggagcaaacatttttggtttagaaaaaataggagcagatagtcagggattgttcactcattgttttgtccgtctgggttaattgtctgctatgccatgatttactagtttcttgagcatgaatattgaatgggtaaggattcgattttgtattttttttcctccctagtttgatgggttttggtgatgtgttttctatttgaaggtgacaattgtggaatgtaccatgtttcttcttcattctaatcactttatggtttaatctcggttttatgggtgcatttagtttgatctccttttg

SEQ ID NO: 48150 - DNA, 85882 bp, Oryza sativa
  unsure (1)..(85882): unsure at all n locations
acacctactcctagctgactggcattgacaaatttgatttgtcccatctctcaagtctcaaccgagctaatgctgaagtagtgttctgttgtaggaatgaaacacaactgagcttgaccattttaagggctcctttaaaatgcaacaattttataggaattagcccaattcccataaaatttgtttccaaatcccatatcttcaaaggatgcctgaagatgtacatcactgaccagccattttctttctagcacagcacgaaacaacacaaatgtccaaagctagcaaatattcagatgcacaggaattgaacgcatacaagtacacggcacatcaaattatttattatggaggaatgccacagggtatccatcagaattttttttccgccgggccagcagcaaagaaatgccccgaccgaatttatccatcagaattttctcatttatatttcaggaagatgtcaatgcatcacagccgatggtccaaacgttccatcctagttagctaactgtatatattgacctatccgatattcccaacccatgactggagcaagcaagcagttcaactcagctaagcacgaagagggaggagctctcaagccagtatgctacctccctcttcgtgattcggggaatcagttccactatagaaggaggcctcacttgaggcgtccgaaccgccaccattagcctccttgtcagcggatacatgtgaatggtcctgaggcagggtgatgccgtttgatttgaatgaagaacccatcttaatgtcatcggctctcatacgctcagcatagctattgtattcgaaggtagctggattccttcctccgaatgctgagtcgagcttgtccaagtcaaagacgtcagccattatcttctggctctctttatcgctggagtacacaaatttcaccttcttgtaggtctcatggtccaaaaatggcttcactatctgccaacagtaactaatgttaggctaccttatctcatgacaacagagtaacacactaaaaatagattaattttactgtccttgagaatatgcacactttgtaatgttaatttgtggttcagtacctcaacattagggaggtaccaaaacaatacactagcaagtgtggttgaacggtaaaaatcctatatggtaaaaagacggaagaaagaataagtgaataactgtactctcaagatattttaaggttgttctcaccttccagaaggactcaaatatcctaggaggattgtaaaggattgctaacccaagcctctcagggtaacagtcttgcaagacgttcacagtctctcgggtcactttcagcggtgtgctccccaatgtccaactctggaagtctgtcagccagaccatcttctcttgatcttccgtcaggctcataattgctttctccagacagtaaacaagatatttgatctgtccctttcctgaagtagtgttctgttgtgtttcaaagttaaacatgtaaaatcagcacatagcatgcaatcaaaccagaaactgttgtggcatagctgtcacaaaatattggttcataacaaatgatctaacaatgcacacatgcacacacccaattgatttgagaaacaataagaaaatccggaataataaaattataaccaaagagtgagattctccttttggtttttccaaatgctgattgacttcaagctaaaattgtaaagatgtatgtatccctccgttatccacatggtcgatttgattcatagcaggaaggataacatgatagcattgcacacattgtatggagaagtaattatgtcccttttatctggaaggtataatcccaatctgatttcagagcatactagatggttggcagatgtacaactaatgcagatgagtagatacatacaaagtaaacagaaagcacgagctatatcaaaacaagactgttatgatgttaatgtattcctttcttcctgccgaaagtgcactaacctctaagcctggcctcaggacaagaacagttcttccatgtttgtccttgtagtcagccctatatatctttcctgtctctgcttcatgtgcaacatcatcctgaaggttgaaaggacaataagattacattatgttgtaaacctgaaaatgcagttacttcctaagtatcaagaatgttctgctttagcatcacaatgctttctccccaatgattcatagaatgctatcctcctattagcacaatcctgtctaaattgacactaacagcagttattcctcctgtctactccctctttccacaaaatataagaattccaagcgtaatttgtccataaatataaggattcctatagtgccacttgaccacctctcattgaaattacttcccaccttactcccaactactcttccaccccccccccccaaccatcccccatttagtgaggggcaccaaagtcttttagtcttaaccttaatcccttctaaacaacctagaaattacctatggctctcagcatcaccaatgtttcagttataatgctatttctattacagcccataaagaaatgcatattcaattgatgattaacacaagcatacccagttaatcttttgtggcatatatgacacccgccactttacagctgacttcatcattttacttgctttctgcacgttccagtttcttgctcgaagaaatctcaggcacgaggcatctgaaaggaaatcttgtatttcttctgatgagtgttcaccaagctccttacgcaagtcatttatctgttcatcagtagatagcacaacaacaaagtaaatggttcaaagcgagagtaactaaattaaattacgaagagatatacaatcaagggatttttttcaataccttctcctgctgctcttctagggtcaagtttttctctgttgtagcaccattgcttgacttgaatagaaaggacattttagtacctcgacagagaagggtccactagatacggaactgaaaagcaataaatatcatcagacatctgaagagtactaaatatgcacgaactactttctgttcagcttccttgtatgaaggcaaccatctgaactaaacaacagaataacagcttatgaggcaggtgcgagaaaaaaacttgccgttaacaaaaattcagtttcatacaaaagataacagaaagtaacaacaaatgctactttaaactgatatcagtacatggttagctagctgctaccgcatgtaattcatacgtggctggaagagcagtatcctaaatgagaagcatttcacagaattcagaaggccgtgcttctgaaaaaccagccgattcagttccacagaagacaaaattgcgacccgaaactgatttcttaagttaaattgaccatccaagatgtcactaagttaaagtagcatcaccatataccgtatgagccagatccggcaacgctaagtttcttgcagattttacaagacaagtagccgagtcaagatcacgtcaacgcaaacaatcccggtggcaattgctactactacatcttcaatcctagtagcacgacacaacacagaacgaacacccgcaattcgagcacgaacagtcacagatcgccgccgtatacctaatgctcctcacatcaaagattaggtagtagagaaatccgatctttggccgagtagaagaaaaccaacctggatcgatgcacccccagcccccaacaaccggggaggctcgcggatcagggcccgccgcctgggcacgacggcgagggctggggtggggaggtggcgccggccgaggtgggagagtggtggtggtgggggtgggggtgacgtgaggagggcgagagtggagacgacggtggaactggagggtgagggtgggtggggttttcctatgaaggatggtggtgcggtgcggtgcggtgcggctgccgtggcgtggtggtggtgggcggtggtgcgggtgcgggcgtgggagacgggacgcgcgccgggtgccaaaggcaaaggccccccgcgtgtatgaccggccaaagatgccgggtcaagcgcggggtcggggtgggggtggttaagtatgatgcgcgatcacgggagcgcggagtgtggactggaatggagtgcaccacccaacgagatattaccactcttaggacaagtactatgagcataaagcatagtctcataggtgtcacataagctaaaatagtgaggtggaggagagaagagatgaaagagatatgcagccacctctcagagcatccgcaatggttatctataggctctctacaagatatccaagtcagcatattttcctatttgaaagagattaaatgaagagagagagtaaaactatctactaacctggagatagtctatagaaaaaaacgatgcaatagattagagagatatagatacccatatagacatactattaaggtgatttactattaatctagtctattgctgagatgtacatgttttatagaaagcaccttactttactattgcggtggatctcatgcaagatgcaaccaccacacaaaattcaagacaaaaggagagagaggaagagtagattaggcaaacaaacattggggctagtgtattagaattagtatagatgtgatatattgtacatattacctctacatttattagttgatgatgtggtcaagattagatgcaacatccacctcttttataaaacttgcctttatgctccgttcggtagtacaagttcccagctcctcctcctcgttttccgcgcgcacgcttttttcaaattgctaaacggtgcgtttttttgcaaaaagtttctatacgaaagttgcttaaaaaatcatattaatccatttttttaaaaaaatagctaaaacttaattaattacgcattaaaacgctgtttcgttttgtgtgccggggagtgggctcaggcacagtagactataagctaactttaaacatatatcgataatataaaagaggagggagaagagtaggctacaaatttattcagctgaagcacgaactcgaatacaagtatttgtatgacaggtggaaccatataagtatatgtttatagataactattgtatgaattgactattaagttggttataagtgatttggagctagtagttggctatactattaaacttgctcttacatgggtaattattaaagatttatcactgaactacgagtaataaatctttaattgttatatttaaaagtggcaaataaaagagtgctcgcacaagatttttttttctaaaactagttttacatgcaatacgttatacgtgatcgtgagatttttttttctttcacttttcttgagagtttttttaagataggtttttaaggaaggaaggagaacaactaagctggtggttttttaagttccttttcttaaaaaatataaagaaatatagcggttttttaagaaacactacgcttttaaactacttcagttgcctttgtttttataattttgtagaaatacattatgttttaaaaatatacccgtgtcaccgaccaacgggagattaaaacatcgattttgctatatatatatgtcgacaaatttttccctaaaaatttgacagatgtaattacagtacaatcgtagtgtaattacactgtaacttgcatgtaattacactgtaactatagtgtaacttgtatgtaactttcaaaaatctctctgtaacatgttatttcggtaaaatggaggtcgtgggaacaaattctttcacatacgtgtgtgctatgatttgttttcttcctcaccaaaacaaatcttgtaatagatctaacgattcaaaattatgtgaaacttacatataagttacactgtagttacatgcaagttacagtgtaattacatataaattacagtgtaattacactacaattgtactataattacatctgtcaaatttttggagaaaaatttatcgacaaatggataggtagtcccttaaaacattgttacctcttgatcgagcgacactgggccatgtcgtttctcaattgaaaaacagcataactgacactagctaagacggcaagacgcaacaggcaagtgagcggaggagcacctagcacaagcatatgccagcaggcggtggtgcggcgcgtgcgagcaaagtcacattgaggacacagtctcacccagtaatccgatgtatgatatgctctgttcaggagacgcaaaacgaagtctctattattgcatgattaattgagtatttgctttttttaaaaaaaaatagattaatatgatttttttaaagcaactttcgtatagaaattttttacaaaaaaacacaccgtttagtagtttgaaaagcgtgcgtgtggaaaacgaggaaagggggttggaaactactactaccgaacgcaggaacacgaggatcgactcctctcaatcagcaataaatgtagggcttgttttgcgtcggtaggacatgaggatgtttgtttgttacaaaatttctgaagatatattcatacaaactagtgtaaaaggtttattttctccatttttaaatatttgcactgaggcactattgatacgtgctttgacaacttttttctttaaaaacataaatacttagaatataaaacatcttcttttgtcaaagtttgttgtgcgctgaacatcttagctagtgaaaagtaaattctaaaatgcttctgggatgagccacatcatccagtgaacaatggttattgcatcaagaaaaagacaaaataaaagagaagagagttgagccatcaattataaagggaaaaatggatgatgaatttctggaaccttccaacaatttggaaatgagagagagaaagagcaaagaaagaaatgtagcattggaaaagagtgggggagtcagctagcttatggcatgtgataattttgcactatgcacactcagtagaaattatgttataaataaaatctcatcctttatttataaataataattcgaatttttttataaatggactatcggcttataggcttatattttatctatagataatccttacaacctactaattccaaattactgctgtaacttgaatgtcacaatatcacataacatactaataaaatttgctatgattttaatgttatactttggttcacttctttagcataaaagctaataggttgggcttaagaatgagtgtttcacctacagatacgctttcaggttatagctgatcaactacacttctctcaacacatacttaacataatgaaacgatgtttattgttgccaatttaaattacatgctcatgtacacatataacatgatggttaaagtcgcgcgaacaagcgacattatatgctagtaaagttgatggatgatttggtttgaagccaaaacttgcataccaaaatattggcattttaaacggtcattttggtaatgtttggtttgttaccaatccttgccaataccacataaatattgtcaaaatattggcattggcaaaaacttacctataatttggcatcgccaatagtttggcatagttacaaaccaaacaagacctgaaacttttgttcattgtagcctacccatcttaaaattactattaggaaaaattgaaatatatagtaaaaatttgaaattaccaagtaaacgctaccggagggagtatgtttcttttttttaaaaaaaaaaagaaaaaaaggaaatctccgccagaacgccacccggcatcgtctggactctggatcctcctggatccatgctagaggcctagagccatagattactgatttattgtacatactttcaacatggcagatgttcttctcgaatggctctcggcgttttgttaacacaaaggggcgtaatgtgtcatgtcgagttgtcaacgaagatggtagagggattccatcaggctgagcgcagatcggaatctatctatgagtataaatgataatgatgtggatacagttaattactaatgacgtggacacgctttaagatgctctagtctctttcacaggtcaaatctcgtgttcaatagtactataggagtagcagccaaggagcagtttagttagtattatgtactcctccgtcttaaaaaaaattcaacctaggactttgatgcgacataatatagtacaacgaatttgaagaaacctaactcctcttttttttcatcctccttttttttctcttccaaatttctctctccataaatattttcattttgaaattatcattgtttaagatgtgtagcggcaagtttgttctcatgcaaatgcttttcatctacagtaaaaaaaactttcactaattgaataatcaaaatttcaatttttggtcaatgaggtatagcaaaatacatatgcgacgaattatggaatagccactcgatcgattttgtgaggctattaaaaagtgtacgtaaaggattctccgtgtgatgacgcatgaagcaagtgtaattgggctcaatgctatatatgatttctgactttgttttgccattattttatttatcttgtttcagtttgtcatttaaattggcagagtttctacccatcgtaaaaattatcttcaaacccaacgccatttttgctagttataaacttataaataaagaaagcgctggcctgcacctgtctggcccaatcggctgggcttgcacccactcttgggccttgggccagtgggccgtaagggaaagagagaggaagacacgagcttttctcctcctcttcctctcccttcgcccgcggcgacaaccctgaaccctcctctctctcctccaccacctcccctgcgaccagcggcgcgcggcagcggcaggcggccaccgggatggcgtcgtcgtcggggacgagggaggtgctcatgctggaggccccgccggcgccctccggggcgccgtggcgcgcgccgccggacgcggaggccgtggacgcgctgccctacatcgacggcgactacggcgacccggcggtgaagcgggaggtggaccggatggtggaggaggagatgcggcgcgggagccgcaagcccgccgacttcctccgcgacctcccccccgtccccgccatcgggttcgaggtagattcgcgatctctcatctcctctcctctccttgtgggttcttggagcagctctagttcagcgtcggggtcgttgcgttcaactatcttttcaggcgaaaaaaaatagaactgtatcttttctttcgaatgtgattcgcgttagggttatagctacttgtaagaatgaaacgggttagaggctggggggtgtatagggttagtagttgtgtactcgaaagtgagagcacattgctaaatactgtacattatcctcctttagaactgtgcttataactatgttttggtggcggaattttggattatagttgagctaattaactgagtatatgtggcttgcttggatttgtatagaacttttttttttgtaaagcttaatgttttgctctgctataatgtctgtatgttaacgttgatcctgaaaagaacaagagagtatttttttctgttgccacatgcttcaattgattagctcgtatggaggacagatgcctgatggtccgtgccttcaaattttctgaaataataataattgatagttttgactagatccaccctgctgcaaacagaaaagcaacatattttggctgcaaatatttaacttttttacttagcaacatttcttgaccaccaaatgaacctattgatttgatcggttacttgaaattaagtatacaatttgaggcaccaagaactgaaatataagctcttttccatgttctgtgtgcattgagctaaaccgacaggcaatttgaacctgtggcagtcaataatatgacctaaggtatcaaaagtgcacacggcagtcaatgaagaatagttattataagaaaaaagaactaaattgaatgggcattcacgctttgatgatttcatctaaataattcttatgagatgtaccagtctaggtgtttgcatcatattaactctgctccataatagttgtcttagagctcagagagcaaggaaagggttaataccttttttttcacaaagtttgcccttttggatgatataatctgtgcttatctgtgcaattgagtcatatttgaagatacatacagccatttaattcgttgtaggcttgtattgcttattgaaattatacaaaatatttgaatcacaatttgggtttcatttttttagaacttatgcctcatcatgtgaatatgtttacaaccttatgagtttttattatttgatactcattttgcacatctgttctagaatcatcctatgcttgctaaagagtacgagcgtgttagagctgggaaacctcctgctaccatagagatgtcccgctatggtttggagccacccccagcgaacaagaggaatgatgttgctgcatggaggcaggctctaagaaatgctcagagccagctgcaccatcaaatcataaggtaagagtagagagccacagggtactgaactaatgaaatttaccatcaaaggtgcagtatcgttgaacgttgtgcatttgattgtgataggatcacagggaccagtgtcttcctgtggcatgtccttttgataatttttcattaccataatagcttttaagctttccctggtgtggaaaacatagacttcgagaatagtatcagagtagataggatgggctgcttgacaaaggtttctgcagtctgtttaaaataacaagcagtattattttgataaaagagcatgttttttggatacactgacaatttgtaaattggaggattgtataatgctcatagcagaagacttttccttgtactttactaaatgtatcttgggtaaattaagatatttgatcatgtattgcctaatatcagcttcaacagtttacttgacaatgggagctcctaggttagttatgattgaacatgtaaagcttcgatcatgttacttcagaattcgactgctgtacgcactgtgtaggatatactgcttttttctgaccatggtttcttatcatctatggagtcagcatacttctatgctattattagttttgaaataaagttaatattgcaggatagagaatctggagcttatgctgaagtatggtgttgaggtttggaagcttcagaatagacaaatggaatcagttttgtctaggtaggctattgtgacataagtttattatctttgaatttggagctacgtatcctgtgttattcatgagattcatttagagccatttcagtactcctgtttgtagactctggtctcatatgttgatagtgtagcttagctgtttaaacttccagtaaagcacttattttgatatttgaagcacttatttcgacattcttgtaagtctcaatgctacttatcactgtaacaatatggatggtagattatttttatgcctgattgcatggtatctaagatgtcgaatatagcatttatcattctagcagcatatgatgggttgatctctttataggatgcaaaagatggctgtcgaatacaatgagaagatagaaactgtcaaccgcgagaggaaatttcaccaggtaattatattactcctgctcttgttcttaaccacggcatatttcacagccaagctgatcatttgtgttttgatcagcaaaacactggtggtcaactccatgccttgacgacggaatggcaggagctgtgtcagaaaaatatagctattcaagctgcatgtgttgatctgcagaatcagattgatcagcttaaacttggagctaaagaattgtactccccctctctccctactttcctccctctctctccacatccacatgactaacagattccttaacaggggaatgcccatcgatgacagcaccggaactaatcagcaagcatcatcagccatttgaggtactatttgttattttgttctcaaagaaagcagtattcttaggagtattgaagttaagtcaagagacaaaatctaccttcatcatgcttacaagtttttaccacagcacagatacataggtagcaatggaggtgagacaattccatgagatgggagctggaggtttccatcaaggcacatctttttgcatgatctgcagttgccaaatccaagataacaatctaggcgattaccttgacaacccgcacttgtgattgtattccgttatccatttttcgaggacttgtgtgcatatggagacctgatagagaaacagatcgtatgcatgctgtgtttctgttccaagtgatctaacctgtgtgagaggcagaaatctcatcactgaaatagaatgtaccttgacattgaagcgtcagttaaggtttttgttatttatgttgacatgtttgtgtactcttcctgctgttaccatacagttttactaaacatgagttgtactaaccatggaggttgatatggaaataattactacctccatcctaacatagaagtaccgacaggatctttgttcagatcactagtaataggagatggtccattccatccatccggttttaggtttttatattttgaaatggacgtagtattatacttagcatgtcatggattgaattattgaagtaagcccccaccttcctggtcggcgtagtcccttgaggccatctctaagtttgtaatgaaaaacaactatagttcacctagagcgtgaatactctattttgattttatgaaccacacctcaaaagaaaatcttagttttgaaagcactaaagcaactagaagttcattttccggcatttattttttttgtttaaaaaaatactccatgtaagaaacaaatcttcagctttaaaaccaaacattattcaactactataaaagctatcaaatttaaccttcaacatggtttcttctcatgttgaagaaatgtttttgagttattttaaaacacagatagatcatatgatccaattaaccctattctgtgaaagggcatctagcctaatggttacaagagtctcagtagcacctgagtaggggtggaactgagctggaaacaagataaaacttgagctcggctcggctcatttcctggctgcaagccttcttattgaaacacctcttcatatatattttataattattagaaaaagtaaaaacaaatcatcaacatataaaatttaaataagtttgtttattcaattcttcaaaatcttaatgataaatttcaagttgacaaataataacgccatataaagtaaaataatcgatataaacacacgatggcctaggctcacgagccaaaacaagcggctcgcgagctagctcggctcggctcattttcagcaacgagctgaaaaggaggcttgggcttggcttgtttggcttacgagccgagtcaagccaaccaagctcgagccaagcctaagctgagctcacgagcctaagcttttttttccacctctacacctaaggtcctgagttcgacaccccatgggaacgaattttctaggatttagcggcgctgtactttcagtggtaggcgacgtacccgtcgacagcgaggtgctgacttcatcaatctctccaggatttgccggcctagtcttcgaagatgctcataggggtagggtttgcgtgcgtgtgttcatagggtgagtgcgcgtgcgttgagagtttctgcgttgtactgtgtaattcaaaaaaaaaaaaaccctattctagctacaaagaaataagcatcgaaacacaaaggttcatttgaaaatctctgaaatttcatcaaacacccctgtccaaaattcataaaaaaaatttgagctgtggcgccatctcccatcccacccagcttttgctgtaccaccatgccgcgaccggagctacactccaatctcccactcgatccccacaaaaacaatttgggtaaattcgacaacgccgctacactccaatcttccactcgcatctcatctcgcatcaaccatggccgccgccgtcgccgccgccgcctgccactccccggcgcgcctcgtggtcacctgctcgagctccgccacgcccgcgccgccgcggcgcccgctgcgggtggccgtggtgggcggcggccccgcgggcgcgtcggcggccgaggcgctggcgtcggcgggcgcgcaggcgttcctcctcgagcgcaacccgtcgggcgccaagccctgcggcggcgccatcccgctctgcatgctcgacgagttcgccatcccgcgtgacctcgtcgaccgccgcgtcacccgcatgcgcgtcctctcgccgtccaacctcgccgccgacttctcccgcgcgctgcccccgggcgcccacatccccatgctccgccgcgaggtgctcgactccttcctccgccgccgcgccgccgacgccggcgccaccctcgtcccgggcctcgtcacctcgctctccctccccgccgaccccgccaccgacccttacctcgtccactacatctcctccgactccggtggcccctcctcctcccggtgcgtcctcgaggtcgacgccgtcatcggcgcggacggcgccaacagccgtgtcgcccgcgaggtcggcgcgggggactactcgacggccatcgcgttccaggagcgcatccgcctccccgacgaggccatggcctactacgacgacctcgccgagatgtacgtcggcggcgacgtctccccggacttctacggctgggtcttccccaagtgcgaccacgtcgccgtcgggacgggcacggtggccgccaagccggagatcaagaggctccagtcgggcatccgcgcgcgcgcggcgggcaaggtcgccggcggccgcgtggtcagggtggaggcgcacccgatcccggagcacccgcgcccccgccgcgtggtggggcgcgtggcgctcgtcggcgacgcggcgggctacgtcacccggtgctccggcgagggcatctacttcgcggccaggtcggggcgcctctgcggccgcgccatggccgacgagtggcggctcaccggcgcggtgacggaggccgggatacgggcgggatacctccggcggtgggacgacgagttccgccccacgttccggttcctggacctgctgcagcgggtgttctacggcgggaacgccgggagggaggcgctggtggagatgtgcgccgacgagcacgtgcagcgccggacgttcgacagctacctgcacaagcggatggcgcccgccgagccgtggggggacctccgcctgctgtggcgcacggcggcggccatggtgcgctgcggcgtgctcggcagggaggtcgagcgcctccgccgtctcgagcagcaggccgccgaccaggtgctcctccgccattgaagatgtgtgtactgctctgctctctctctttctcatgttttgtagtagcaactctgcatttgcaaattgcaatagtatcttacataaagatgctgctgctagtaataagcatggtaatttttgggatgctttaacttctaagcaataatatgacatttttattcagtttagtggaaatcccagttgtcatgaattcgtgatgattgttatgtgtaccagtactcaacacatagggaatttagtgggcattagcaacgattaattgaggaaaagaactgcattactcgggtatatcgtatatgaatatatgatatagttcaagctgacaattagtctcttaataataccggaaggggttgtagagagtagctaggtaacataacaaaccagatctgaaaagcctaacgaagaaatacaatatattcaacgaacactccagtgaaataataatccaaatctcagtatcaaaatgaccatctcctccgttctccagaaaatgcaactgctatgtaatgtggtattctggtcatccaatcaggcctgcagtcaattgaaagatgagagcgtgacagatactgtaaaaagaacaaaaccaccaatcaaattttatcaatataacaaaactttggaaaaagagttggcatagctgtgttcgggaggaggggttggtcaccggcacgcaaaacaaagctcgtattgttgcatgattaatcaagtattaacttttttttttgaaaaatagattaatcatatagaaagtttttccataaatcacaccgtttagcagtttgaaaagcgtgcgcgcagaaaacgaaagaggtgggttgggaaaatggggggaagaacacagtaagcttcaaaccatgtaccaccatctttcaaacaccctcatggtacaattgcatgacagagtaatgtggtaatggcacataggaactaccttgtttgcaatgttgctcgagagccagtcaaggccctcatataaaccctctcctgttgtggcgcatgtactctggatatacctaaatgacagcaaaatccaacaggttatgatatgtaaaaatagcataatattttcaaggaaaaaaacgaaagttattgatccattgttaaggtgattctattcatcatgtaataatgagccacataattgtataggtgaacatcactaaaaagttttatagatctaggatggttcttggtgaaaatatgtaaatggcataagatacatacggagtaacacagttattcaccccctatgactatttagttgataaaaaagagttgaaccacaaagtggagtaaggtaaaccaaaaggctgattcattaaaatattaaaacataaagtttaaaattgaaagatagaaatcgacaaaccagaatacaagaccatcaaacttagaacaaaaataggaatggatgagatgagaagtagacagcctacaagtgacaacaaaagcaaccatatattaccagtggcgttggcgcagggaatggagaccaagcttatctgtgatctcagcagcattcattgcattaggaagatcttgcttgttagcaaaaaccagcaacaccgcatccctcaactcatcctgcaaatgccatatgactgaatgcttaaagcagtgattgaaaagaatttgtatatgtatgtaacatagtccaagtgtatctgaaagcaaaattcaggattctaattgcctaagaggatagattccttaaccatatggaactaatacctagcaacattttgcataggcatgtcttaacttttaagctctgaaaagcatatgctatgtgtgtaatagtgtgtattagcataccatggcatattttggacagcatatatttatttttaaaattctgggcaaacggtatagtaacaaaaaattatgaggatatgtcggaagtgtaggaacatgcccaatatctctattgatgagttaataagtattgcaagcttaggaaaaaaacttaaacctactaccacttatgaggttatctgaaaaaaaaagggtacttgtgtatgaatatgacgaactaacaataaaatatgtgacatcagaaaatgagtattttatgatggtatatccaatttactcattttactaaatgtcatggaatggtgccatactatgttgtcttgtgaggaaaaattggctgcacttaaactaaaatcagtatgcgttattctgacatttataaatcaagtcactgatgatgcatcctgctgcacaaactatttggaggtggttatatgcttaacaagaaataggatgaagttaacaaaaccaaaaggcatgttcagcatacatcttatatgacagaacaaagttatccatgtaacaggttaagccagaaacatgaacatgatccttaaacaaagtttacctcattaagcatcctgtggagttcatcccttgcctcaaccacacgatctctgtcgttgctatcaacaacaaagatgagaccttgagtgttctggaaatagtgcctccacaaaggtctgatctgtagtttagaaaacataatgttatgagaaaaaaagtttctaaaaccctagagctgtggccatatattagtatgaagttcatatattccctactgtctgatgtgtttaaaatagtccaatacagcacaatggaaaatctactgctgattgcagaaataccttctgaagcgaaaagtgattttggttacaaaaagcaagaacgaattggtttttaccttgtcttgacccccgacatcccagacagtgaagctaatgttcttgtattcaacagtctccacattaaaccctagacatcaaagaaaaacagtaacttgatttgctctctttacaagcattatttcaaaaatgaaaaactatctctcatctgtctaacagtaatattttgcacttgcacatagagccatacaagcgtgcaaccatgtttgttcatatttccaacattatcaggttgcaatatgaaaatggatacaaaataatgcaagtgagccactaaatacaattgtaaactaagacatccaccaagccaccaatggaaggaatccagccctttttcatacaagggaccttacttctatgtgatctgtttttctttttgactacactatagtttgaacccaacttaccgacaacaaagtaggagtatttgaatgtacttaacagacacatccagtcaaaacatataaaatatcaaataggtttttacctattgttggaatggtggtgacaatctctccaagcttgagcttgtagagaattgtggttttaccagctgcgtcgagaccgaccatgaggatcctcatctccttcttggagaagaggcggctgaaaagcttcgtgaaagtgaggcccatcttgccgcagttgtgcaagaccttaaacaatcaagaatcaatatgagatatgatacaaaagcacatgcagcaaagttcttaaatctcagctcagataatgtaagaccaaaaccaaaatgggctccatagttcagttagttaaatcacaattcattcaaacgaaccagatcttttgcaaacgagaaaagtatataaggatatcgacattaagaagtactcccgtcatgccgttgtcttttaacatgacgtttgacatcttactaaaaaaattatataaataccataattttgttgtaacttgttttatcataaaaaaactataatattaacttagtacttttacatatttatactaaatttttaaataagacgttatgcgaaaagtcaagagcgtgcgttatacataaaaacctgaggtattatttgaaacggcaccgtgatccctcaggcaatgcaaagaaaacagcatctacagactatgatttcacatcccacgagtaaacaaaattcacagaccagtctgctgtgcgaaggatctatgcaatgcaacgcaacgcaacacgatgccactggaattaaaatgaacaatatacaagtctaacacgtgaaaaggggtcggcaatggaaacggataggcgatcacctcagccaaagcaaacaacggatcgccgaccagaagctcatctacggactaacaattccgcaccccacgcacgaacgaattccgcggacttgtagaggcctcccaaggatctacgcaacggaacacaacacacagcaccacgccattttctcgaggaaaaaaaattctggatcgaaccgaacgagatctacacacgcgcgacgccattggaagtttacgcaccacacgctacgaactcactcggctacacagatctacgcctccactccacggatctgggcctgggcagcagcagcagcatcgccgattcgccgccagcgccagcgccaccgcatccctccccagcaatgccccgagggcgaggcggagatcggagaggagaggagagagggaaaggagttgggcgtaccaaccttgctggagatcgatctcgtgcgcgcgcgtggcctctctcatctcctccccacctcgtcgagccgaagaaaaaggagacgacgcctcgacgcgcggtggttgcagcggagggaggcttcgagccgccgcggtgggtggacgcggtctacgtgagccgggtgtggtggactggtggtggtggtggtctaggtagagtgcggtgcacgtgagacgggtgcaggagagagcggtgcttctcatttgaagcttcaacgtgcaaccgacgctttctctaagtttcattttttaaaccattttaaaattgagggagcttctaacttctcccagctgtcccaaatagtctagattttcatttagatttcaagaatttgtaattgtagaatccagaaaatgaactaaaattctcataagttgactaccaaccagttgtttcttagaatttttaacttttcaatcaggaccaaaaccaaaaagtctacaatgtcctcactttatcaaattctaatataattattcatctgcaattatttctcattttttatttccaatacaattattctttatgttcacaaactccgatgcaatgattattttaaaaataaacttattatggaacggagagagcatataagcatgtgtacatgtataaagtcgtataaaattcaaatgtttaaagtcagggtggaacccttggccatgataccaataggaaaattcgattgggctgtgtacccaaaacgttggggcagagctgcaaatttattgtgaagatgctgttgttccgctagtttgcagtcacaattcattcagacgacccagatcttttgctcgagtatacaagatgtacacatataaagtcgtgcagaattcaaatgtttaaggtcagggtacttgggatgtaaagtgttctctagcacaaaatatatttggcatgtgcgcgttggaaatacaaaatattcactctgctcataagataaaattaaatcaatcaatacctaaacacatgagaaaatagttcaattctccaacatcacttccccacaccttgaaaactaggaaaataaatacatacgatctcctaaatatcaaaaagaaaaatagatacattctcctctccctaaactgtagttcactcttttcatttcatctcctatatttctacaacatactattataaaatataaaggcgacgaagagacgaactgaagaacatgaatcaagtcttcggactgggattcacagcatcagaatcagcgaccaggccaatctgcatagggaagatgccatttcagtcaccagggtgctccacagcacctcatatatctgtctgtatggtataatcctgatctttttgaagaacttatgatatcaccaaatacttgcaatccaataaataagatcttgtagggttaatgctcctgctgacgctatctaaagccatattgccactaaagaaatgaatttactgtcttgtttgcttctaacgccgcctcaatatccggcaaagcaacagaatagatgtgctactattcaaaccctagaattggccccaagaaatgggaaaaccaaacaaaatgcagcatgcaaagaggtcaacttttccttagctcattttctcttgattttcttgcattagtttctccagttccttctgcccagtagatatcagtgtcttcacagtatcgaacgcagtcagtttaatactgcatggattgaggaatactgtgagcaatgagaagttacgtgccagtaaacatactattacctatcagtgttgccataaatttaaatatatagttgaccaccactgtgaaaagaaaaggcacctgctatttggtagattttttaatgcatttggaacaaaacctctgtatagtccaattagaccatcacgttccacaatgcctgcattcagcagagacaaatttaagaaatgcttcagtttagcccataaaggacaagaccaagctacaagtgagcatgtagaactggcatctgagagctgaagtgaacgttatgcagtaagtaaaagatgatgtttatccaacaccagaaggactatatataaatcagctacctggaatagcatccaaaaccgtgttgtagggtgatcctttcatttgcatctgccttctaacagtgtccagaggataacacatcaaagttgcaaatgttgctgaaagaagagcagttgccagagatgtctctggtctactcttatacttctctggtacagatttcttcattcttacatacagaaaagaatagagggtgaggtgaatatctacttttgagaccaacttttttatatgatgaggtagaaagaatctcacaagtcaaaaacacagaagttcacagcaatgtaaggggcgattcctataagagacggacccaggcctccatagaaggaggccaaaccttcgtctctcagcatgttcatagcaacctaaaagttaagtcatcaggttacattaatttccagaaacgaaactcaagcttataaactagttacctgagacatagtactatgtccagattgaactgctagcctcagccgaagaacatccagtgggtaagttacctatcagcaagtagccaagtatatatagaagtttcataatgatcagaacacaaacaaacaaatcaaactagatataaggacaattgctcaggagtaaataaataaattacaagtgtagatgtcatgcccgcacaagcaccagcagcaagtctcccaaacacagtaagctctccgtcctttctccggaaaaatttctgaatgcaaagcaggtacatggaaattgaaatgacaggaatccaaaataggtaattgactgatgataaagagttggcgttatcaccttgtaaacttcataagaaaacagttgcaccgcactgtaaggaactatgcggataaccttaagtagtttataaagaaactaagtgagaacaggaccaacagaataaaataaaccatgcatgagccacaatctgcatgatggggaatatcaagcacctgtggaagattgcctttccagtaacccttcaagccctcttccttccctatctctgcaatagcctgcataattgtagatgtatcagattagttatgtagtaccagatatacaactctaagtaaaatctatgaaaaagatagctatgcttctcctccttgtttgaaagtggaaagtgcaagttcatatatccaagagaaattagaaacaattatgttaagaagtcagaccgcacatagaaacaacatgttaaagcatatgcgaactggcagtactttgtgtctaactcatcaacacatgaagcaccagcatggcagcatctgatatcatattaaaaacatctaaacgaacaaacatcatgaagccataagtaaaacttaatggcatgccactgcctatttctgaaaaccattgttaccctcatttctgaaccatacaagaagcatcatgaattcaggacacagtgagtatgttacagtgtattataagtatattggaacaaattatggctttccctcagatagcaaccacgaattggtagtggtgaaacacatcagtttcatgactcacaggttcttttttaaagaaaaatgctccatgcctcacgaaagcctttttcatgatatgtttcccagaatagttttcaaatttctaaaacgtaattttgagattgtgtgttaatttttagtaaaccacgagtttcattgttccatatcagttcacatacaaccgcaagaccagaatactgcatatttgtagtggagagaagagtaccccattgttatgttcaacaccacacacacagacagaactcggttcgttctaacttatccctgatgtattcggaagctgcacttatgaattcagggaatttatcatgcaattgcaaatgacaggtactaaaatagacagggttgggatcaactccatggctagatggaaggcattttatagcaacaacagattgacattgttgtcatgaaaatcgcagacgatagtattaacattactaaaatagacagtgttgcatcagctccatggctacagaaaagccattctatagcaacaacagaattacacactcttaccaacttagaaatttatagcaaactgaagagaagaggtggaggacatcatcagagttacctcgaggaatccgatccctttcttggtgctctcccccaccacccgcacgctgtgcgtctacaaagaagaagagcaggaaatgcagtgggttacagaccacgcacccacaggccaccccacagcaaggagagggagagaaatcagaaacccccgggacgggaggggcggggtcatggtgtgccctacctgcatgaggagcttgacgcggtcgagcggcgcggtgatcgtcttggcgacggcccccgcggccgcccccgccgtgaagagcgcgacggcgttgggcaccagcgccagcatcgccagcgggtgccttaccagcacccccnccgccggccgcngcngctgcttccccttcncntcccccacctccccctcctcccctccccctcccccctcccgcacggtgagcgacgcgaacgccgggccacccccacccccacccacgcggagggcgagcgcgcggcgggcgtggggaggcggcggcgtgggtgggggcctccatgagtcgcacgccgccgcatccactcgccggtggctcatcgtcgtcggtgggcaggcggtggccggatctgcttggccgcgagaggcgaggcgaggcgaggcggaatggaagagagaattaatgcggaggaagaagaagaagcgaagaaggaagaggggataagggggggaggaggattgatttcctccccgttttatgtcgaagctcgagagagcggtgaggaggggggttggttgtttaaaccctcgcgcacgccggacacgcgggcaatgcactcctctctcttttttttctttctttttcgttttcttttcttgagaggattaatggtgtatgagtgtggcacaatgaaagggacgtgtttcggttcttgccacaatgtcagcaagtaaatgcggttttggttgcccgtctgttcggcatttgtgccgtacatggacatgggaaccgaatcgtggaagaagggacagctaattgggtccgttttttttttttttgacaaattgacccttttggaaaacttatttcgaaactaacccctgccaaaaacttcaacaaaaaataggccgtcgcctcagcgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagcctgctggatggcttgcgggctgggacctcagcgccagcccacctggcgctgaggtgggacttggccgcaacccccaaggcccagaccagcaagcctgctggatggcttgcgggctgggacctcagcgccagccataatggcgctgactattggaaactcagcgccagcccacctggcgctgaggtgggacttggccgtttcggccgtggcccagcccagcaagccttctggatggctgggctgggacctcagcgccaggtgagccctgctaaactttagcaaaactttgcacacaacagaggcaaacatcaaatcatagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatctggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtaccccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgaccaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatgaaaaaatcacaatgagaacggaaaggaggacaacagaaagtaaacattgatgcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgctaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgcccaattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaattttaaacccatgcataaacattaattacttgaaaataatatgtaattaccattgcaataccaatacttcaaaagctaacaacatgtctaatttttccaataaataagtacattactcaaatactacacattattgataaaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacagaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcgaattaagtttttgaaaagggtcaatttgtcaaaaaaacggtaattgggtggtaactagaaccaatacgtacttcatatgtacttaaataatacttttaaatattagaatctacgatactatttaacccatcctataaacaaaacctccatacaaatttataggatggtttaaatcttgtagtaggttgcaacattttgagacatggatagtatagtaatatagtagctggattagacctaacctattactaatcttatctagatcttgttatacccctctaaattgatttgaagtactaaattgtgtctaatctggtttttcggtactaaattgctatattttagaatgagattcattcaaattctaagtaaatacaatccaaaaaataaactaaaaaccagaacagattctcaaaaattaactaactaccaaccaaatgtttatcagaatttagctccctaataaagaagaccaaagagttgttgggtggatggttggattgagcgtggtgcatagctgcatatcaaaggctgacatcatttgcagcaaacgcataccacaataatactatgcatgtacgtgaagtgtttttttcgtgaggattattaaaagtttaagttttttttcctgaatgaacgaggtttattaaaagttgagttcaattatactagcacgcatgtagttagtctatattgagtaccactagagcaatgatccagctagccaagctaaaacgacatctagatcaccccaagtaaagcatataggtttagaaaccattcggatacacagcaaaacaaaaagaaaactcatgtcccagctattctttagaaagtccatgggataaattggagcaagtctatttgcttttcccttttgctcttggaaatttgcagatcaacggtaagattacatatagggcataaattagttgactttctttgccaccttttgatgtttgttattcacaactgagcactattaaatatgatatgtccacggtgtgttttgtttatttcttctcatttcaggttttctacaatactgctcagtactatttaggattctcgtgtcatattgattggccttcttctaattattttagcatttcaatacataaacagttgacaggtatgtataccgaattagaagtatttatctatgtcaaggttcttttagtaattgtatgatgtccataatgtttctttcaaaatataggatcatgtcctgtccccccaacacacacacaaagagataaaaatagaatgtggttattcttaggtacccctctgttccaaaaaaaagtctaatccttgctaatccttggacacatgtgtgtcagattcgtagctagagtttgcctttttatgggacaaagtagtaggaactacacttttttgttgttttgcaagtttgaaatttgacatttcattttacatttattattttcatgtagagggattgaactttatttttccaagtctttgaaatcacttcttacagaattaagcatttcatgttcatacattctttcgctctattagctcaaaagatattttgttgcgatggttcctacaaaatgttaagagttattgcacctgcttcaccttttgtaatatcacatatattgtttatatatgcgtgccaggcaaattatatgtgtcaaccgctatttatgtgatatatgctcctttttttcgttatatactattgattagggattcttatgtatgttttatatagcaggttgttaacgccaaaatttggtaagattttgtagtggattcggttaaggaaaaaacacaatcagccgatggaaagcttatccagaagagtccaagttcaaggagtcatgaataccatggcgtggcagattaatttctatctattaattaggtagagtttagttattttcccttatctttaggaagttttgtctagtgtccgattaggacttgtatctttccttgtctttaggaaacatggtgtcgcgtccgatatgaactactatctaaccatgggtgtttctttgtaaaatgtaatctatctcttgatcaatacaacttcagcgcatatcattggacatctacttcaacatattatcatcggtcgattggattgattgtctttatatcatatttatctaagcgttaaaatttagatcgggcatataacctattgtttaagaccatatcgacatcggctagtactgatacattggcttaatggttgatcggttctttgaacatcaatttatctatcttgtcaattacaggatcaaactgactggcacacccaaacctgatattttaggacttgcactggagctaagcaaatctcccatgacttcaagtgtcacgaagaaatttcacgtcaacacatgcccatatatagatggatgtttgttcctcctttttgttgcaagttttctgtgcattatattcttattagacactctccaggcccattcatgaatgatcctatgtacatgtaagcttctctattgcctttatgtgtacatgaagattatttcgtataagccttttcaagtcttacttcgatacctcagttatcttgtatagttaggtataattatgatcaataattatttaaaaagtctatgaatgatatcgtccattcaaatatatgatccaaatgactacaattattctaaaccacaatagaaataatgatgtcggtatatatatatatctctactacctaaaaaaatcaaaacgtttccttcgtccatcaaaacaaaaaaaaggaagaaaataactaaaaaaaagtctgactcccctgcgttcgtttgccagggctggccctccggtatggaaaacggagcgatccattagcgcgtgtttaattaagtgtttgctaatgtctttttcaaaaatggatcaatatgatttttaagcaattttcgtatataaactttttgtaaaaagaaaagaaccgtttagcattttaaaaaacgtgcgcccagaaaacgaggaagaggggttgggaacaagcgggaacgaacgcagcctaaatagatcagattcccccttaaaaagagggaaaatatgagaaaaaatagcgaacaaaacaacaacaaaaaaaatatgtttcctttaagtggccaaacaaaaccgtagatccaaacgggaaaaaaaaatacgattcctataaaaggcaaaaacaaaaaaaaagtggtgaaaaaaacgctagatccgattcctataaaggtgaaaaaaaaatccaaaacatctttaaaaaaaagttcgtccgattccctaagaaagtggcgaaaaaaactgtttgtaaaaaataaaaatgggttcgtataaaataaaaaatacacacgagaaaaaaaaagggcctaaaaaagtttgatttctattcgttttagtagtcagtatatatatcttctttatctctaatctaatctaactatttaaaaagagaagttttcatcgtacaactgaaaagaaaaaatgcacaataaaataaaaacagttcaaaaaatacgggagaaaaaagtcataaaaaagcgcaaaaacacgctaaaaaggttttccatcttccaaaagaaataaaaaaccgagcaagaaaaaaatatttccatcgtcggtaaaaaaataaaaaacatgcgaggaaaaaactgtcagaaaaaacgcgccatttcaaaacaatggtttgaaaaaaccgcgcaagaaaaaaacaccgtctattaaaaaacaagccgctctgaaaaaattatcagaaaaagcagtaaattgatgcacgcttgagtcggaaaggatccatcgattttttgccatctaatacacggcttttgtttcgtcatctattctcatgtattggaataaaggaaaaagaacattcgaaaaaaaagagcaaacgtgcgagaaaataattgtcagaaaaaagggcaaaataacacgcgagaaaagaaaagcaaaaaaacatgagagaaaaatacggttttcgtcatcagtaaaaaaaaagcaaaaaaaaaacatgctaggaaaaaactgtcacaaaactgcacaagaaaaaaacaccgtttataaaaaaacgagtagaaaaaacaatcgggttcaacacgagaaagaaccgatgtttctaaaaacggttcgagaactctaacgtaacgcgagaaaaaaaaagcatcatttctaaaaaaaggttagagtaaaccatccgaatcaacacgagacatacaaaattgttgtttatgataagaaccgctctggaaaaccatcggactcaacgggagataaaattgatggacgcttgggttggataggatccatcaatttttttctatctcctacacggtttttgtttcctcatctttctcatgtattagagaccctgcacgtctctgcacgtatctgtatgtagatatcaatatttgaataaagtggaggaggaacctatagaaataaacatcaatatttgaataaattgatcaaatatttaaaatattaggatgagataactaatttaccatttattttagttaattacaacactttgagttcacagatatcacttgaaagtaaatagataacaggatgacaaaaacgaataatccaaaataagaattaacagatatcacacctaaaaataaacttacacaaataaatataaaaaatgcattatcatttctagtgtaaggatatcaaacttaatatgaaatgcaatccccagcacaagacgtagatgtgtacatagtccatagtcctaacacaatcagatgtagagtacatataccatcctaatcctcaacacgagaaatacgtgtacatatagtactatgtatagttttaaaaaacctcctacttctcggcacgaggaaatcagggcatgagaaaatcgggatcgatccataacatgtctagtgacttgacaacgctagaactccaacaaacactgctagcacagatccaactaggaaccgtgtgcactcaaccacgcttatgcaaagatcatgctgtctagcaagcagggcagtgcttaaggctgcaattccccccacctcacatgcaacacatgagcacatgcattaacatagatataacttaatcaaattagggagcgtttgttgagggggaaatgagttgtaagacctcatttgcatggccagcattgagtcccatataaacaaagcattaattaactctatccatttccaaaatatagtcagttttataaataattttcatgaaactgttccaaagccaagtaccatcatccactgttgtttaaaaatgtatttgctagtactacatgatgaggaaagtagtaaaatgctagtagtgctttactacttcatttattgccaggcttatttttggtccattattgattggggagagatataaggaaaagatattaaaagaatttcattttattctcaatttttgctacacaaactagtaatagttgtaccttgaaactgagagtataatttattgtttattgtcatgctctatgcatattaatcaggagagtataaagggactatatggcacagctccagcttcacccctcctagagctagagctcagccaaatgtttcagctccacaaaaaataggagtggagctgggtggagctctctcacaaaatggtctagagttgtagagctgggtttaagagctggtgtgctaattcaaggagcaactcaggaactccaaagcacctcaaaccacatatccaccgagcaactccagcatctccaaaacaccgcaaaccatatatccaccaagacatacctacgcatgattctttgtagacgagcacagcgcgaccaactgctacgagtagcgcctcttctatcctgccctctccgcaccgtcgttgcaacgatgtaatggagcgaagcccacaaggaggcaatgggggcacatgcccccttacgctcatagaacaaagcgtaccttatagtaataatagttgatctccatggttgtgggttgctcatcatcaccaatggagcttaaactaaagtggagggagaacctatagaaataaacatcaatatttgaataaattgatcaaacatttaaaatattaggatgagataaccaatttaacatttattttggttaattaaaacactttgagttaacagatatcacttgaaagaaaatagataacaggatgacaaaaacgaatcgtctaaaataagaattgatagatatcacacctgaaaatcaacttacacaaataaatataaagaatacattatcatttgcagtgtaaggatatcaaacttactatgaaatgcaatcctcagcatgagacgtagatgtgtacatagtcgtaatacaatcctcggcacaaggagattatttgagccagtgaacatatcatgttgatcatgaccatcgtgataagtagggtagtggatatgtgtctcacgccacaaaagaattggtgtgctaattggagaagcaactccaggaactccaaagcacctcaaaccacatatccaccgagacatctctgtaagacaaatccagcaacccgaaagcaccgcaaaccatatatccacaaagacaaatctccataaggtcggtaagcatatccatcaagacatgcatacgcacgattctttgtagatgagcacaacgcgaccaaccgcgactattagcacctcttttatcttgccctctccgcaccgtcgttgcaacgatgcaacggagcggagcacagatgggggcacatgcccccttacgctcatagaacaaagtgtaccttatagtaataatagttgatctccatggttgtgggttgttcatcatcaccaattgagtttaagctaaaatggagggagaacctatagaaataaacatcaatatttgaataaattgatcacacctgaaaataaacttacacaaataaatataaaaaatgcattatcatttgcagtgtaagatatcaaacttagtatgaaatgcaatcctcagcacgagacatagatgtatatatagtcctaacacaatcagatgtagacatgtgtacaatcagatgcacataacagtacgagacatgtgtacatataccatcctaatcctcaacacgagaactatgtgtgtacatatagtactatgtatagttttatagatcctcctacttctcggcacgaggaaatcaggatccgagggtccataatatgtagtttcttgacaacactaagaactccaacaaacaccgctagcatagatctaacatgatataaaaggcatcaagtggaaatcctctatgttcaaatttgaaatcaactagttattgagaggatttacagcatgtagttgaataaatttggaattcttgtaatgaaaagaggtctatattgataaatgcgatggagaatgcaaatgatgagaaaagggctaaacagatggaacatgaactgggatagtgaatacaaatgggaaaaacataggtggcaaattattcatatcaagtttcgatagagatgagccaagagaagtttggagtggagggaatgaagtttttgtgtgctcctctttttggcctgatgccgatggatgcaggttttatgccctagcttattttgtagttttttttagtcgatctggtcgcacctgaaccaatgagaattaggccaaaaccttttaatttttttctcctgaacttaatttttttattttttttctcctgaacttaatacttccctaaaaatacttccactgaactaaagtatataaggagaaatggtgatcaagctaataaatgaaacatggtgtaataaaaaaaacataaacaaacatgtgagattgtgataaaagcaactgtgactatatagcagctcatccctcatgcggagagagagataagggggagaggggtgtttataacaaggataagcatgcattcatgataatcttaacaacactaaacagccttgactaacctggccaacagttcttgtgtgcacaatccagaggaaggcactaaatcactacatgtcaatcgatagaagagacaaatacttgggatgagcccctgcaatatgtccacaggcaaaaaagttgacagacttgcttaggagcacaccaaaagccagaccaagtaaatacaagcaccaaacatctattttgttttgtattttttatacaacctcccaatgggaataaactaagcatattcttattgatttagttgattgacatggatgagttattgaaatatttgttaaatctatattactttcaactgaaagtataataacaaaaacaaggaaggaggtttccgcatgtaaaagtactaaaaagataattcaaaacgtgttcagactttagtagtacctcaagatacatttcatcgagcagtccttgagcaccaaaaacctctaatgcgttcctcctcttccttgttctctttgtatcctcctattctctggccatagcagcagtgcacagcagcacatacatcatgaggtcaacgtagagcagaagcaaatcgacaacaaatcagaaagagcaatgcggtggcagtaacataatagcagcagcagcagcaacaacatcaacagttgtagctgtagctgtagcctgtagcggggcagcaaatcgtccctaccaagcaaagcaagagcattgaactcattttttttagcagacggtaggagcaaccgcataggagttggcaagggatgtgaagacctgaaaaaatttgaaagccttggcaaatcagttacagcaactgtcaggcgactcaagctcgtgctgccagccgttgtcgctaccatctctccccctttgtccgcaggaaaccaccgctattgtcgctaccatctttcccctttgtccacaggaaaccgccaatatccccatccattgcatctgtagtgatagatggatggggatgaacggaagacgatggataattttataagatttcatctcttcctcctcttatggtgacgacgttgcgatctactatctaatcccgctttgcttgccctagggtcgcgctcagccctcaactcatgctcactgccttccttatggcgaagatgcagagttgaggatgacgacaaatcgacagcaccgacagcggtgggcaggcggcgatgtcgagcggagttaatgtgtagcagccacagcgcactgtgttgaggggagatggcgacacgagacgaggcgatggtggtgggctaaggcgcacggtggtgggcctattggcgagccggcgatgacattggctgggggatggcagtggcgacgagccacctgggaaggaagaggggtggttcaaggcggcgacgaagtggaggcgtggggtgctcgaagcagggaggttgtccattggtttcactaatcctgctactaatccatcggctaatccaactcacaacgtaggtcgttagatgagaggatccaacggttaggaatgatctgggtatattttgttaattcattttgactttttccgtagtcaaacttaaccaagtttattaataacatatttgttttgtatttaaaatgctatgctaacttgattaaacttaaagtttgattagtcaaaacaacttataatatgaaacagagagagtagatgcctactaattgacttactatactagtaatatgaacgtgctaatgctatggcgatatttcataaaacaatggtgatagacagataaatagaatcatgttgagaatcaaacaactaattatacttgttgctcacagtatactgatttaatacaagacttcctaattcataaaacccattgcatgatcagtttcacttgagctatcaaagcgtaaggattctttgaaaaacaaaaccacagacaacagtgggagaccatagtttacagggtcaacaatcatgttttctccttttctagcctccaaaaataggaacattgattcaatagttttttaaactcccaagttactctaggaaggttgactatgaagatcgtctgagttctaaaccagagatctaccgctctttacaaactgaccaaaatcaaatctatggagctttcccccgaatttagaatggatatgttttacacactttttcaagaacacacgaatgtattgcatgtccttcatacaaaggaagatagggttagacatatcgttactatggggtagtttggatacagggttagtctctgtcacatcggatgtttggacactaatttgaagtattaaacataggctagttacaaaactaattacacggatggaggctaatttgcgagacgaatatattaagactaattagtccatgatttaacaatgtagtgctacagtaattaatcatgaattaattaggcttaatagattcatctcgtaaattagcctctatctgtgtaattagttttgtaattagtctatgtttaatactccaaattagtcagagcgttcgttcgttgggtgattggagagaaagcacatcgttttccgcgtgcacgattcccaaactactaaacggtgcgttttttgcaaaaaaaaaaaaattctataggaaagttgctttaaaaatcatattaatccattcttgaaatttaaaatagttgaaactcaattaatcatgtggtaatggcttacctcgttttgcgtgccttctcaatcttctcttttcctctcctcaaaagtaaaagagagctgaaactcactgattctaaagtttggatcactgaaggctgcaatatggactgatcacttcagaaaagagtcgacacttcaaatttatctacattgatcacacaacctaatagattcactggacaccaatctaatgacatatattttgacaaaatatgtagcagagaaagtactaattattcataaatcacatcatgagctacaaaaacaccatgaactttgcttaccacgtagagcaacaatcgacagaaagctaggcttgcactgttgtttccagcttcctatagattttcctgcaaaacctacaaaactataaaactggtgaattttcaacaccaaacatggccaatgatatgtaatcatgaaaaatcggtataaatctaacggccttatcttgttgcttatgcttatgcttattagccaaaatttgatttttcaaccttaaatttggagttgattttgtggtttttttcatcgtagtttattttttagcctttgcttttagatcgttaggaacatgtatataaaagttttattcacaaattatttctcgtttgcaaataagaataagccaaacaatgggatgtaaaaggctaacctcaataaatggaaatcttcattgatcatgatgaataaaaaacatgaccagagctacagtactatacattaattaaaaacaatattttttgataaaaaaacagttttaattactgcatccaactaacattaataggtaactcggtaaaaaaataggaacattgattcaatagaataagatgctaatagctctcccatccctactgtcccaagttactttaggatggttgactttgaagatcgtctgatttctaaccagcatcttttaaggtgttggagaggttgttgtaaaaccacagacattaaaaattacatgatttagtataagatattcaattgttaagcatccctgtcacgaaccagggggctgctgcaacaccagagtcagcttctgctcctaatctcataccatttgtcgtgatctatgaagtaaaaattgtcattcagataattaatacgaagagaggaaaccttataattccttctagtggcaggccacacagttctaatagccttcacctccacttttgcagcaatgtggaagtaattttacaaaattttaactaggttagtagagtgcagatgttcagtgcaaaattactcgtctattttaatgcgcaccagttgtcttcccataaaacaaaaaaagtagttgagccttacaaaataaaaacttagatgcagggtgttgagcattatcggtgattaggaaatagttccagttctaaactagagtgtttacaaactgatcaaaatcaaatctatgnnnnnnnnnnnnnnnnnnnnnnnntggatatgttttacacactttttcaagaacacacgaatatactgcatgcccttcatacaaagaaggaagatagggttagacatcgtattactatatctgaataataagaggatgatatagttaaagcccttcatcatgctcagaagtaaaagagagctgaaactcactgattcagaagtttggatcactgaaggctgcaacatggactgttcacttcagaaaagagtcgatacttcaaatttatctacagtgatcacacaacctaatagattcactggacaccgatctaatgacatatattttgacaaaatatgtagcagagaaagtactaatcattcataaatcaaatcatgagctgcaaaaacaccatgaacgttgcttaccacgtagagcaacaatcgacagaaagccaggcttgcactgttgtttccagcttcctatagactttcatgcaaaactataaaactggtgaattttcaacaccaaacatggccaatgatatgtaatcgtgaaaaatcggtataaatctaacggcctcatcttttcgcttatgcttatgcttattagccagaatttaaattttcaaccttaaatttggagtcgattttgagttttttttcatcgtagtttatttttcagcctttgcttttagatcattaagaacatgtatataaaagttttattcacaaattatttttcgtttgcaagtaagatgtttggcttattcctcaaataagctaaacaatggggctgtaaaaggccaacctcaataattggatatcttcattgatcatgatgaataaaaaacatgaccagacctcaattaatcatgtggtaatggctcacctcgttttgcgtatcttctcaatcttctcttttcctctcctctcaaacactccctaagaggataatatagttaaaacccttcatcatgctcaaaagtaaaagagagctgaaactcactgattcagaagtttggatcactgaaggctgcaacatggactgttcacttcagaaaagagtcgacacttcaaatttatctacactgatcacacaacctaatagattcactggataccaatctaatgacatatattttgacaaaatatgtagcagagaaagtactaatcattcataaattacatcatgagctacaaaaacaccatgaacgttgcttactacgtacagcaacaatcgacagaaagccgggcttgcactgttgtttccagcttcctacagattttcctgcaaaactataaaactggtgaattttcaacaccaaacatggccaatgatatgtaatcatgaaaaatcggtataaatctaaaaggctaacatcaataaatgaaaatcttcattgatcatgatggataaaaaacatgatcagagctactactatacataaattaaaaacaatactttttgataaaaaaaaaaacagtactaattggtgcatccaactaacattaataggtaactcagtacaattagcccagcagccatttttcctagccacaactttcaccacaatgcattttctacaattggcctcatttctgttttgaaagcaataatgagaacataaaacattgggagctcaatttaattttagagtaaatttcacaaaactacatattttatggttcaagttgcagaaaaccacacatattttgatacttggcacttaagtacatatattttggtagtttagtttcacaaaaccacactatcgatgaatggattcacttgtgatatgacgacgtggttgtttcatctagtatgaggacgtggcatcatattaatttcgtgcgatggctgtaataggatgccatgtcctcgtcctaggtgaaatagccacatcatctcgcgggtgaatctgtacatcgatagtgtagttttgtgaaactacacgaccaaaatatatgtactcaagtgccaagtgtcaaagtgcgtgtggttttctacaacttggaccacaaaatatgtagttttgtgaaatttactcttaattttatgtctggaacaaattacgacctggaaaaatcagaaatgcatttgccgaggaaaaaaaaccagtgaagctgcagccaggtatttgccatgccgctgccatagcctagcatatatggccaacataaactgtaaacataacctagcactctataagtatatggccaacacaaattgtaaatattaattaattcaacaagtatatgacagtcaatacttccgttgtagcctaaaaacaaacatataagaaaagaatgcatcgacaattatattctctagcgtgttcagactttcgatatacatattgacaaggcctcacataaatttgaaagtgagtattaaactaagttcataagtgatcttaaaacaagtaaaaaaataccatttggagtgcatcttttggaacccctgattgcctagctttgtagcatgagtcttcaaaggagcaatcaacttcaaatgtctggtccaaaatttcccctccggtattcataatatatagaaattgtgttcatcaagggataaacctagtgaattactgttgaaacacaggaaacaaattatctccagagcataaggccaatctcacagatagaggtacaaaaccttgattgagtctaacattctacagtgcggactcaatatacacacatgacagtccatttctattttagagagaaatcaaacttcattgtaaattttcattgatgttaaaaatgaaaaataaacaccagtttacaataatgcacatagaatctatgttggcaagaaataaatcattgcaacggagaagaaaccaagtgtcattattatttccatacaaaaaaagagttagagaaacatcagaaattcattgagtaggaccacatcaatatctttacatttgatgaataatatctttacattgttaatgaaagtacatcaatatatattgtggtaaaagcagttctcaaatgatttgcaaaaaaaaagagagcatatagcaccctcaaactatcaccaacatggccttgcatgacacacttctgatgttcatggaagtataggcaaattatcatggggtgtacaatataccagcaccctgaagcaccatacatagcccttgcacactctggaaacaattgatcccaataaatcccaaaagtatatgggtgaagtgattccacactaattaacagagttgtattgtataaaaaccaaacaataatcaatattgatgcagaagtacttaatagcaccaattgtggtatacatggttttgagatctgcagttaaattacagcagttacaccaattgagtttcacaaataaaaacgacagacctagctacaatgtacatctagtgtaaactaaaatgcaatcttaaaataaaatcatgtttaccttcaagccagggcagatggattgaaattcaatctttaagattcataaaaatattgcccctcaaataattcctagggtgacaaatacattctgtatacagaactaaaaaactggagtcattgcctcacatcttttttgagaaggttgaaccaacttaggagcaatttaagtaaacaatattcattcaaactcattttcttttctgaatctatgaccaaaataaacacggtttgttgaagtttagtgatccagcaatgggaacaatatttatcatgtaaacgcgccttaatgaggacaaagtttgtgcctttcttatgagcttctcatatcaacctgccataccacaaaaaaaatgccatacaaatgacaaggccctgagcttatttattttccaagacataagaaacaaagagtgatggctgaaatgcatatataatttagtatgaaactaaagaatgtagaacccaaaatttcctagcactggtgaggggataaatgtacaggatacttcaaaatttatatcacgcatagaagaacacaatattgataaagatactgaaaaatggcaagaacaggagaggttttatgcgatctttaaatattgataaataatacatggttaattgaaagtactaagaataaattaactcaacattctgatagtcctgatcagatttgtagccttatttagcaaattttaacttctttgctatgagcaagcattgcctggtggttaaagtcacagattgcacacccgtataaaaataaactgcaaaggagcagcttaaatacctctgttcatttggtaagttcaccgtatgctatatgtagtaatctccaatatgggacctttcatgatatccaaacctgaacaattaaaaaacagaagcctcccaattagctcctagaaaccacagttcacaatagtacactgaaacaacacggaaaaagttgctctttttttcctaaagtaattatttagtaaaagcttgtaatgcttcttctttacacattccacaataattggattgtcacatgctatagctaacaaattcaggggagtgtacgtcttatgggacaaagggtctatgggagcactattcattacatggtacagtcgacatgtaatataacagctataatgataatgaccttatgatagtaatgaaaaacagatgtatacttcaatgaaaactcatgagcaagcaaaataatgaatagcactaagcatggtttctcaatttctcttctgtccataaaattcctcaatttctcttcctctcccacagtgaggatgataagcttcacagcagtcccagaaagtgaattttatggcagaaaaggaaaaatcataatttgccctgaaagcaaatgcaaaaaagagcctatgtgtatattatcatgggtaaacatatatgactattcagctgaacccgttgtgtgctggaactagttttgctgaaagatggtagtgttggttatgggacctggcattcttcactaaaattccatttaaggttttataacagagtaaaaaaaaactgatgttagacactatactgaaccgatcactgcatccggcaagctgtacacggagccaaccaaatgaaattattcgtgttggccatttcagttagcctttatgtacttgaataataacaagcaacaagagctaatgatctactgtcagatgggatccaaaccgctaggcaattcaaccagtcttatcagaaagcttgtctttatcatggattgactatacatgttagcaatttctgttgcatattctcaacttggacgtatgcatcacatatcaccaacttgaatgcctacaccacagatctatataaacaacgaaatgaggataaacaggtcttaccttcacaacaggggcatatgaagaggggaatgggatcagtgcggcgtcgtgcgatccggcgcaaagaggaccaccgtggagatcaacggagacaaacggatccagaagccagacaccttgtcgattgcagactgccattgcgcgtggagaaggggagtcggcgatgtaggccaccgcggagtgcagtggtgggcccaactttttgaacctgtgtattcgaaatgggaagggttaaaaaaattgttcatacacctaaaagcctaaaaattagcttgtatagttctgaaaattaaacaattatggtaatatggtatgaactaagcaagcaagtatactaaatcaatgaattgtagttcccaatcctaaaatcttcattacaagtatcaaattttgcgattttagtcatagagacaaaaaaaggaataatgagttttatatccttactgtcgatgctaagtatatttaaacatagagaccattataagtcagtcagatgatataatactagtactctagaataaaatgtcatgaaaacttgggccaagaacaattctgttatataatttctagatgaatgaataatatagtgtactgaaaactatgatgtaccaatcaatcaaaacataaatgattcaggcattggattactgaaggaattcctgaaagttgaaaactcttgagaaataatctggtgaagtggtgatgacatgttgatatatcccttctcttttgctgatcttttcagccttcgggaggaatatttacctgctgaggaggtgctgaggaggtggccgagatggcgtgccggcgccctgcgtggcactgcagcgccgcccgagccgctgtggcgctgccgccggtgcgcccctacctggctgcctcacgagtcgcgccgcgcggccgcgccgcagttgccactcgccggctcgccgcagccgcacggcacgaagcgccggccggtcgagcccgcgagccgccgcctccctgccgcagccgcaccggcacgccagagtactggaggtagttgtgaggtgggtggcggagggaggccggcgcgaagaaggggggagagtcggcgaccacgggatggaggtggttgtgaggtgagcgggggcggggagatcggtgaggcagagggacggcagcgcgagtgcgacgcggcggaggtagcacctggcggcgcttcgtggaaggagatcggcggcggcatgtgagaaggagagaggattagggcgtggaggagagagagagagacggcgagcgtgaggaaggcgtcacacgcagaagagtagccgttggattaagatgttaccgttaggtggccgagatgtaaattgtactccttctatccgttggcacgcttgtacttaagaagtatcgtatttgtttatttattcgcacaattatacaaagtacgtgagtatataataaaagttttttttcgcccattaaaaactaggtatctgttggttactccttcatatatttacaaaagaaaaatcagaaatcatctccttttccgtaggacgtttccggcctactccttcccttttgttcctcgtgcatagagatggcaacggagaattcaccgtctggggttacatccgcgtcaccgttcccatggtgatgaaatttcaccgtccctgtccccgccaactatgacggtgctacattttatccatccttgaccttgcacggtccgtcaccgcatgtgctcatcttgcttcgtcaccgtcggagctaatgggagaggtcaaagccatggccagtagccggcaagggagagaaacggtggggtggcggcggagatgggttgcaataggtccctagctacaggacacgcgggtcaccgcgggggacgaggacggggagtggagcactgtccccgcccccgcccctgccatccccgatggtgatgagttttgcaccactagatttcctgtggatggcagatatcatccatcctcatcccttaggccttgtttggttaatcccctttagagagggattggaggggatttatttcacacctattatggtgtggaattattccccctcaatcccctccaaaccgaataaggccttaatgtgtgatttcaccgtggggaatcgatgatcgtccccattgccatctctaatcgtgcggcccatccggcatgcctttgtttcaggctgtgccctgcctcgtgttgacaagtagggttgatgggaaggcggcggtgacggaggcagccctgcgccggcggcggagctccacatccttcgatctgaggtggggaggagcggcgaacttgcagtcggatccagtgtcgccgccaagctccccgctatggtcgccgcccttgagttccgcgagctcctccacactgacgacctcctgctccccggctccccatcgcctgcccctgctcgcccgccgcgacctcttgcttcatgccactggctcgacaacacttgcaagctccaccaccatgaccttcgccatcgctgtcgagcgacacgaggtccttcgaacctcctcgctaaggtccaagtcctccgatttgcccgcgatgcagaaatgacaccagtcgacgtcgcttgctgctccccgcgctagcgaaccccgcagcgtggccgtcaccgttgagggccattagctccatcgcgccgaaaccacactgttgtcgtcgtctccatgcgacgtggggcaaaggtcgatgcggcgccggtgcccatgcgaccggagggacgactggcgctcgcagccaagtccgtcgccgccgccgtaggtcccattgccggcgtgcggagggggagagggaggacaagggggagagagggctggcgccggctctgacgcacacatcgcccatgtggtgagggagggacgacagcgctctcgcggcgtggggaagagatgggacgggcagggaaggaagtagatggatagagtttggggataggagggaaggggatagatttggttgtttttcggaaaaaaaaaaaccttgtgtttttcatgtttacagtgctgcccctaagagcagaattttctcttcttcgtgtcgcatttctttaaaagctaggggtgtactgtataaaacggaacatggtgtcagtcggtggaagtacgtgcgcgctattccgtccaaacacgaggagtctttttttttataaacaccaccatgcgtcatttactacaagaaaggttctgcgtgacacacatgcaggacgagactggcacaaccggtggaggaaacggcgcaaaaaaaatcatgtcacccaatcgaggagcttctgcacctgcaaattacataggacaactactgaggagccaaaaaaaatccaaaaagggagaaaaagggtagctctaggggtttaatatattaatgattaatgatgtaggtgaagtattttctctccttttcttaataaatttatatgcaagttacttacaatttaactcaatatatacatttccgtgcctaaccaaaataaatattctataatgattttgaggacttcacagagagagagagtgtgtgtgtgtgttttcttttttaaaaaaaacctgtcgcgtgaatgggactgcattatgtcgctgtttatgtgttgggtttggtaccacggaccacggcgatggctgattggatatgcatttagggcatacaataggaaatgtatatatggaaatagatatctactgtacttgattgtgttgtcggtagttaggacttagtacagtgtttagttgttcacttgtttgcatgaatttcacataaaaccataaaaaagaacgtatagagttacggaattgctataaatatggcgtcatatttatagcaattagtttacagtcgatcttttaccgtacaattagttcagcgatttgtgcatgtccaaaactgctaacaccatcattactactattgttgatactatacatcgatatacactatccaggacatactaatatctaatcattacggagtaaaatccaagatgccatgcacagatggtaggcaaaaggacaagaaaaggagaagccaaggaagatagagagctcacgtcaatgtctgtttttaaactgcagttacatatgtaattatagtgtgattctattgtagttacatatcacttacacaccacttacatatgtaattaatataattttaggatttacatatataattttagaacttacatatataattttgggacttacattgtaaatacactaaaattacatattagaaatttataatataaatacatgccggctatttttttataaaaaaatatggcgtcataaatatagctactccctagagtatatggagagtctataattataatgtgtagttgcacttgaacagtgcctagaagcactctgccagtcatacttgtcactgcagcacccttttgtccatctaacctagcatgctttttgttggaggattttggtgagttggactgggccattctatttttgtaagtgtttggttgaaaaactccatgggttgagttagacccaaaagggaatactatgtatatatccaggttggcttgatccgtggaaaaattggtgaactgttttgacccacctcctttagcgcagtacacatgaggcgtatgcttgtgaaaaagaagaagatagtgaaaatacacgaaacgagatgagacgttatcgcatcattaagtattaattattttaaacttaaaaaatagattaatatgattttttaaaacaactttcttatagatcattcttttataaaaacacacatacttcgggaagcatgtgcttagaaaacgtgaaaattttctactccgtgtggtgctggtgaacttgcttgagctttttcgtcgacacataaaatgatacaggagattagagtatgattaatcaactattaattattataaacttaaaaatagatttgtttgtttctttaatgaaatatatgatatttatttatttttaaaaaaacaccatttagcaatttagaaagcgtgctaacaaaaacaagaaactttcaatttggagttgataaaaggaacgcagactaaatgaatgatgacaatcaatttcgcatcctccagaagtatctaaagtatcaaacctcatgacctcatcagacaaaatggtcaagcctgggttagcttgagccttagaaaatcttattggcatgagtataccaaattagtataacaatattcacaacaatttcagatcacattctctatcgaatatcgatcccataaagattgcatcccacattcctttgaattctagtgaataacaagggaccaaaagcatgccacattcctctgaattctagtgaatagcagaacaccaaagaagcaatgctggcataaacaaatcttccggttctcttctctctccttttttttaataaatccccaaagggacacgaatagcttgtttgttagtccaaaatatttgtgccaattgtttgttttcactctgccttttagcgcctaggcaacttttctattttatcaatagagtatcagggaaagcttcttcaacttcagccaagttattaccaattatttctgccccaagggcatcaatctcatagcgcacctcctccatgtgctcgtttatgctggtcactgcctcttgaacaccttgtatggcctctttaagagcaccatcatactcagcatctgcctctgcatcctccgtgccagcagcctcggttatctctttgacatgcacacagacatgttgagccatattgcttgacctgcaatctgcatggttcaccaggcgttccgaaggacgaccagctttcttcaacacctgaattcttgccgtctgaaataatcagagattaaaaaaaaaactttgttcagtgaattgagaaatttccaagctgagacctacagatagattgtgcgtcagatcaaaccaaaacgtgattagccacaacagctagaaacaatcgtttgtcaggcttctggactagttttgagtttaattttatttagcagcaatgccatgcgttgattaatgaaattacttttccctcacaaagaaaagatgatgaaaacaaaagtatatcagaaaatagttcaatattaaatcaaggtattgctgctagttgctagacaagcaattcaaacaccctaagtaaacataacaggctaagtgcaaaatatttcaggggtcatcagtaagagagtaataggtgtagttttcaagcaggaatatgccatcctattgcaattgatactatcatgctcaaacagattagtcaatgtgacattaacctttgaatgcatatcaattactattattgctaaatcagggaaacaagtttatattacttcctctgtttcataatataagtcattttgactttttttttccagacaaacttctttaagtttggcaaaatttatagaaaaaaatattagcaacatttacaacaccgaattagtttcattgaaaccaacatttaatatattttgataaaatgagtgttttgtatcgaaaatattgctatatttttctataaactttgtcaaacttaaaaaagtttaactaggaaaaaagtcaaaacgacttataatatgaaacagagggagtattttatttgatcttagagcaaagtataactccaaaccagtcagcactttgaattcaggaatcgggatgcatgttaaatttgttaattgaaataggttgagttgctatttgtaaaacggtcagaacgaaaccataaaaacaaaaaatttagttctttgtgtgattaatcattccgacatagtagcttccttacgccacaattaaaagcaaaaaatatagtaggtaaccaagtaatttggtttttgaaaggaaatcagttttcagttgaaaataaagcataaggctgaaccatgtcaaatttcataacaacacaatggagtcatagacaggttaccagatgcaacttctctttctcgtgtgcctgcacatccttcagtaagttggcaagatcgccacgacaaatttctggcgttgataggagggctaccatttcgagaacctatagggaataatatgaaatatataactttgtatgataaaaggagatgagtcaggtgataactgcctaacttgtttcgagcaatcattgaactccgccgtaacactcgcgcatagttgttgaaaagctaattcacctccattagccatgtattcagaaaaacccctgcataactttcaaaatgagataacaaaaagaatggtcggaaccctcaaatatgacgatgctgttttaaataaaagatttccatcacagtatccaaaataaaccatgtatgcgatacaattagatttgagcgttgattttcagcacttcaagattgtatgcttgtgagttgtgagttctactttttaagttacacttcaacatgaaacagctttgctggctcaatgtagtgattatgattttaattctgtacaaaagatgagttaggttaaccagcataccaacattatttaattgctgttagcaaatacgacagtcagtgacatctttccatatgtgatatcgtattttctgttcaacatgccacttgaagcatataatgagttcagtaataccgacgcattcctttcgtttcgttgccataatttcagttattttagcgttgcataagggtgatactacttccgtgctccaggaaaaggttttatcattttgttaataacttaatatctccaatagctcatcttttctagtttaaaaacttacatacccaaaatggcttgctcttcatattcaattcatcgcctcaaaaatcacattcagagtgcaatttatcactaaaaccacaaagatcctgcctacaggaatcacatacacagcactctaacctcggcttaaaagttaccagggcaatgaaaaatccccccctgattctaaaagttactccaatcctagggttttaggggcgggactgcacaagttgcacggacccagcaagcagcgagatagtataatatataccttcggagcgtggagtacgcctcggcgcggcgctgctgcacggcgaggaacccgcggagcactccggccaccctcgcgttgctccgcccgccgccgccgcagtccatggcgtcgctgccctcagcggcagccgccgccggagggcactccgccatcgggtcgccgctggcgctggcgctgacgctagcaggatccatctccgccacgctacggccgcctccgatctctccccccttgatctcagctcttcacgaggtgagcgagatttttgcgtgctccggccggcgtcccgccctcccctccccttcccttctctctctctctatctttttccggcccagagatcgggtcggttcaggagttttttttaaaaaaaaaatcagttaagttaggaatcgaagagcaaaccgaatggacatttaacttgccacttttaacatgtgctaattaattatttatacttattgtatatgacatgtgggtccttatatgtatatgatatgtgggttcagtgacaattcttttatcaccactaatagataggagtgacaaataattaattattccgaatcatttctctcggttgttaaaaaagaaaaatcagtctctctccttgttaagccgtttttcttcttgttatgaatttcgcgtgtcaaatagtataagattggggatttatttataggagtataaattactactgtacttgtaagtttcactagcctggtccagacttaggctgtgttctttcctggttgatctgggtgattgtgagtgagttttgtttcgttttccgcgtgcacgcttcccgaactactatgttttttttaaaaaaaattatataggaaagttgctttaaaaaatcatattaatccatttttgaagtttaaaatacttaatagttaattaatcatcatgtgttaatggctcacctcgttttgtttttgtgtaacctaccaatctcctctatctcttctcctcaaacacacccttagactattaaactttatcacactttatactttatgacacagttgcttatttcgttgtcacgtggtggcttgccacagtttttttatccttcgacctgcatacacattcttgtgcaaaaatttaccaaatctatattcactaaggccttgtttagttgaaaaaaaaaacttttcacccatcacattaaatgtttagacacatgcatagaatattaaatgtggaaaaaaactaattatacagtttgcgtgtaaattgcgagaaaaatcttttgagcctaattgcgccatgatttgacaatgtggtgctacaataaacatttgttaatgacaaattaattaggtttaataaattcgtctcacaatttcttaacgaaatctataatttgttttgttattagactatatttaatacttcaaatgtatgtccgtatatctaatgtgacaactattcccaactaaataaggcctaatttgttagccacaccatagtttagcatagagaatgaagcaggggcaaaatttgctacgggttaggtcatgtttaatgtaggttaatgagtggattattcaaatgaattatgtatttgattatagaataaattaaatattttaagaaataaatatagtaaatactccctcctctatataatccagatttataatatataatccagatttataatggtaggttatatctattttaagacggaggatttgtactgatgggttatctatttttgagactattggagtagctcaaaacaaatactagtctaagtaactcagagcgtgaaataaataatccatttcaataatccaataaatgttcggtttcatatgcaaaacgatcacaacaaaaatttaaacgttaattttaggccctttttttggggtgtgggtgcttcgtgttagacttttaaccgcttgtaagacatatatatatatatataagtgctaaaattattcttcgttgctctttcattttcttccccgcagcttatcgccttcactcaaccaatcagagccttgttccgtgaggatcgaaatgagggtataacagaaattgcttcatctgctggtcctgaacatctcacgattagcaaaatgaatccttgttacattggccagtcccccaaatgataatccagcggtatacagttcgcaagtgccatggaaaaaatggctgcgtcgctgccgttgccggcttgccgcaacaacgtcgcaactcgttcacccgtccgatggaacaccggttcctcgttcctttctgggcggatgtcccatgtcgcttcttcatccatgcaccgtttggctgaccccattcctaaagaaagatgggatggatatgcatatgctggagtagattatctggcaaaccagcataaaagcaaacacaagatggaatttgcgtgacaaaacaatgtcctcagtattataacttgacctggttaaataattggaatcggcttaagtaaacaagcatgagctacatgagtttctgtcgttaaggctagataaccaagctaagataacaagctattagacaactctactatcccacatggtacaatgtcatgaatgccatgaactctaattcagtgcattatgatgcatccatgcaaaagagggaagcaatttctatttgcttgcaacagcaatgaggtgcttagcaggcaaatgttttgcctcgctgaatttcaccaatagaagccatattactggatttaacttcaaactattacagctagaaagataagtgataacagcactgagtgacagatcactaatctgaaaatgtcttcaagaataagagaaaagaaaaaagaatggaaggccggctagttaggagtttaacagaataaacactaatcgatgttagaatagaacacaggtgcaacagttcaacacaaagggcggcatgcatggcaacatagccaactaccatagcacagcagtgcaatttatgaaggaaaagcacagtttcatctgttagaaagttctaaaatgcaatatattcctgtagtcaagattacctgtatgcagaacaataatgacagactgggttgaaaatactaaggttactctacacaatgaaaaaagatcaactctttgtttagaaacatgtctgcatgacactcccatgcgggttaggataaaataagtttcgcaaatatgtaaaaaataatagaaaaggagctctgtacataaagcatgtgaaaaggtaacctgcattgggttcacaggtcaatttaaataatttaaaaggtaacctgatcttatgctgaaaatctgcacttatttagccaaaacgatgtagaaaagatccatggttctttaaatccacacaagctcttttacaataaggtcacaagccctgatggccattcgaaaatctaaatagttgtacatactgcttaattttgaaagataggattgaggaaacaaagttcttgtgaaaactttgaccactagagtaatcgatttgccagaaacagcttaaaacagcaagtttataagtgcgaagcaggaacacgtagaatcatctggccacagtaaaatagttataagcatcctgtaaaatagcaaggtgaataaaaataagtgaaatgggtctgcaaaaagttaaaatttgtatgtacaaaaaataagtttctgaaaaaatgatatacatgtactatggtgatttactagcagttaaaaaaacgttatggaagggttatgaaataactaatatgttacaacctagctgaacagttgcactgcatacgcatcaaaataaggttaggagcaaactgagtcacatgagaatgacaaggcacaacatgaaccatgcatgattgcgaataattgtgaatgactatggatagtgcatgtaaatatctttggatacttttggtaaatccgagagccagacatgataaagaaataaaccagaaatcaagcatcatttaactaaaaaagagaccagaaaagcacgtgatttcacctctagcaaccagcctacgcatatctcctattattatttagctgtacttcaatttcttttgattaatagaatatcaagcttcccaaatctttcccaagctatgcctaatatagagtatgtgcaatagaattattggaaacgattcaactaacactaacataaggcattaactccctgaaattttgattgcaaaatgcagacttcagattcttatggcaacaattgtggcattaaagaaattaacacaagatggcatgttatcctaactttcattgtgcatgcgaagcatctacctaaatagcaataccataaaaagagtaccttggctcatgcaaaagcaaactcagtttaaaagcaaccaagaagagataaataatatagcgactcataaagggaaagctatttctttaccgatgtaaaaaatgcaagatcaatttcttggcagaaaacacatgtgaaaactatttgtaggttcctatggttgggacacaatcacctatccggatcttacctaatgacccatgtaatttcttcctgggcctcctggtggagtactgccatacccaccaccacccccatagccgcccaaataaccaccagcaccaggcatcccaggcaaaccactactacccagtcctgcagaagcccctgggttaggcaaccctgaaccatttgcaccaactcccaggatgttgttcagacccaaccctccaccctgggaggcaaggatagctgtcaaggcctgccccagagcaggattcacccctgggccaccagctacacctggcaatgaagtcaaactggatactggagatggcatcacatggcccccaacagcagcaccaggcaaagaatgactatgagctccataaccaccagcgcctttcctcccgcctgaagtgccagcaccatacaaacccccaagtcctccacctttgttgggctttggtccatcaattgccttctggcagtgcagcacaaccccctcgaattgcttgtgtggctcctgaagcgctttcttagcactatcgagggtcttgtagacaaatagagcaaagcccttcggcttcccggtaaccttatcgagcccaagaggaccctcctcaatctcaccatactttgaaaagaactgcagcagtttctgcgggtctatgtctgcgccgacattgctgacaaaaattttccgctgcgtgtactccgacactggcggcaatgccagctgcgctggggctggggctaccgctggggcagggttagtggccatgccgcccggcggcacaggaccaacagaggcgagctggcaggccgtggtgcggttgccaatcttcttctggggctcacggagcgccgcgcgggcgccggaccggcggctgaagaggatgaaaccgtagcccttgcacttgcccgtggcgcggtcggtgacgaccctgaggtcctcgatctcgccgtaggcgctgaacgcctcggtgagggtctccgcggtggcgtcccagccgaggccgtggacgaagatcttccgcagcgccgggtcggcgtcggccgcgcggtggacggccgtgagcacgtcctcgtggctgagcgccgcggcgctgagcagctcaacgagctggtccttggggaacgaattcagcagcgcctggatcgagtcggcgtccctctccgccgcctcctcctcctcctccccctccccctccccatcctcgtcctcgtcgacctccacctcctcctccacctcgacctcctccacctcctcttcctcgccaccgccagcctcacgggacatcatcctctcccccgcgccctcgctggataggcccaggggctgcgacgagggggccgggtcctcggctagggcttcgggctgggaggagggctcggcgacggcggcggcggcggcggcggcggctgcggctgctgcggccctggcggctgcggacctagcggcggcgggggatttggaatcgagcttccgcttcttgcccatggcgacggcgagcgcgaggcgtgggggaaccttggggctagggtttcgacggctgtggaggggaggggaaaggggggctgtgtggtgtggagtctggggctcgcgactcgcgaggccacgcggtcgtggggctttcttggttaacggcgacggaacgggggctacacaccgtttcccacttccgtgtgtggccagtttcggtcgtttttcccaagacaacaatgccacaatgatagatccaaactataaacagtacttgtactattagaacgtaagttcatcttttctttttctcaatatataaacttgactttttgagagcggtagatatcactatacttttgtattgttaattttgtctataatttttaacaatcatctgccttgaaccattttttttttgaaaaaatatatatacaagagaatatccgaatccattttcaagaatgaaggtgttcaacaatcatagcaatataacaatattaacaatagaatatacgcgagtcgaaaaattgtgcttctttagatttatcgaacctattagtgtacatatttatctttctaaattagcgtggaatcattgtaataattaagtacggctttgtgcttcttatttgcagcggccggtttatccattatgtaaaaaacttccgtgcacttaaaatagaaaacaaaaatacaaaatatccagcaaagttgattttgccccaacgtatgtacagcagtgcgaagaacgttgaaaatcttattgtcaagaagtgtccaatccaacaagagatgtaaagattaaaagtaaaccgtataaaatatcagtaataatatgggtttagctttacgctattttttctataatggaaataattccctagcttggtgatcttttttttatttagattttcctttatttctattaacttaaatggagatatccaagacgtcagacaaaagcatagatattggttaatagaaaccattggagtggagataacgaaatcctaatttaagtttataaaaaaacaatcttccaagctccatttaacacattccatgctgtagtacaccagcaacgatttcaggcggtgaacaagctggaagctaagagcaatagttcgtctaacatgtcagtttggggatctagcttcaaaggcttcattggtcaaagtctgaggcaccaaaaaaagagtaatctggatcagcagatgagccaagcaaagggatgtactctgatcctctcacatgaacactgaagcaagctgcaaaatacataaacactgtcaaacgtctacaaacatctagcgatatagtatcccagacaactgcatatgtcaaaaaggtaatactgtactaatcaactgcggacacatgaaaaaaaatgatgctagcccatatgtaaatattttcacaaatgagtggaacccgattcacacgatacactgaaataatttattttccagctgtaatatcaagtttgtgaattttgtccatactaaaacattaaacaaggtagaacaattgctatagttcaatacggtaagccgaggcaaaatcaactactcaactacagtctaacatgcaccccccccaccccccctgcaatcattcacgaggttaagaaatgactgacgaaagtcatgttaagcattttctattttgaactagaacatttggattccatcaatccatcacattaaacacttaaacttgactagtacatgcttccaagttccaaaaaaacttaaaatcaacttagttagctagttcaagtgggggcgtccttagaaaacaaaggattcaacaaaatgtcagagttatgaggttctccgtgcatagagaactaagccggttaaaaacgggattcgatatgtcagttgtaccaaaaagaacactagatcttggataaaggaacacgtcatcaaacaaaagtgtgccattttaagaatcgggaaaatatagttagaatttagcagatatagaaaccacatctttggttggcacaaaaattattaacagtcatttactagtataaatgagcattagaaatgaagatacctctgaactaaggaaagtgcatgttaactactaatctatatagcatgttaaagagtacaagtctatataacatgtctgtatatagtttcacttaaggaaaagataatatgtttcatctattattcatgttgtgataagtattgatacgtccaaggattttatgtattttcaaataaaggtcataaatgaggactctggtataaagttgatattgttgggcatcaaagaagtgataccattctcaattttcactacactttgcagcatagtctccatcttcttcttcatctcactattgtcatccatcagaggcaccacaagggtcagctccctgtatatatcacgtacaaatgcacaaatgtttttggcatattcaacttctccatcagatatacggccaattgcaagcctcatcagctctcctgacagatcggcaacctaacatattgacagcacagaaataccctcaacaacttcaagcagacaaagaaaaggatatttagcagaactaaattttggacagttgcatttacccctaaaacatagtcgagtacatttatctgtaagggctcaacagatttgtcacccagctctagcaaagaatcattgatttcagcaagacttaataaagtgccagtcttgcaaaatctgcagaatgttgcagcttcaacatattcttgtacctgaaatagtcatgacaaacatattggatccgttacaaacctagaacagaaccgatgtaaaggaacaacatttatactaacaccaaaggtataggcccttctgagcttccagaagtcggtcccttgcagttcttttaccaacttcccaatgtattggttaaccacaacagtgagatcattttcagcttttgaaagaacctcttccttgttattcttacttatcctgaaacaaatcagttcagttataaattaagtatagcagcaaataaaattgcaaagcagtataacagagagtaggtcaatttggttattaactatgaaatcatgaaagagacttttgagatgagtatgtatagttctccaatgttgtcagatgaatggacaattttgacactaaataataacttgaatgtatcatttgcacatacagcttttatcaattgccaaaggttgagactagcaataacttctcacaacgtgccacgagatgaaaataagttcatctaaaatcttgtttctgatcgccttcgatttggaggaaacaaatactccataaagcttagctcatggagagttcctgattgtccgtacagtgagagtaataagttttgcaaaaccagaatgacgtttttacactaagaataaactagaatttactggttcattgacattccacaataattttagtatcacatggcatactaattcataacaaactaaggtaatgaatgatacaaggggccctaagaatcacattatctgtcaaggaaacatacatggataattctcttcctttatttaatgaagcaatgtaatgccactagcacaattgtttgcttgtcaaattacctgtgaacctgaaagatggcctttttgctgttcattgtcaaatcccgacttgctttcacaagcctttcccttttatcattctacatatggaaaactgatgagataatataaaaatattgctaacttaagaaagatacagcctgctactaccataactgctttcagcatgtacaaggggaaaaaaatgttcaactgaagaattacacactaagagtagcagtgccgtccatatcacacactaaaccaaatatacatatcttaagcagagctacctagcatctagttcaagcagctttgaggatcagtttggtacaaatgtccaataacaataagttttgcagtgtccacaccccgtgaggtcagtaatctttacttgtcaaaacacttctcctaccctacaccactaaccggcactccaaagtgatcgacaaggctatctcgtcaataatgcactcattagcagaagccagtgatcgcataggctcaacgggaatttctccgagcacctggcccgcacaagatcttggcaccagatcacaccaacagtttccccaaaaaaaaaatcatgcctctactctactctaatatacgacagcgtcctctttgagcgcgccgctgcaggggggaggaaatagctcgagaagagagaacgtcgtcgcacgccaaggaggcgagggacgagcgctctaacgcgtgcgtacaacgtaccagggtgttgaggtactcggcgtgcttggcgaactcggccttcatcgcggagcaccccgccgaggccgaatgcgccgtcgccgccgcgtcggtggccatcgtcctggacctcttgggcgccgagccggcggtggaggctgcagaggagggggagcagagagggtgagaccgcggagaggggagaagaccgaggaggagagggaggggagtgtccagagcgtacgcggaggagggctcgcgcggagggttttggcggggtgggagtgggactggggcgccgccatggacgtggtgggggtggtggtgatgggaggaagaagggagggggcggtgacgccgcgcagggagaggaggcggcggtggcagccgcgcaggggcaacatctgtcagattgtgggccccgccccgtctcggcacttccgtttcctttgcctcacttggtgcgatttgtatttgtaaggcataatatgcttttttttattattgtttttttagaaaactaaaaaaaaattcgaataaggccttttttaatggtggtgtttgaatcagggactaaactttggtccctgtcatatggatgaatttggagtattaaacatagactacttataaaactaattacataaatgagagttaattcacgtgataaattttttaagcctaattaatccataattagcgcatgtttattgtagcatcacataggctaatcatggattaattaggctcaatagattcgtctctcgaattagtccagggttatagaatgggttttactaatagtctacgtttaatatttataattagtgtccaaacatccgatgtgatagggactaaaaagttttagtgccatctaaacagggtcttagttctcaaaaaaaattccaaaaaacgtcacatcgaatctttggacacatgcatagagcattaaatatagataaaatgaaaaattaattgcacagtttgcatggaaatcgcgagacgaatcttttaagcctaattagtccatgattagccataagtactacattaacccacatgtgctaatgatggattaattaggcttaataaattcgtctcgcagtttccaggcgggttatgaaattagttttttcattcgtgtccaaaaaccctcttccgacatctggtcaaacgtccgatgtgacacccaaaaattttctttacgcgaactaaacaaggcctatgattaagttcaggagaacccacccaacccaagtacatcgacgaagagatacacggaaagtattgaaccgtcttatcataaaagaggctaactgaattaaagaaacaaactttctaatgaaactgaagagtagcataggagcagatcgatagggtattgtgtcatttgtcgcaatgattgcgtccttaggccttcgttaacgtgcaatccgcttgacatacaggtaatttccttctgttgcctccacagaatgtacacgcattagaggtttgttgttgatgttgcgtggtgtggtgttcatcgttaaatctgaagagcactaatcgcaaccgcttggaccaagggtgcacaagcagtctatactcaacccgaacaatgaaccctgcatggttaccgttgcatagaaaacgtcgagaaagatgttccctaaatccaaccaaccttaatcaagagagaacttggacggtggcagtagaacatctgtcttgctagatcaagctggagtacatcatatgaatattgagagaaattaacctttggaaaccttaaaccattaaatgctataacatgtagacttggttcaccacattcagttgaacaagcatgaaatccacaccaacgtcatagtcttcgttaagcaatacctatctactcacctactccatcttgaccaccgaccatcatccgtagcccatccatcaatcgagggagctagccaatgagcagcaggtttggatcaagcaactgttggttcgggcaaccccaccaccagtggaagggcgcagaagtctccagccaaccccatccaaatcaccgaaaagaggaacctgaacctagcattgaggcatcggatccatcggaatatggctgcaccgaaacaacagcttcaagcctccatgatgatttagccaataaagtcgatgaagggactatccaccatggtctagcatgcatgacacttgagatgtcctgcaacacataccgccaccatgggtcctaccaccttcagcaaacgctatggacatgacaccaaaacaggattaaccttaaaacacaagaggacttgacatggaactcgaacactaaactatactacacttattaaagaagaaggcccgacccctcgtttgaccatcaccgacggaaagctgtcggaagcaaggtggaaaaggggtcatggaagggttttactgtagctctctctctctcttcacctttgatgttctccagaagcctcccttgtaaggtaggctgtttaaatacaagaatatgggtgtggaaaaagacacaagatttatggaatatataatattgtttatggagtttttatattgaatattgttcagaactatattaactcatctgtactacctgtctaactccgtccatactatattaactcattaatactacctgtctaactccgtccatacaccagtgtatagctgtatagccataagtaactattaattatcccacaaaatgtaacgttgagacaattttctgtataacagcaatagacttatgccactttttttttataaaaaaattgtagcattataagcacccaaggaactatgtataatttacttaacaatataaatattttgcaaagatacacaaattatgagttaaaaaaacatgtgcttttgcgattttgctatatatttgtcgacaaattttctcccaaaaatttaacagatgtaattacagtacaatcgtagtgtaattacactgtaacttgcatgtaattacactgtaactatagtgtaacttatatgtaacttgcaaaaatctctacgtgatatgttatttcggtaaaatagaagttgtgggaacaaatccttacacatatgtgtgtgccgtgattttatttttcttcctcaccaaaacaaatcttttaatagatctaaagattcaaaattacatgaaacttatatacaagttacaccgtagttacgtgcaagttacagtataattacatataagttacagtgtaattacactataattgtactataattacatctttcaaatttttgaaagaaaatttatcaataaatgtataggtggtcccgtgcttttgtattgtgtttgcgtgaaaaaaggacacggtaaaacaagacgttggaaacccagtcacccacggccacagcccaacaagcccacacaggccacaggagggtccaaccgtccaagggacagacgacgacgagcacgagccccagcgaaaacaccgcggcagcaccgcagcagccgccacccgtgcatccctacccgctgctggccccacccgtcatatacaccctcatccagccggtatttcctccccacggtcggggccccacatgccagccagcgctttgcctttcccacatcccctcctaaacacaaaagtccccataggtcatctccccctcctctctctcttacctcacgcgctccacgcacgcagagtcgagacgcgcacgccaccctgtcgctctctctctctcgctctcgccctcgcctctcccctccccatcaccacccaaaaccctagttacccccaccctctcaaaaccctaaccccacctcaccaccctccccggcggcggcggcccttgtggctgtgcacccatcactccaccggataagctctagctatctatcatccaaagcagcttactagtctgtgctctctctgtgtcggaaggcggcggcggcggcgcggcggctggtggtggtgggcgggggaggcggcggtagagcggtggtatctgggcgttttgtggcgggggcggctcgggcgtcggcgatggaggagccgaatgtgggcggaggggcggcggcggtggtggcgcctgagggggcggatccggctggcggcggcggcggtggaccgggcgcccccgcgtctccctggaggaagaccacgccgccgcctgtggcgggtgaggcggtggtcatgggggccaagtcgtggcccgcgctggaggaggctaggcagaaggtcgccgccgcggaggccgcggcgaggccgggggcgggcaatgctggcggcggtggcgaaccagcgaagggggcgcaggcgcagcagccgtcccctcccccgccacagtcgcaggtataatctggtgctcgtggccagccatatgcttgtttgctatggctttctatttttgttagtttagttcttaaggaaattttagtgtatggtaaagtttgctcacttcggtagatgtttatagtatttgtctctctatacgaaataggtataggttgggtctgggtatgcattggtctactggtgagtagtaaagtaaagcttggctgtttttggaaccacgtatttcaggttcaactttctcgagtgtgttcaactgtccatgttagtttttttgcttgacaagaccgcttgtccgcttatgttcaaagtaggttacacatgcattttgcattatgatgtaagtttgctatttgtcttagaagtaatgttctctctcaagtcaaccatgccccgacagcaagtggttgatagattataggtgtcatattttgatacgtaggatttgtgcattttttgtaacctattatcagattttgtttccacacaagttgtgatccaattggatctttgtatgattttgtccactgtgtctgtagccatcacattattttaggtattgctgtttggtcgcaaacttgcaatcattccaatgctatctagacggttattcaatcttaactgaacatgccttttatagctatctcctttgtaagactgctgggatggttacctaactgactcccatggaagcactttcttgggtgctatggcaatgcagtacatattgaacttatttatcatcgtgggggtaaatataagccttgcatttgtggcagttttgtaacgatcatgatatacatttatcattgttaagatgcatgggtggtctatcccatgaaactgatttgttccaaggtccactcggtaagatcaggaaaacatcattcttatttggtttggttccttgccttccctgtaaaccaaatagttgtcaaacaggtgttttgtgtttcacatgcagactaaggataattgtatgcttttcatcaaatggtttaaagtcccttaggagttattttttttattttaatgttttatgagctgaatatacattattttgtcactgttctacacaagcattttttttgctgatcatataagcattcttcctgttctgatttagtctgatgcaaagggggaaacacttgtttgtaggcacctaatcgcacgcacaagtttgatggccatggaaatcccaacaagaataatcaagcataccatagaaatggccccaagagacgttctcctgctgcgaatgggactccatcttatcctgccgcgatgccatatcaccaacatccagggcaacctttttactaccctgttattcccagtccagtgatactacatgaatatccttacccaccttttgctgttccggttccaagtcatgacccgcatgctggaaaatctggatatgagaattctatgcctgcttatgttccagtagatcaagctggtggcaatgaaggtaaccggccagtgcctccacaaccaaggggagaccttcatgcttggaggcctcctgttggtgcaagaccccagcctggccttgaaggccgtggccattttaatcacaattggcagaatccccagatgttcggtaccagggaaaacacaagtgtaccacaaggtgctgggccaagagctttcatgagaccaatggcacatctgcctcacactctgggatacataaatggtccaccataccctggtaatgctatgctcactgtaatggcatctcctttcatgcttggtattagagctttttttgcaccaatattaaaaaatgtgttgacccagggccaatgcctcccatgtattattacatgcctgctgtacccatggagccgatgagaggtccaccacgttttgtccaaaaccaaccacctcctcatcctgttttatctcctgaattaagagctaaaatactgactcaagtggagtactattttaggtaaattcttatttcttctattgagttgggtagctattttatattgggttaagtctgatttactccccctcaattatcacaaaagtacgatctaccccccttaactctaaacaagatattttacgccctcaaacttttaaaactgtacgaattaccccctttgcactatattgggtagtttttgcataagtggtgtctatgtggcaacaaaatcagtggaccttttttttaagacctatggacccacctcccattctcctttgtctgtgttctctctctgtgttcttcctacacgagcaagagcaaccatccaaatcggagatctctcaaaaccacatccggcatggcagcaacagttccatttctgtgactcgcctgatgcaatcaataactggctttgcttgaagggatgcctcccactgaatccaaggccatatgtcatcgaagtatccagctgcatatgactgattacttcctgattgatctctctgttgagctatgatgcacacctagatggagctgctgcacatggttggagctcgtcaggtgtccttttcctgaaagttcgcgaggagatcgccagcagcttgaatgggcctggctgtggatagatcggggaaatcactagcagcttgggctccgctgtcgctcccgcctcataccagtctgccactgttgtctccatcgtgctgctacagtggagataggggcagggagatgcgactcggttgctgctcagaaccagatgccatcgcgcctaaagtccaaaggttgcaggagggagaggggagagaaataagaggggatgaagaaggtagggagaggctgacaagtgggtctgattccacgttggatgccatgtaggcttaaaaccaccatatggttagcagaagggggtaaatcgtctggcttaaatagtactttttccccaaggaagcatgatggttgatgactagaaaacaggcatttgagcatttacactacctgatagagttttcatgcaatttcagaaagcagtgacaagttagtcccattgtatgtctattgaactttggaatatatgaactacaatttgattttgtcaatttcattgttgttatcctatatgcaaacactgacatgctgcactactaaaactattttgtatgtatgtgatgcacatgggttatcatatgcacttttatcatttgtcattcataaggtcttttatttacccattatgatgcttttcagtgatagtaatctggatcatgataattttcttaaatctttaatggacgaacatggctgggttccaatttccaaagttgcagacttcaatcgggtatgtttttctcagtacttaaacttttgctatttcacctttatattatgccatataactactctgctagtttggcttgtttagttgttttgcagcttaagaaaattatcaaggatatacatctaacaactctgttattgcttggttcatttgcagcttaagaaaatgaccacggatatacaactgattgtagaagcattggcaaactcaagtcttttagaagttcaggtacgtttaatgcaactattgttgcttagatccctcttagaatgtcatctctcttatttatcttatgccttttgtataccaccaggatggtaatatgaggcggcgttctgactggtcaaagtgggtttccttgtctgggacatctcttccgagtccatcttcaaccagtatggataacactactggtgaatgtaataaggatgcttattctgaagatgaaaagaagcctcatcctcgcagcgtagattgtgttggtatgggggcttctgatgagccatcacatgatacactcagtagttcagtcacttcactgaataagggcttatcaaacattagtattgataataagcctaagagcatttctgcatgctctctgaactcacaaaaacatgaagctgcttttaggactggtgatgttaaagttcagaaagtaaacacaaagatcaaagtgcctgattctcagagggaaagaggtttctgtaatgatttcataagtgactctcctagcttcagcggcgatcaaagcacattcttgcttgatgaggaattagaattggagcatgcagagctttcacatgatctctattcgcacaaaaggtgaattttaactagtttatatatgatctgttacttcatttcatgagctataatttgttgttttattagtttgttattcatttggtagtttatagtgttgttattgtgatttgagattaaggcgattttggttgtaatttaggcttcctactctggccgaagtgattattattttatgtattcatttgtacagttttatgaaatgaaagatgtatccaggccacttatgtgagatgtgtgctatactgctacaccctccttttccatcagttaatgtcctattatttgatgaaactggatattcttctgtgttcacattttggagtgttaggcacatgtattctcagaagttcaaaaattgattatatattttttcatgtaatactgcatcttttatctactacactgcagattctagaaatggtatgcatataattgattctctttatgtttgtttaagcagggtcgatgatgaggaagatgatttttatgttgatgaccaagatgtgaacaggctaataatcgttacgcaggttagatttcaagtagtattttgtattgctagctctgtgtagtgatatacctccttcagtttgcagctccttgccttcgtaatctgaacacactgggcttgcctttttttatgcaccatgcaccaataagttttgggacagtttcaatggcgttggatgtttaactatttctaattttcatgttatgatgatttacctgatttcttattttttgtatttataatagtcttgctatttcccttgctacgaatcctatttgagcagattatgttcatgcttaataattacataacaaataaatagttgattgctaagtgaaattttatgctttatagggacatgccctttttatttcatgatttttgacttgattgagatacatttccatgtactgtgatataccattattttaacattatttgctttataatgacttgaattttctcatctctaaatattatatgttaattagcaccttagcatccatcaagcaaattttgcagcacgctatcttgtatgctttcaccatgttaagcaagtcttgtcttggtaatagtgcaataaactcttgtcaactatctgcgttacaggacggacctcaagcattttcaaaagaggaaatatcaagaatcaatgaggggttatattactatgaggtaatattttagagcataaaaagaacaagattatcagtaattggggttgtatgtgcattttaggggccaatataatgttgacacagtgctgtgttgtttgggaactgccattcactccaacgcttgtatttattattttattttaacaattacatgctcaattttatgcaagtaaataagctttattttgggcatgcaattcaacccagtaggccagtatcctgttttatcatgaagtatccataaaattaagtaaaattcctgctcaatttaatacaattgtccaggctctaattcaggttttctgttttttagattatcatcccttttctttctcaagaattgcctgcatttgatacttgatacatattatagctttgagttatatgttagaaattagaaatgtcccagtagcatgaatctttccatgtatagtgctggatttttttttttggtatggctaatcaattctttgaatttttgaatcatttgtactaaactgagtgttgggaaaaaggtacgagacaagggttatcttggagctaaatcgaatttaagtcaagccaggttgatccaaacctgagctgttcttgcctttctttatcccaaagccctttctggatttatgcttgcctataaaattacattattctcatgctaatacatgatatttattcttgctttagaatcacgcttataatcaaagaagttcccaagctggcaccatagatattgattctaaaccagctggtggttcaaaggggaatcccattaatattgtaaacaatggaattgaagattctggacagcctatcccacgaaggaggcacaacagaggcaatagaaaagcacagtcctctcataagcagaggttctttcctggtaactttgcgaataacaccaataatagatctcactatggcggtgtatcagagagccccccaagcaattcaattggatatttctacggatctactccagaaaaccacaggttaggttaataaattaattgaggttttatttctgtaaaacaaatacttatctctatgctttgtggctggtcatattgtcatatacctgcaccattcttagcaagagatttgaaaactgagtacatgatttgcgcatgacatttaagtttcaagtttatacacttgcatggacaaatccatctctgccaacctgttttttttattgaaggtggacagacacccactgttatcatgagtgcctttttcattgaagcaaagctattgaagttatcttaactaagtgttgttgtttagctatagaagttcaaggttgagctcatctcctcatggaatccctactggtagctcgcctgttggttctgtgcccaaatctttcccaccatttcaacacccaagtcatcagcttttagagaaaaataaattccagcagcaaaggtaagctgtcagtatagatctcaattgagttgcagttctttctagtactcattcctttgcaagtgtattactaccctttattcgttgtttcatagtaaattgatccgttttaatgttttcttctgcatgtaaaggtacaataagttcaaaaatcgatgcatcgctgaacgcaagaagttagggatcggttgcagtgaggtgcaacttcctcgcacatctctctttctatggcaacgttctaactagatatacataaatctgaccaagctcatttattactctctttgaatcattttcttcatatgtgaaatcatttggtgttactattgttttggcaattattactgattatatgccgcatgaatacttgttctgtttattgattatatactgatgctcttctatcttccaatgtaatgcaggaaatgaattcgttatatcgtttttggtcgtattatctaagagataattttaatgatgatatgtacaaacattttaagaagtttgcactagatgacgcggcagcaaattacagatatggacttgaatgtctcttcagattttataggtacggtacataaaaattttatagtaatattcccatttttttccttgcattccataatatagcagcaatgttcactgcctgcttgtatttacagttatggtttggagaaaaacttccaacgcaatgtgtatgaagatttcgagcagctgacactcgaattccatcacaagggtgatctttatggactcgaaaaatactggtaatttgcatttctctgttacttcctgtcccctagtaatctaattatgtggctactgtccttggggaaatatttagcacagagctatttacacctgagcaaacaccaaacagtatgcaactcaatggtgcatttccaatatcaaatattcacaaccttatgctgtggagtattggcatgataaagttgtacatgctcagtcccagcacaaagatcatcaacaagaaataccatctggtgtcactaatacgttacctcccttctcccacatgtgaacctcacactagatcgtattttccaatttatatttttttgtggtggcactgaaccaaatcttcttttgattataacacacgctattgttacatgaaagctggttcagacctggatagcctgggtacgccctgaaaagggtaactgaaaatgaatcttaaaattatgctggactagtggaattggccaacctagcagttgtaagatttttgagtttgcgatactttgttgctgacagatctgctttttgctaattgaaccagggctttccaccatttccgaaatcaagatagcagccccattatcaagcatccagaattggagaggctcctaaaggaggagttccgaaccatcgaggatttcaaggcacggaaggcagcagagaaagaaactggcagcagtactgctgccgccgcaggccataacaaggctgatgcgaagtaggtcctagcatggcatgaaattttggtggtcatcccacaaaaaggagaaagtagcaaaaccgtttttgtttggtgaaaaacttaaggatttgagtagacacctgtgcagattttgttctcccctgccgacgatacttgtgtggccttgtccaagaaattttcctctcgnnnnnnnnnnnnnnnnnnnnnnnnnnnnnngccctgtgggatttgtacataaagataataattacttgttgattaaatggacaaataatagagcctggagttaaaatgacacggcattgtcgtcttgccgttgcttttggaaggtttatcttagcaagtttcttcacctgtggtccggaggctggaaaccaagtcacggtcatattgcctttgtgagcttctctccatggaccatggtccttttcgaagtctctttcacttctctggtggcaatgcctttatttttgtcgtcggccgcacgttatatgtcagcacaaagtgccatattctcgttactggagatccggcgtactggcacgacgaggttttctcggtttgtgatgccttttgctgttgcagtaagggcctgttcggagaagtttccagctgcagcttctcccaaaatctctagctcacccaagcaatctagattgtcatccagattttaagaatctgtagttgtagaatccagaaaataaactagaactctagaactcagaagcttaaaaacccagctcatacagattctcagaaattggtcaccaactagaaaattcttaaaatcttaaactcccctaaatagggcctaaatcgtttcttaataagtactagtgccatgtgtctggggttggaaatggtaaaggaaattttcgattgacggagcacagtttccgtataaggggtattgttactcttttgttcccaaataaacactatgtttatttatggatagaggaaatatttcaaattcattaaaaaaaatcaacttctaagaacgagataaatgactattcagatttattctcgtaagttggttttcaggaatggaggatatgtacaagtttttcgattttttgtttgcaaaccgacataatggacgttggacccaaagccagcacggacgataggagaaaatacagtggccagggctgaggctctgcgtcatatggatccgagcctaagtggagtagatgctctcgtagttcgaatgagtacccaatgccagtgtcaaaggaccacctgttatagatgttagtccaaataatcttttcaatattgttagccatctatcgactcaatcataccaaattacgataaacaaaataatactacgagtttacgtatagcttatatctccagactctaattattaaaacacctcaaccaacatggcacatcggctactacaggtttaatagcctaactgtcatccttcctctatatgactgctacattgtcattatcattgttacattgtaatattcactctgtatttaaaagaataactagaggattagagtctgatgctaacttaactttatatcgctattaaaacttcaagtttaattttactttagtatagtatagtcagcgccatattttcacttctctcttagaagtcatttgatattgtcattcttgtttccaaaggccggtgttctatttaggttgtggtggtcttggagtgaaaatatttttgtcacatgtgattcattgtacatttagttaagaaattttgtattgcaactttttttcgcttgctgtttttcactctccacctttactagtaagacgtttggtcgctctctaaaacgtgtctaataattcgtcgatgattaactttagagattggtcctacccaatccccaaacggaactaactactactgtagttccggaattatttgatgatagaagacatctgaccctagatttaattagaacagtaactaagttggcgtgtacctaaaacctctgcataattgtgctacgagtcattcctaaatggacagaatgaacagctcacacatggacggtgacgagtgacgacaagccccagctagatccgataattttccagctcacttgggagttcaaatgttaaaaatctctgtaaagccgttattgcgtaattaatcgaaatgtgaccttagcaagttggcaaattgtgaaaaacgcctactaaaccaccaatatttattacttctaaaacgagccaatatttttgtaataagacgtagccggatacagactgacgtggatattgattgattttcatcattaaaagtacagtgtattcttaaaaacgattattcatgttttttaatattgaaataataatttctggcctctattcatgatgttgtacataatcgtaaaccgttgttcatgtaaatcgcataaacggtgatgtgggtattttaagataaatgggaatgtgcttaatatacttttggacaaaggaagtatctgtgtgtatctacacaaacatttactccccgatttttgtcgtccaaaacagttcttgggctgtgttaggactttggagtactggttgataactcattcccctcacaggaaaaacaagattaattaagtattagcttaaaaaaatagattagtaagattttcaaagtaaactttttatatattatttttaaaaaatgcatcgtttatatgtggtgaatggttgaaatcaatttaaactagctctctataatagtcaatactatagattaaatgtatttaggacgtgtaattactctcagttagagttaactaaatagagtattaccatatatctaacgctacaatagtgttgttagtgatgggagtgaggatgttagcatgttgcctcccaccaactaataatgcttttaaagagagaacaatcccacctactcaggttgattatatggtggacacatcccttattaagatcaactccaaggctcataatgctagaaaaagatatgaacgtacatgtataattgtgtcgcccaagcagacattataagcaacagaaaattaaaaagaaaacatacctactctaaaaactttagggagcatttgtttgcacaaagacaatattaatagctgtaatatttaaagtactatatttaattaaacaaatttggtcttgtagatgttgaattttttttataaacttgatgaaaactaaagaaatttgataagaaaaatcaaaacgacttagagcagatacaatagcaggctattagccagctgtaaacatattttactaagataaaagatgagagagaaaagcagcagactacagatctatagccagctgtagcacggactccaagatgtaatgtgtgtatgacgtatgtgaccatatattaatagtatagtaagcaactattgtatgaattggctattagattggctatagatgaattgaagctagtagtaggctatactattaaacttgctcttataatatgaaacatttggagtaggtacgaggcaagaccactcctaagctaagggcctgtttgaggagctttcagcagctgcagcttctcttagaatctttagttaccagacgctccctaaaactgtccagctttttacccagattctgagaatctatagctatagaatctggaaaatgaactagaagccagaagctgggtttcccagtttctccagattctcacaaactagcttctcagcagctgcttcttagaatctcaaactcatccaaacaggccctaagagcaattgaaaccccacccaagcaatcatcacaaatcaattttttagcttttcaatataagtctagaagtaagtgattttcacatgtaaatccgtccccttgacgaaattgaagtacactccttgtcgtttatcgtgtaaaccatccatgcatctccacgaaaacgagaatgactatcaattgcttgaatcggatagtttcttgcggatcttgtgcaagttcggaattccatttcaaaggccggaacttccgattcggcatgtttcaccggaaggcttggctgcggtgtgctcccgtgttttcgtgcaaacacctaactagaaatccgtatgattgtaatatacatgagaattaactaggattatcacacaattttccatgtacctaaacgttcctaaccatcaaacagctctaggtatcgcatgatacttgagtatcagccgatacctactaggtatcagtcgagacctcagagatattattccgttcgaatggggtatcagccgatatctactagatatcagacaatacatgtaaggtatcataccatccgaactagatactgttctcatttgccattttagtaatatgccacttcaggcttagaacggttagaagttgctgaggcccatgaaatttactcgaaaaggaagcaaaatctgatataaattcggtgaggccaccgccggccaccgcgtccctttcatcgcgtggctttcccacacatcgctgtgtctctggacgccatgacaaaacaaaccaaccccttcaaaataaaaataaaaataaaaataataaaaaaaaacaccacccttatctaaattattattattattatcatctcctcccgctcccgctcgctcgcgccattttccagcccaaagccaagcgcctcggctcgctctcgccgcctcgccgcgcgccgcgcgctcgccatggagatcggtggcgtgctcgtgtcgctgctcttcgccgccttctccctcccctgcctcctcctcctcctcgtcctcgccgaggccggcctccgcctcgcctccctcgcgctccgcggcggccgctacgcctggcccacccgctccgacttcctcggctaccgcatcgcccgccgccgccgcgccgccgtctccggcggcgccggcggggcggacggcgaggagcaggcgcagccgacggcggagtgctgcgaccgccttgccgtggcgatgtaccggcgcgggcgcgacgcggctcccgtggactgcgtgttctgcctgtcgcgggtggacgacggcgaggaggtccgcgagctccggtgccgccacgtcttccaccgcgcctgcctcgacgcctggctcgtcctcccgcgcgccacctgcccgctctgccgcgactgcctcctcccgccgccgtgcgagccgccgcgcagcttcccgctcgactactacgacgacgacgacgacgtccacttcggcttcaacgacttctccatcacctcctccaccaccaccaccacctccgccgccgccgccgtcgcctacccacacggcgtcgcgctctggcccatgtaataaatgtaataatcgccattgctgccgctgccggctgccgccatgcgagaagccgaggagcagagtgttctctctgtttttcttcttctttttttttggtttctttttgcatagttttttttagtaattagttgctaattaatttgggactgattgcttgattaatctaatgtaatctaagatgatctggctaggtggcccatgtaaagtaatgtaataatctccaattctccattgttgctgccacacgagagaagccgagaaacacacagggatcttttggctagctttacgaggtgataggctagacgatttgaatttgaagcctcgttctttctagctatttgatactaaatctttatctaatattcacgtcttttttagcatagtattctctctgttttttcatattttaggggttttttagtagttaattgctaattaattttgggacggattgcctgattagtgcaaaagacgatcaggcttaggtggcggttgctggctgctgtcctgtcctgtcttgctctctctcccggtaaatatcagcgactgataacgatgcctcacctgctactatttctcggatcgtccgtacatctttcatctactacacgagtacatggccatatgcattcatcacgagaaaacgctgcataatgcaaaccacaccccgtcccactaatgcttcatttctgggcatatacaaatactacctctatcctaaaatataaaatattttatccacgtagaagtagtgcttcattcctgcaatcctactgatgtatatatatagcgagaaatgaagtgttatgccaattcagaaaacacaaaaaggaaacagtaatatattatttgtgagcaatttaattaaaaatatggattagataccacctaataataggaataagtttgctgggatcgtgaaagaggaagtaattcgttggatcggttctcctgatccatcctccattatcaaaggatcagcggagtcccaatccatggtggaattccccgctccatggtggataatatcacagcaaatcgatggattgacctaacctagtgtgcaaagcacgtagactaatgcaattagggtaggtggcggtgtcaccgagcgagccagccagccagccggagttgacaacaccggtccatcgcgatcacgattatgcagcccccctacagtagtaatttctccatcacagtaaaaaacaatctagaagtacctgaagtagatttgacactatttgacactatttagtactccatccgtttcataatacaagtgatcttaagtttttacttatactacttcctccgttttttaatagatg

SEQ ID NO: 48151 - DNA, 29326 bp, Oryza sativa
aagatataaatcacacttaaagtactatgagtgatagaacaactcataacaaaatagattataattacgtaaattttttgaataagacgaatggtcaaacatgtgagaaaaaatcaacggcgtcatctattaaaaaacggaggtagtatttaacaactcatcttattcaaaaaaattatgtaaatataaaaaacaaaaagttatgcttaaagtactttggataataaattaagtcacacataaaataaataataatttcaaaactttttaaataatgcaagtaaaaaagtcaaatagaacggagggagtaaaacagatttgaacagaacagttcagatttgttttgtaatagatgatgtcaaatccatttctaaattatttatttttttcctaactaagggtctgttcactttgataccactttcaaccttatcaaattttggtaaagttaacaaaaaaaaaatggttacatttagtttgctgccaaattttggtaactatataagaaatcctaccaaaattttggcaagttaccaaaattttgacaactataccaaaatttgataatgctaaaatttagtaaggttttttttttattaaagtgaacaggcactaagagagtactccaaatagtagtacagtgagtgactgtgaaggccagccagccataagcctaagctaacctaatcctccgtcgcgtagcaagttgacaaggccaacttgcccagcaaccagcaggtggcgcggccgtagcatggcgcacgtacgcgcccaccgcatttccgcccaaacgggggagctatccgtgaccgtgcgcccctatccgaagttgttaagatcattagcagttcgaaagaacgtgctaatgatcttaagtcagaaatcagaacagaacgaagccctaacatagtatgatccggaccggcatcctaacaacctcgcgggcgtgatatatcctcccagggttcacaattccgacgaaaaccgatcgaattcctcgaaatttcgacgtttcgatacggctcaaaattaggttttaattggaatttcgaaggctaaacagtatatttggtcgaaattcagtcggaatttatcaaaaactgattgaaaatcatcgaaaatcgtgatatcaatgagacttaaaatttagtggtcaaccggtaatgtgatcctccttcccgcttgcaggtgcagctcgatcgcgcgcgcacccggcaccgaagcgcagagagatcaggtgccgcggcgaccggcccggccacgacgaccaaaacatatcagcattcaacacgatcccgcgagggcgcatgctaaacaaccttatctttttctttttcttatgtttatagttatcaaccaaaatttaaaattttaaatcgttaagaacacgtgtgtgtatatatatataagaaatttataaattattttttatttgtatcctaataagcaaaaagatagccgttccccaactgccgtggcagtacagcctacaggtggtgtacctgcatatggccggcaggcgacatatccatcgccgtttggtactgtggcgtactgagttgtacgtactactactgtgtagcagccagatcttttttttcttcctaaaaaagagggacgtaacgtaacaaccgattgataaaaaactactaacctcttctgtcgcacatatattttcgaataaaccaaaacggcttattaaacaataaaagttaatttataagtacaacttctatatatttgttcgtagcgacttaaaagctaacactaaaagtaaattacatttaaaatatttaaaaatcattcaaaaagttaaattttagctttttctttggtttattagaccaaccaataaggctctatgtctgatctgatgagggaaaacaaagagcaagtttaataataaatgagctataagattatctcttttttttctcctcctctttctatctcttacctatgtatttaatgtatttatcttgaaatatatgaatagctagctattgatgagagccaaccctctttattttttaaattctcttttctccacagttggtttatagcctctaaggacgggcaattcagtttgtataccgcgtgaagccgtgaaagttgaaacagagccggtgagttccatcgtcggacggtcgccgagaagaggttacgcaaaatatgcaacgatagatcatacgttccctatcaaaatcgcgggtgttttgcttgggaaggcgtacgccgtctccgtcgacgatttaatttgtcccgtccccgcttggattcaatgttcgttgccactgatcaagaaccaataatatggtttaggcatttgcttgctcgctaaattgccctgcctcggacatcttaattcacatcgatcgaagacgacgacgaagaaggggatcagtcctgcatgtgactcactctgatttaacggtgacgccacgctgccttgtgtctagcttccctctcaatatactactactcctattcgtcgtataaagagttactcactccgtcaaaaaaaaatcaacctagaaagagatacgatctctcctagtatgataaatataaacatataatttgtccagatttattgtattaggagggatcacattgcctcctaagttgagtttttttagacggagagagtagttttttttagaaaatctcagataaattagtatcacattgaaaaagatgtcaacgtcttccattaaaggcttctttgggacacatgaatagaaaaaaaaaaatagaaatgagatgccatatgtaagcaaatcccatgaaatacaaaacacaggaatttgcaagacaatgtgtttagatagctcatagtaaaaacttggggatttggatggattttagagagagaagagagagaaatagaggaagcattggacttctcaaagcaatgttaaaatgaggtaggagagctcatgtgcaaaattcctaggaattggagtataggattacaattcaaaggaattttcctatgcttcaaacaagctagatagaaaattttccttaagatttaaatcctttgaaattcaaatccttgaaattcctatagaaatactccatttcaaaggagccataaaccccatagttcgtagtagtgactattggttgtcctgaccatgattttcttttcaatgaattcctaagcatggtttaattactctgcagatactttttaatatttattcacttcttactaaaatatagcaaccaagtgctcgaatagacaccacctaatactaatatttagtagtacgagtatagacaggtccctttatttagaatcgttgagctatgtggtatctactatgttgctactctcttcgtccctaaattaagtactaattaagtatattttgggatatggagggaataactttttatgggagagattttatatgctaaattatagtataattttaatacagacccttgcaattgattttgcagtatatttcgcacaagctagtctgttatccaagtatggacttcacaaacaatgagaccctgtttaaaagggactaaaactagttttaagtctctatcacatcagatgtttggacactaattataaatattaaacgtagactattaataaaacccatccataatcttggactaattcgtgagacgaatctattgagcctattaatccatgattagactatgtgatgctacagtaaacattatttaattatggattaattaggcttaaaaatatgtctcgcaaattagctttcatttatgtaattagttttgtaagtagtctatatttaatactctaaattagtgtctaaatatagagactaaagttaaatctctggatccaaacaccacctgattcggttgtcggttgcaaaaacaaagagaagaaaaaaacatttcccttcaatccccgtgcatttaatttccctcgtactaccaaggaaaaaaccgaaaaatacgttcccactcccacgcacatatggcctgcacgaatcgtcatcactctcttcatttcacgaaagcaactttaatttgctaaaggaaatcagacaggttcggaaagacaaacgagtttccatttttaaaaagacaatatactctctccgtttcaaaatatttgacaccgttgacttttttagtatgtgtttgaccattcgtcttatttaaaaaatttaaataattatttattcttttcatatcatttaatttattgttaaatatactttcatatacacatatagttttacatacttcataaattttttgaataagacgaatgatcaaacatgtgctaaaaaatcaacggtgtcaaacattttgaaacggaaggagtattttcctaaaacatcactttacgtcgccttattcttatatcagtgacactcaacctatccgtaaggctagaaatgaacatcatgtggacaacgtatcatattaaatctttagttttcctaagccactaccaacagtaacttgctccaccataggccagtattttgctacagagcaacagttccttccggctgcgttgccgtgtgatgctctgtcgtggctgtgatctgtccgtccgcttgccaacccgatatgcttgccctccacacagcacacacccatcaatccccaattcatgaaaataaatccctaatccatctgcttgccctctccaccacacacccatcgatccccaattcatgaagataaatccctaatccatcggagaaatcgacgccatcccctctgccccatcgatcaccagttcgccggcggctgcctttctcttccccgacctgcgttcttccccacccaccgcctgtgattgtagggttgccccgtggtggttgccgctggttatagtcgtcgtccagctatctctatcggtcaggctgccggcgcgctggccgcacccatcaaggctcccgattgttgccctggtcgagcggctgccatctgccagcctgtctgctctggacagctgcctccatcctcggttttcttcagtaagtcttttttctctatactgctctttgttgctgttggatgccaatcttgctttctttcagtttgagtcaccgagacaatgcccaggctgatcaatctttgctgttgttaacagccaaaacatgaatctatttccctatgcttccttgcgatagttaggctgagtgaatactaccaaggttgcgattttttcagattaaacactatatgacaaaatgctaatgaacgaaagatagatatgcgcttttccttgatatgttctcattttgcctgtcagtttattaaatatttgtaggccgtcaacttgcagcttggcatttggattattgcagtgctaattttgctatttattttggcttgccatattgggtcgatttagaatatatgtacgcttcagcatggcatttggtcttggtggtttgattttgaactctctgttactgcctatcaattccctatgtgcatatctttttttttaaccttctttccggtttggtgctttctttcataaacaaaatgcattatagcctcttcattacaatttgcaagtacactcacatttaaagaactccatatcaattggtcaaaaagattaattatgactagatgtgtagtgcattttatctgctttcttttatggctcttcccatatagtttaattagtattacctgatatagcaaactggccagtacctaatgtgccactttatggatgcataaatttctctttatatgtatactacttgattgctacacatataatgatgttttggctgctataaaaaatatattactttcattattatagttccagtaaaccactaattactttcataaatcagtttgaatgatgtcagtctcttctgggccatcaacacctaaaccagcttgcaagcgcaggcaacccgagagagcttttataccttcaggttagctccaagccatataaatgcttatttctacatttgaaaccattttcctattgagctctcctatttgtcaacagatgattctgttgtgccatatctatttcctagggaatattcctagcgatggcgttgttctgctggctgatgacgccctctcccatgtttgtgatttccctacaagttttcatttgccatcaaggcgctctatacgtcgaagactacttactcagtctgctggtataatatttgttgttttgatttttttttccgttctaattgtctaccctgttgttttccaaatgtatggcatttctttccatttattatgcataatcatcactaccaattcaacctaccgcagtccacatttacatatcaatttcccatgttattatcctaattcttttttgaccaaaaattgttgctcatattctaaatcaggatttccccacccggatcctgtaacagctgctcaatcacgtcgaaagcgtaagcttgctatggctgccaaatcatctagaggtttgattatattctttatccactcacatgtttatctacatgtgcactttcatgccttatacaaaagttttttttccctaacacatgttgttttctctagaaattaatagtaccactgaaatgatagagcatcggacgcatatccatgtgctacaacggaatgttcgacaacgaaccggtctgtctcagtcatccaccttggttcctatcaattgtggccatacacaaccttttgcaactgtcgatggaggtctgtcctattcctatttccacttattttactgtgtttctctcctaattcttcaacaaatgtaaccaatgatagcatgttcatcgtcgacctcttcagccctattgtctccatctcccacacatcaacgtaagtttagtcatatattagttctctacaactatcatttcatttcaccctttacaaatcatgacaactacaatgctaataatgtacagaccatttgctcatcaattctcgcggttttgctgatgtaaacctgatgctcgacatgtcaaatcagatcactcatacagtatgatgctcgacttgctgttcgactcactaatgtaattctgatgctcgacctgatgtatgtcaatcaatagcacgaaaaaaaattcccaccttttacacacacttatgtcattttcttttaattactaggcactattttctctccatcaaggcttgggcccccatgtcacacttgtccatattgtggggctttcttttggtttgaggagcgtgtccgccgagaacagcacagctcatcaccaatatacaatacatgttgtaaaggtgggagtgtcatcttacctccatataggccacccccagaacctttgcatagtctactcacaggagttaacagatcattgtcagcccatttttttagaacattaggttctacaattcgatgtttgccttcacatcgatgggtgtaaatgtcattgattctatcaatgatggacgaggcccatatgttttcaagattagtggccagctctgccatcgcattgggtcactcataccagaagaaggaagacgaccagagtatgctcacttatatatctttgacacagaaaatgagatcaggaataggataaatgttggaacctatgcaaataggagttttcgtcctaatgaggatattgtggctggacttatagacatgttcaacacccacaatcctattgtccacctatttaggacagctcgtgatagattggctgaaaatggtgatgattgatacatcataagattatttggtgatcccgacaagcatggtgatatatttagtgctccagttgcatcggaggttgttgggttagttgttggtgatgtaggtataagtgatgttggccgtgaccttattgtgcaggaccaagcgggtcatttacaaaaagttgaagaaaagcattgtaaatttatgtcaatgcaatatccaattctatttccatatggggaggatggctatcatgaaaatatcacataccgacgttgtgctcgattacaagctatcaaaagaaagaagtctactatggttgaatactttgcatataggcttcatgacaaagctgatgacttcaatactcctatgcgctgcaagagaggaacccaggcctatgtcatagatgcctattgttgtatggaagaatctcgcctgagtcactatagatccaagacatttcagcttaagtatagaacaacttcatttagtgaggtatccactatggtccattcaggcatcacagaagcatcagatgccgggcagcaagttatattgccttcttcttatattggggggggggcaagatatttatatcaaaattacttagattcagttgctctatgtagaaaatatggttgccctgatttgtttatcactttcacatcaaattccttatggtcagaggtaacacaagctttggctatcatccctgggcaacactcagcagataggcctgatattattaatcgtgtattccatgttaagctgcatctcttcatggacgacatcgtaaagaagaaattttttggccctgtcactgcaggtagtaatttaattgttcatgaatcatgacacaacatactgcacacttcatatattcaaatattttgtatgtgtcattctcacataatttttccttttatgtagttgtgtacacaattgaatttcagaagcgtggacttccacatgttcacatcatattgtggttagataagagtggtccattgacacctgctgatattgacagactaatatcggcccagcttccagatccatccattgatcgagttggttatgatgctgttgcggcattcatgatgcatggaccttgtggtgatgcaaatccgcattgttcatgcatggttgacggtaaatgctcaaagaattacccgaaggaatattatgagaaaacaacaatcctgccaaatggccatgtaaggtatgctcggccaaaaaatgatataattgttgcgaaaaatggaatttctcttgataattggcatgttgtcccccacaacgtcgatttattagtcaaatatgaggcgcatatcaacgtggaaagagttaatcgtgatggaatggaaaagtatctattcaaatatgttgctaagggttttgattgttcgagggttggtctcaagcgcaagcgggcatgtgctggaactaatgagattcatgactatttagaatgtagatgtatagcgccgaatgaggcggcatggcgtttgctttagtttgagattcattatactgatcctgctattgagcgtctccatgtacatatgccattagagaataatgttacattcacagaggatgataatctggaacagatcttggataacccacgcaatcgtgttacgaaacttacagcatggtttgctgcaaatagagaatactctcaggctgctccatatacatatgcagagttcccagaatactttacctggcatggtaatggcaaatattgggctccacggaaaaattgccgcaagaaaattgaaaggatagcacatgtttgtcctgcccaaggagatgtctactaccttagaatgttgctgcacattgtcaaaggagcaaaatcctattctgatctccggaccattgaaggacatgtatatcctacattccaatctgcatgtcaagccctaggccttcttggtgatgaccgtgaatggtccttcgcaatgactgatgcgactcattgggcacttccctaccaactccgtgagttatttgtaacattgcttcttttctgtgatgttacaaacccactgagtttatttgaagagcatctgtcttcaatgggtcaagatgcagcctaccaccttaaccatgccacactaggtataaattcttctgcaccttcagtcatacaatatgtcaagtcctatgttcgttccgagatcgatagcatacttagaaatgttggtcgtactttggcacatttccatttacctgagcctactattcaaagcacatccatccttggcaataggttgctaatagatgaacaagcatatgatctagagaagatatcgattgaagcggctgatcagttaggcaagttaaatctgaaccagagacatatatatgatgctattctcaattctttaaatagtgacattgggcataccttctttatctatggctatggagggacagggaaaacattcctttggaataccctactaaatagtgtaagggctgaagggaaaattgctttggcagttgcttcttccggtatagcatcacttctacttcctggtggccgcacgcctcattctcgctttagaataccattggacatacaagagcatccagtttgttctattaagaagaacactcacttggctcaattaattcaacaaacctccttagtcatatgggatgaggcacctgttaatcacaaacattgctttgaagctcttgaccgaacattgagagatattcttgcatccaatgatccatcacttgctaacaaacagtttggaggcattacagatgttcttggaggagattttaggcaaactctcccggttctaccctatgaaaaaaacaggaaatcttatcttcatccatcacacgttctcatttgtggcagcactgcattctcatgcatcttacggaaaatatgaggcttcaatccccaacattgtctaatactcatcgtcaacgccttcaagaatttgcagaatggttgttagcaataggggagggagcagtagcagattcttcacctactgatcgagaggatgtttcttgggtaaaaataccagagtatttgcttttgccagatgacacaagaaacctttcaggccttatctcttttgtatatgatgcctcaatcaattctcacacagccaattatctctgtgagcgagcaattctagccccaacaaatgaaatcgctgcaagtataaattcccaaatgattgctcagctgactactgaagaaatgtcatactatagttcagacacaattgaagatactacaagtaatcgtgccactcttgatgctctttacccaactgagttcctgaacactataaaaatcagcggtttgccagaccatcaccttcaactaaaaataggagtgctgattatgctgctgcgcaatctgaacccaaccagacttataatgactcaattgacttgtcgtgtgatagaaggggagataattacagggaaggctaaaggatccaaggcatatataccaaggatagtaaccacttcaattgataagaagtggccttttaaattaaagcgccgacaatttcctgtatgtgtgtcatatgcattgactataaataaaagtcaagggcaaacacttagtagagttggtgtctacttacctagccctgtcttctcacatggacaactttatgtcgcactctcacgtgtaacatcgcctgatggtcttcgtattctaattgagaatagtccaactgagcatgtgaccagcactcacaatgttgtttacaaagaaatatttaacgatctggatcaacaaggaatgcatacatgattacaggtaagtcaagcatacgtgttctacctattagtaatttgttgtgtttggttgccttgcccccaatgtgagtcctaggttcttttttctcagacctactaacttgacctgattatattctttgtgttttgatacttaatgtcaaatttacctatcttcattgtttgcaggattctttatctgaaacctctgccttgtcaaagcagcacgcagttggtattattacaatggttcagttctttcctgtctattttatgtgatcttcacactcaactttcctctaatatatgccttctggtatccatggtttcttcgtaagtttgttttcctctttttatattttgcattctgaccactaaacaagttcaatgtgaaaagaagtttacagcattttacaggttacctatataaatttgaagatccttgcattcatgcattaattgccaaaagaaaaaaaaatcttccacaccaaatctagattctctcacggctaatgcttttaagtattctatcatatttggtcacacacctattcctattaatttagtcttggtacaagttcatagtatgctataattcattaagttttccatccatatatatgtttcataacatgtcttaccacttcatttgtcatctcatcaactgtcacatgatattattttccctgtttcaatgtgatcagccacttcaacaactgtatatggatgtttcacacacatacctattttacttaaaaattaatctgttattcactatgctaccagtcttgattatggctgatgctcataatgatactataatgcaggctgccatcatacgaagaaccaagcatccaaccatctcaatgatcattataaatttcatttttccatcagcaggtgttctgctagaaaacatatcaatgcacctctatgccctattatgtaccttttggcttgcaagagtgttatacgagataaattatttgtctcactcacctgtatgcctgccatgtaaataatataactattttaattgccaactgactaccgtcatcaattcttttgtccgatgaaataacatatcttacatatattatatgctttttagtaagtaaacttccagtaatatttttgttgtcatgtgaaatattaaaaatatatgcattcacatttatattaacgacaatgcagtttctaatcatatcagctttgacgttggatttatatttcaaaatctacatgaataccttttgtttccgtgcttcactccatgcttataataaccaattttcattatgtcccgcggcaacgcgcggggcacatactagtttagtatatacatcgtcaagattctcacgtagtccttccatcctaaaatatttttagacgctgttaactattttaaaaatatttgaccgttcgtcttattcaaaaaatttaagtaattattaatccttttcctatcatttgatttattgttaaatatacttttatgtatgcatataattttgcacatttcacaaaagtttttaataagacgaacggtcaaatatgttttaaaaggttaacaatatcaaacatttagaaaatgagggagtattcggtatggtcctagatttacacggcgacatcctagatttacatggccctttttcgagtttttaatttacgtgtttggggtatctttacaacaaaaaaaaagtcacaaacataactcaagcaaccgattagtctcgccctgttttagcatactaacataatttgagatcttatctaaaaaaataggaatttcaacggagacagtttaaataggaatttttcaggaaaccattacaaaagttgtttctacgtttgggttcatcccctcataattccacctcatcagtgcgtgtgttcggccgtccgtagctgttcattgtctatcgccgtcgtccatcatatatatcgtcagatggacggcgatgggggtgtaaaagagtgacgctgaacggaggagggtcctgtgcgttaatgtcagctacttgtcttctcctcgaggccatagtacccaagctcatgattccgcagtgtcttttatcaccattttttttcttcgggcttgttcactttaatgccaaaaaaaaaccttactaaattttagcaatgccaaaattttggtatagttgtaaaaattttggtaacttgtcaaaattttggcaggatttcttatatagttaacaaaatttagtagcaaactaaatgtagccacttttttttgtcactttatcaaaatttggtaaggttgaaaatgacatcaaagtgaacaggcccttcctctccagttactacctccacctccgttcgataaaacaccaacttctgactttaaatctagatgttggttttttatgagattaagagagtaattagtagtagtaaataaaaacagtaaaaatcaaagttaaccggcttggcgacctagaattattaaactgagcggagattattaatttgtaagttattcataaactgattttgcatgcggggtccgaatgatgtgcagtgcgcatgaacctgaacatgctcgtcgacggtagagctatttccccgacttttctaactcaccatcatcgttttttgcgcccactcttttcaaacggctaaacgacgtgttttttataaaaaatttctatacaaaagttgctttaaaaaatcatattaatccattttcaataataatatatatctataactaatataaatatttggatttttcctgtcgtcacctctcaatgatcgctgtttttgtccgatcatgcgacaaaattttcgtccgtaatgtccgactgagcggcgcccaatttccatccctaataatgtctgactgagcggcgccctccctctctgcgtgaacgcaatcgtgtacggtggccaaagaaaaaatcaaagaggatacaaaatcctaatcgtgtatgacaaatcacaacatcaaaaccaaccgataatcctagaaaatcagtttttcattcactattacaagatcaacactacaaaaattatgaaggtggaagcagaaacacacaaacaaatcctagatccctaaaaaaaccaattgcagcagctcgcgatgcggcaaatccaattgtgaccaaatcagcccaaacatctccacaacaccaatggagagcaaatcgggtaaacaccaaagatccccataaaaaaggccacaaatttccaaagaacatcgctcatgaatcctcttactaaccatcccacgattgatggaggaagagaagcaagggtgctcgagtgaaagcaggaggaaaggcataaaaaacaatgttggatctggaccggtcgccccgcgcctcctccttcgtggaaccatcgcaccgtcctcgccatgctccctgccgccgtgctggtccccagctcgggggctgttggatctagcccccgccgccccgcgcctccttctccacctcatgagagaggagaggcctcgccgcacaggggagagggaaggagaggcgcctgccgcggcgcaggggagagggagaggcgtatatcccagataaaacggacacgtatatcccatatatatataccggttttaaaaaaatatataaaatattactggtgccaacactcaacacttttaatgggctacaggtgcgtcacaaaattttcatctgtaaagtccgactgagtggcgccctccatcttcgcacgagtgtaatcgtgtacaacggccagagcaaaaataaataaataaatcttaatcttaactaactaaaagattaataattttcctttcgtcacaaatttttggtccgtaaatccgtacgcgtttaaccgttttaatcggatttcatgcgcgcaggcctagacagagtccggagctagcctggagtccagtacaagcccaaaatgcccaaatacgttcgcacccagtcacaacatatcctaatctgttttcttttcctccattagtttgagagaaaattatatttgaagtataggtagatgatgcctattatagatggagtggtagctggtttagttacgttctttattatatggcgtccccacatatgtaagatgatacaattttctctccataaagcaaaattcaaacaggtaagacagatcgcaacgccgcgagacattacggatcacaacataagacaaatcttatcttaactacttaaaaatttgtaattttctgttcatcacatcatttttcatccgtaacatcaatttttttgtctgtaaatccgattgagatccaatcagacaatccaaagaaagagaaaacgaatggaaaaaaaaaaacccgcataaatcttatctcaatctttgtcaccgccagatccacccacgggaagccactgtcaccatcggattggcctgtgggaagccgcgtgccgtcggcgccagatccgccatcgacgacgctcgcgggaagtcgctgtcgctgttggatccggccgtgggaagccgcggagggcgccgctgctcgcggtgggggacggcgcagcttcactcgctcgcagtgggggagggcgccgccggcaatgctcgcggtgggagggggaggtcgctaccatcgccttttgagatagagagagagagcaaggggatcgggggaaatgatattaaggttagggtttgagctgccgaatatttatctaggtcgggatcaatcgggaccgtccatcagattggatggccctggtttctcccgcgtcaggtcgggcgttgttcccaggccacctagctattgggccgcatatcctttatattaagttgtattatttatatagacagattaatatatccagtttaggggtttttttttggcagaagacttgttttatgcagatatccaattggacaacgtcatttttcaaaaaaaaaaacaaaaaacaaaagtaccaaaacagtgtgaaaataacttcagttaaaaacaaatatttttagttttaatacgccgtagcgaagcacgggcattttgctaataataataaatatttaattaattataagaaaatgtgtcaaatgttttgcgtgcgggacctcacctcccagccccgtactatcttgttcgaaacagaacgtgctgcagcaaaactcttggtttacgtacgcggacagcagtgcagttgcaggttgttacgctttaagaaagtacgatctcatacatgataacgtacctaggcacagtttggacttggacatatatgaatatttgtcgatggtttggacgtttggaagttgtgatctgcaacaaaagtaattaacaatctaccgcccgggcaaggttttttctagtgttaacaagaagagatgcgtaaaagaatcaacagctatatgtacatgcttgtttggtttagtcgtaccaataccaatatcaacacctaaacatgtttttggcactatcaatattttagtagggtccgtagcattctaagtaagtgaagtgggtttaaattgatactaattgagagccaagttttatcaaattaagcatgagcaagctccaaaccaaaccatcatatttactactccctccattctaaattgatctacatatagttttattttagttattcctaaatgatctatacatttgtgatcattcattaagtctattcgttatttgtgtattggagtaaatggacattgatgcatgcatccatgcacacaagtatttataacccacatgcaatatcttgatttgctattggctagaaaatagtgggggtgatgcatacattaagtttgttgctagagttaatatagtataaaaaagttcttagtttttcttgatcttagtgtacctatgaaatatgtagatcaatttaaaatggagggattactccacattttagtatcaatccaaaataatcctacatcaacgaaggacagatcagggcgtaagattcactccttttcactctgtagtcatccaagagcatatgcgtgtgctcttgctaaatccaaaaagaaaagacatgcgtgatcaacaatcgagaacgagagagagagagagagagagagaagaaaccgcgtgcccgattgggccttctgccgactgctcggcctgttccggtgtgcgatgccgcggtggcgtcgagcgtgcatccacatccaattatggaaaaagtccactttcaatccatcggctatgggcttacgacccatgcgccgcgccgatgaccgatctgcttgcggcgtcactgtcacaccatgcataccagccaccaccctgactttggcctcgtcccgacagcatccgtgtcactattcatcggcttggtgtatctccgtcctaaaatataatataaatattttgtatcaaaaaatataagcatttttaaaaattgatatagatattaaaaaaatgattgaaaaattgttgtgatcggttgataagacaaaataagataaaataattaaatggataactattgtgatttgttgagaggaggggataggtggagaaatgtttttttttttcagaacagaggcgccagtaatttttagctgagacggtcgtgcattttgtttgcttgcgtgtgtacgtgacagcaccgagcagttgccgactaacttgaagccgtgaagcgagtgaagctgcgaaacatacatagggaaacagcatgctctcgtgaggagaagttgacttgagcaaatcaaatggtcctatacctggtttaattccgttaaaaaaaatggacatcggcgttggccgccagggtttatggacaagtcaccagatacgtgccgtagcggagacaagggggagcggctgcgagacaggagctgggtggtggccacaacgggcggaggactaggccttgtacaacgctccaccgtggagtgtggtcttagaccttcacgtcggattcgtgtgctcgtgacagtgagaaccgtggtcttgcgatgccgtgcgtgacctatagaggttccggtggtctcatcgcgtctcagctcaggaacaacgacgccacgacctggaaccacgcgttggatgagtccggagagaaatgagtggcttcggtgagagaaggtggtccataagggggaaaaggagaggggggaatgagaaaaggttggtgcacctgagaaaatatcgttcgactggaatagaaaaagtatgtttggtggcataacatgcccacctggattcaagtgcttgcatttacgactatttattgttttaatgctagacgatatactcagtggacaagttaattatggtgacttcattgatataaagatatatcggctcagtctgtatatgagtgtgggtgtgagcatttatagggtgagtttgtgtgtgtttatatgagcaagtgtacccagtaatatatggaatcgagaatacgaagtgttgtgctccaacaaagtcatggtgtccgtatgaattgaacaccggtactagcccggttttgtggactacaaaatgaagtacagtatataagaaaacgctacaacacgccggttcctctctagtactggagtagtactccctccgtattttaataatatatgacgccgttgactttttgacaaacgtttgaccttttgttttattcaaaaaagattttaatgtatgacgccattgactttttgacaaacgtttgaccttttgtcttattcaaaaaatttatgtaattataatttattttattgtgatttgatttatcataaaatattctttaagtatgacataagtatttttatatttacataaaaattttgaataagatgagtggtcaaacattgattaaaaagtcaacggcgtcatacattaaaatacggttaaaatacggtgggagtactacctaacatggaccgtacatcagctgaagcacgaaaaccaccttttgttggtacacgcccacacatgccgcagccgtcaacgggtaaaccagctgcaccagcaggcccctgatggccaggccagccaccatttgaaaccaattgaaaaaggcaaaattgccaatattcaaccagcctacttttgttgatattgcggaggaggggactaaaagtttttcttttactttgtgcatgtacatagagtttttgaaatttactcaactcactttgtactcaggactcctttgaaacataaaataaaagatacaaataaaaaaacacaggataaaaggtcattctgtatgaaatcctataaaaattaaaaacaaaaatttatcaaattggtcgtttggatactccacataaaacttataaagactttagagaaaaagtatcatttaagtagagtagagttaatagaagagagatagagatatggtatcttggactttcggtagtacaagttcccgactcctccttctcattttccgcgtgaacgcttttcaaactgctaaacggtgcgtttttttttttaaaaagtttctatatgaaagttgcttaaaaaatcatattaatccatttttttaaaaaaatagctaaaacttaactaatcacgcactaaaacgctgcttcgttttgtgtgccggctcccgaacatagccttaaaaggaattcaaaacttgaggtttaagctcatgcttgaaatcctccaagaagtggaggaaaaaaaatattcgtccgaaacttttccaaccatcaaatcctacaaaccaaagggcattgaatccttagaaatcctatgaaaatccctcgttccaaattaacctttaacattgcagtttgacatactgaagttcgtgattaattttggatggtttatctatatggaaatttagtgtaaaaagttgtacttcctctgatcaatatgacgttgagtgtccaagacatttagccagtgcggagtagtatacttaataaaaataatgttggcggcataacaaatcaatgtgtattaataatatatgacatcgagaatacggagtacaccctccttttttcatgttacttatctcttagctttgtccttagctaattatttctaactttgacaacaaatttttcaaaactagtatagttttttttaaagaaaacgtatagtttaccatcatgtaaattatacattacgaaaatatttcatatggtgaagctaaaaatcataaatcttatcattgaactatataatttttttagatattagtggacaaatatacacatatttaatttaaaacaaaactataatgactttgtattaacactatgattgtagtacgattgagcggctcaggcaccaccctggttttgtggactatgtaaaaggaaaaaaaacgctgccacgccgtttcatacggagtactacggaagtaccctaacatggatgtaccccttccgttgggtaaaatctaaatagtgctcgcgtactatttgtccttagggcatgtacaacccacagataggggttcgtctccaagaacctcgaagttatcatccagacagatataaagacagctcatacaacccatagacagaggatctgtctgtaagctgtttaatgcttttgcatgtagctttgatcaattgcaaatacgtttgtgtataccattgtgtggctatatatttgaaataatactatcaagcatgaataagatacatgattataataatttttaggaaccataaatataataattatattacaatgcctttagtctaatttcgtcgccaaacttttcaatcaccccttcagcaaattttatagtataaaagtgaggcttgaattcacgttcacattcacagaaacgggcatgcacataactgaagcattcacataaaggagcacatatacataatgcctgtaactgaagcatgcacattcacattccagaaagaaactgaagggtacattcacattcacataagcaaataagtcctctcggcactccaacaaaaactgaaactgaagcatgcacattcacattccaacagaaactgaagtgcacattcgcatttacaaatcacattcacattaattcagaaactgaaactgaatgagacctctcggcactccaactgacctcacaggatgtatatatctcccaggatgtatacctcccagccatgaccacaatcaaatcaatatttagctcccagtatatacctccaatgatcaagctctgaatttatttcctaaattttccttttctgatcatttgcagattctctccgcgcgggatcctgccgcgccgtcgcctcgggacgacgagctcgtacaacggtgctgagcttgcctcttccgcctcggagcacgggtcgtcgccgtcgcctcgcgagaggacgcagctcccgtcgcttgactcaaccggggggttttttttgcataaaaggcatcacaaagacggggcaaaaagacccgctgtacgtgcccttatcccgttaccctttcgtaagccgtccaattagttaatggtagtcgagttacgaacacgtgaccatctaagaagcgagtctattccaatgtcagacaaagagaactgcatgccatccgccagttatcacgtcaattaacactactatttttttatagaatctttcattacttatatattctagacaatatgttatttttaaaatatgtttgaaccattatactgtacttaaaatatgtgacaaaacgaatctaatatcaaatatgttaaaattatttaaattttgttacttcctaatgagttactttcttccaacagtacagttatttctagtattttgaagaccttgtagcattgtagttatttctgcacaccataaaaagatacttttctctagcagtagagttacttctaatatcttatagagatatttctaattttaagagttagttccctgtaggctgtaccagtgtaggtacttcaaataccatagaaagttacttctgttctttcaaagttacctttgtaagcagtgtagttacttctaggatcgtgaaaaattactccgtacatgatgctaaattatatatgtatttttaaaaataacatagagatcactttgaatgaagaaagtatatgtatttatttgaaaatcgtccgtacgttttacttgtaaatttactgtaaatagcctcacgatataataatttgtagtgctataaagagttatttatattacagagctaagctacttctataatttaattaaattactttaaaattgatatatgtttagatatactcaacactatacttgttttatttgttatatattttgagtgaagtgtaatagtgcaaatagctcttaaaaatactatacggtttaggaaatataaatcattaaaaagttttaaaaagatatagtacgagagaataatatattgctatttttaggaagggttactcgttgacacacggcggatgaggtggtcgctctgtttaaccatgtgctgtgtatagacgtgtcccttttgttggtacacgcccacgccgcagcgcagccgtcaacgggtaaataaaccagcagctgcacgttagcacgtacgcctgcacctccaggcccccctgacctgtccccaaccgaaaaggcaaaattgacgcccaaactgcccattttttcatcgagaaaaccagcagctaaggccgtgtttagattttttttcttcttcaaacgttcaacttttccgtcacgtcaaatattttaacacatgtataaagtattaaatatagacgaaaaaaaatcaattgcacagtttacatgtaaatcgcgagacgaatcttttgagcctaattacaccatgattttataatatggcgctacagtaaacatttactaatgatagattaattaggcctaatagattcgacttgcagtatatatacgacatctataatttattttattttattattagtataaatttaatactttaaatgtgtccatatacttaaaaataaatttgccgcacaaactaatcacagacaataaagtgtctcggcaaagccaaagcgcggccgttttcccgggtgccccacccccaccccaccccaccccggcccgcaggtttccgtcccaaaacccagcggcgaccgaccctggccttgccccatgcgtcgtacagacgaaaccgcagtcagtgccgccaccagctgacctgcctgaccaaccaagccggcggctattcatggcggcaccaaaataccacccgccgcccgcccaccgtacccgcgcgcgctgcagtcgcggtgcgatatatagcaacccccacttgagctagaattcccaatccatccaaacccaaaatcggaggtagctacagccgaatcccccaacagttgtgtgcaatttcttgcttgcttggttttcttttccccccactcggatcgatctcgttgttgtgtgaggttttttgagctttggtcgatggcgtcgatcgtgctgctgctgtcggagctgctcggcggcgagagcaccagcgtaatggcggctgactggtacatgagcggacacagcctccgggagttccggcccgtggcggctgctccggcggcggcggcggcggtggccaagtgcgagcggccggcggccgaggcagcgggggagaagaagaaggaggagtcgttcgaggatctcgccgccgtgtcccggatcgcggtcgacgtgatgtggccttagagcatccgtcgccgccatctcgccggagaagaagaaaaagaaaattctattcttgagttttttttctctatttttctccttttttttggttgccaacgaggcatgtgttgtgtactgttctttttgagatcagatttgtaaatatacgaagtgattcttggatgtttttcatgtcattttgtcatcgattttctccttcactcgtttctttcactagttctccactctttttcattccgtctcaaaaaccatcacgattcgctctgaagtcttaacctaaatacgcacttgcttcttcagacaatgcagttcccgcatccagattgcttcataaacattgcagatccttttattcccaaatataacatcaattacaatcgttcgcggtacgcgtcgaacaacaacaatttctccgctgaactctcaagcatacaagagcaagcagatcgccagacactctgacagagagagatgctacgccaagagagtcccggccatcacagtgacagcttctccctggatccggactctcctgttctcgccgtccagctccaagtacaatgttccactccttggcgaagcctgacgaccatggtattgtgccgtttgtacttatcttttttttttcagaaaagtataatgttggcaacaattgtttaccccctacttgtcacaagaaggtagcaaaaggataatacctgaaacgccgtaagtttttgtttccccagctttccaccccagtaaggtgccagaacacaatgtgcgcttccacacacaggatcctgtaagagtatatccgagttgttagtgttttaaaagcctgtgctaaaaaatatactacgagaagtttcaaattttggtcgataaggggcatagagattaacttgccaagttataccaaaagtttctgaacactcaaggaacgatacagccatacagggaatcgtcataaaactatcaaatgcatgataacaagtttatggaactgtcacaagaaatcatgaccaaaataaatttcagtactcagtcaaattcacactttggtcacttcacaagtctatctaaaatgatgtttttttaattactagttgtcgataaccccttgactcaccttgaggtattaagaggttctgattctttggagagattatatcagtcatctctgcatcaatgccaatgtttttcacctagtgtggtaggaactaggaagattaaaactacgcataaaccagaactgtagagacttcaaataaaaaacaccatattatatagagttaagtattgttttcttttatgaaaggagttaagtattgtagtaatcatgcaaggtgtaatcaatttatgtctctgattgatgaaaaatagcttgtgatgatttaacaattttgaatttagacaagcaacattggtaacatcgtgacagcagagaatccttctgtacccatgcaatgactaaaaagtgtaccacatatgagattatatctacatattctggaactaaaatggccatttttaacttaacaagccacattgtctgcataaaaaacttggttgttgggtggaaagaatcggcatacctcatctatcccaaattttgggcagaagaatcgtgaaaagaagtcataatcagatccagcaggtgctggtcccgtaacaataactcctctaccatcacattttttaatttcattaatgttagggataatatcagcaacctcttttccggaagaaagttccacctgaaagccatgccagaatcatttagtactaacaaacaaatgaacaattccaactccttcctctccatcttctttttttaataaaaaaaatccattataaattttccatcttttcagaaaagcttaccaactcctcatttaatattagcatccttaaaagattagcaattctttctcttagggaaataatcgtagcggtagcattgccatggttcatgacctccattttaatctttgaacagacattttttaatcattgacaatgttgactcgcctaattaaatttggacaaataataatttcaaagctattctactttgtaggctaaaaataaaattgtaagattcattccatattactattttcataacagtgcagagttcagagtatttacaaatttattaccaaaaagtagtggtcaaagtgtgtataattcaattgatgttgccaatcattttaaccaaaaaaaaagacatggtaatatccaaatgtactagttatgaaggcaacattcagagcagcatatatcaaattttgccaaattttgccggatgttgtaacttgtattaaggggatataagaggaagtacgatgaggtcaccggcggttgatgatttccaaacactgacgactcgggcgccattcagagtctccggaatcgacagcgtctccgcggaatcgtactccacgagatcgatcatggggaaatccagctcgatgaacagcttctcctcacccgggacgccgccatcgttcgccggaggcggcggagcaggaaccttcttggcggtcaggatgccggacctcgtcacgaactcgaccatggcggcggcggcgtgctgctgcttcgcgaggacggtggtgaagaggaagtgggcggatgccagcgtcgcgtggccgcagagattcacctgaagacaacgacgacgacgcgtgcggatgaacacaggggagacgagtaagaggaaacctagggttggggggaagggggaggcgacctcggcgacgggggtgaaccagcggaggcggaaccgcggggcggcgtcggcggcggcggcggaggaggaggggtcgcggatgaggaaggcggtctcggagaggttgaactcggctgcgacggactgcatccaccgctcgtccgccgccgccgcggcatcctccccttccaggaggcatacggcggcggggttgcccttgaacggctcggccgcgaacgcgtccacctgcgacgaccgcgccgccgtggcgccaccgacacgtcagcgtcagcatcagcatcgcgcggtgggtcaacaagagaaagggcggatagtgtactgaccacggcgtactggatggcgttcttgaccatttccggcgaggcggcggcgacgacgacgactgcggcgggcggcggcggctgctccgaattcgcgcgcgtgctgaggtggctgcgcaggcggggcacgtttgtttatactttatagagagtgaccagtcgtgctgcaggtgaatgctggtgctgtgttcatcagcactgacgacatggagcttggcggcttatattccttgtaggcactgccgcaccggacaagtgtcactgacaagtggggcccatggacaagtggagccctcggtgtgggagcagttggaaagttacaaatttggaaggcctctcaccaatcacaaaaattttgaagaaaaagttgggaactaggggtgtgtttagttccaaagttttttttccaaacttccaactatccatcacatcaaacctttcatacacacgcaacttttcagtcacatcgtctccaatttcaaccaaatttcaaactttgggtcgaactaaacacagcctagacaaggcctaggtgactggagacagtttaatactactagcatatactcctcccataataccaaaatatagcaacatggtattatattaaaacctacttattcagatttgttgtaatataatatactatatcatatcgaatgtatttactggtgagagtaacttggtactagtagaattctccattcagtcaagatggaaaatgatcaatcagttcggctcccatgacaaacccaatagccaacttcatcatcagttcttcacctgctcccttcttttttctatcctcatatttctgaccagctaaaatgatagtcaaggacagagctcaaccaaccaatttggtaatccagttgaagttagagctcacgtcaatgctgacaaacatgttgcccggcaagctgatttgtaacaggaaaacaaatattctgggcgtagcaaggcagactacaaacatctttacatggatactcgagtagtcagttttcgtttatttactacagcaaaagcatgcatgctgcatgagaaaacaaacaacgacagaatttcgttactcggatcagatttggtccaagatcacctcggcaccagaaaccttgaagtcagaaggagctacctcaacattgaaagccttgatcttcccatcgtcaacaaaggctgaccacctaaaacggacagcaatacttttagaagagaagtaagaaaaatctatccattaaccagtcacatttcacaatctcttaaatgacaaaacatgtaaattacatcctcaaaaaaaaaaagtgtaccacagcatgagctgtccatggagattatggaatggcatttcaggcttagccaaatgcatacattgtgtcaccagagtactatttacaacaaatgaaagggggcacacaaggaggttcaaaagtgactcaatgttgaatgatgttcaactttgcggaatcacgcaactacatattccttcacaaaaaaacatgcaatacatgcacctggtgaaccataattatgttccaaatatgcacctcagctcttttgtttgaaatttcaatgcacccatagatagttgtgcagctaacaagggcatgctaaagtgcgacacttaggaagtggtttggattcatttattggagtcttttgagaggttagcctcagtgcagtaaattttgtcacaacaacagcaaaatccattggaaatcgactgaataagactcacacttaaatcatgtataggcatgtgcatgcagcttgaagtaattgatcatttacagtcatgaatcatgacagtttaacagtagggaacatgtgtagattagcaatgccgccaatgcagaatgtccttgacaacataaaacatgctcaaatatgataatgaatgcaatgcactttgaagggtaaagctacagtaaggaaaaggagtacttgagttaacccatggtaagtaataagtttaacacaatgatttaattaaacaaataaagcaaaaggcaactgaaatacgttgttttatgttcaattgtaattatataaaacaggcagcagttttaactttttaaggacataaaccaagttaaccaaagtaaaattcattgacctgtgggaacggcggccaagcaaagcagcagagaggtctacttccaaatccaagcttgagtattctatagtgtc

SEQ ID NO: 48152 - DNA, 15469 bp, Oryza sativa
cattgccctttgctcattttaattggttaaaattatttccaaggctctgaaaattccactaaaaatcctgttagcatattttgacatgtagaatccaagaaaaattccacatgtcgattccgattattatttgcatttgttaattagggattcatctctaggttaaattaaacaatttcttcggacgatttattttatgaatttagaacaagggaggggaaccttagggcgtgacactaggtttcctcgttccctgcgcggtatcctcgactgccgtcgtggtgtggggttgaggggagaggaggcagcaacagcgataaagcagcaatagaagctagtgacgggggagagcaaggggaggccaaggccgatggtgggggaactgtagttcgcacacaactcttcccaccgccatggtcatctacgaagctctgtcacggccccctgctcaaaggcaagtggcaacaacagtgatggcactggtgcgtgagtgtagccatggcgaagccaacagcagagggagctcagcagccatgcgagagctgggcttccactggtgcgtgcactacgcggtcaccggtggcgcatggtggcaaagtcaatgccactccaatgtacatgagacggaaggagaccctaggagcgacaatgccggtgtcgacgtgtagaggggctcccccacaagattcagatggtggtggcagtcaatcaatcagcatgccctcttcccactcccagattgtagctgcaaacaagatcaagaacaaaattacaacacaaaatcgaagatcaagaacgaaattacaacacataatcgaaaatgtagacgacctaaaccctaggatttcggttcttttaaggggtccgaaaaaaatggctgctggtcaaatattttagtcaacagggtcaaaatcagtcaaaattcctaatcctccctaggtggtgcgctgctcgctggagtcctcaacagcggctggaacgacgaaagagcgaactcatcgaagaaatcgatggcagacacaacatcttgtctcgcttcaccaacacggcacgtagcagcggagcgggcaatccctgcatcgatgtggcccacggaggttgagcgagtactcaagcaacatcgacaaccacagtctcaggagacgtcgacgacaactgttcttcgttggcatcatgggcgacgacagctcaagttgcaggtgtattgtgttctaggcagttatcctcgttgtgaatcatgcatgcctcttctgttttgtcgccgaagtagctagaaacgacgaatgtcttgccgaatttcctcatttttgttatttttttcaatattttgttcgaaatttccaaaatttcgttgaccccttcccctcagcgaggttacctcgccccaatgccaccgagagaagatgaatcaattcttggtgaaatccgagagtgagtttttgatttttgttcttgattggattaggggattggttgcatttgttcttgattttaattttgtttttgctcatggtgtatgtcatataggttgatgaccaggttaatattttcacgcaggagtcaggtcaattgaaacagccatccactatttgccactctcttagttcctatttggatggttagtccctcccatccaaacaaccccttagatatgacaaatataacttactgttaagtaagggtaaatagtacatgtgcagtctcaaaaggtatgctaggcacaataaacaaattagtagtactagtacgttttcttttatctttttaatcctgacaggaactggttgatcactcaaagtataagtatatatatttactttcggatagctggtattccttggttgtctcggaaaaagagaaatcctctatatttgtggataaactaatggagcaaagtcccctatatttctagatagagggagtacatcttataaatatatgagagctcaactatcattgacacatgcatggtaaatatttgacaaataattaaatacccctccaaagctgatgagtgacttaattctaccctataattcaacaaatggttttactcattcatcattcatcatatcatatatccaatggtccaaaatcaattgatgaagtcgatcggacggctccgatcgataacaaatgacgcccctccctccctccccaccagtattgcgcaagacgcgtccccaccccgctcgcggcgcagatcgcgcaactccccttcaaaaaaaaaaaaaaactgcaaaatctcaatgaatctttcgccgtctccgaggcttgcacaactcttcttcctcatcttccgcggcggcggcggcggcgccggcgacggccatggcggcggtggcggcggcggagcaaagcgcggagcagttcaggggccaggcgaagctcctgttcctccccgtcgccgacgctgtcccccgcctttcctccttccgtccacctgccaccgacgccgccacccctggcagtgactcctcctacccgacgccgacgtcgattcccccgccgccaacgtcactgccatcgacacctactcctgtggcagtgtggaggactgttgcttccgttgataatgcatccccgccatcgcgcctcagatcggggacaccgacggccctcatgccgaccgcgccgctgcgcctccagatcgacgctgccgacgcccatcacacgcaccaccaggtaatcgtcgtgccgcgccgcatcccgcccctccgccgtcgtcgcatcccgcgaccccggcggctactccgctgcaacccctgtgcggcaggcgaccccgatggctcctctcgtcaccaccaccgctgtcttctcccattgtataggtatccaaactgagattgcttgatccagtgattgctagagtgttgattgatgaatggcattttgtttggatgtgtgtattgctgtaattgtgtgctgatgatttcatagggtagattatgaataatgtcgatttatgttggtataacacaaatttttgacttctgaccttgggtaggaacagtaccctgtggatgccattcatcatatttacaactgtctttgaatatgccacgtcttttcttgcatacaaaatcttatagagagttttgtagtgctcaatttttcacttcttttatgtttgtgagaataaatagtttagaggattatgggtcggaattatattattttttatttgtttctctgtttgccactgtaccacctatgcatgattaagtacttatctaatctgttaatgtacagtcaaaatgatgtgtagcgtttatgtaataatcgagtccatatacaggagatcaatatatatttctcggttttggcgatgtatagatagatcctatatttcttggcagcaatcatctgtttgtcttgccttcttcctcacactccacatgtaaatgtcttgattttagtgtgctaggtgctcaatgaaattcccatgtgaacaaatttctgtttttgtctatcaggctatgtgttcatcaaagagaacaaagggaagttagaaattagaaatagtacagttcctatatctagcaggtgtgatcttcatttattatttcattctttgatctctattgtaaagggttgcatcgccacatttgcataaagcgaaatgtgcactgcagtatgtagttaagtgcttttgagcaatttattattatttaggctttactttgaatgccaacaaacctacagctgtatcatggctgatatcaccaacaaattactgctgccaaactacaggagaacaatagatgataagctgttccaaagaaaggttagctagcaagtcaattacatgattaacaatacttattactgatttgcagattaattgatacataggttgtcattatttctttgctgtgtatggaaacagaggaatgcccatacgctccggccatctctactatatctgggatccccatcgcgctcctccattcgtctccacagcttctcgcccctcccaacccaatctctaatcatctgaatgcgcgagggtggaagccaagttggagaaacgggaaagggaggacgatgacagggaagttgtcgttccatgtcgacgagtgacaagctgaccgatgcattccgccagctcggcaaggctttcaatccctaggtaccgcaccgaccatcaatcgctactacatctggtctgggggaattttttctccagtactcgagtatttctttagctttgattctagcaagcacatgcggttgaccggttcgaaagaaggatcccatgtgggtttatgtggcataggaaggcagtcaatatgctgttctgaatatgtttgagatgggattccatcatctctccattttgatacacttttcggcctcttaaatcagggttagactcaataaatacaatgtgttaattatctaccgtgtaatttgaaggtaacaagactaattcacttcttcatacactgatacaattccttttttaccaaacatggtaaacttgttagctcctgatgatatagaaaaatatatagttagtctattgtattttctcatactaggaggtataatagatcaacaagtttaccttaatgatgaaattttccatgtttttgcttcatattattcagtagatgtttaacaactaaatttcattagaaattatgatgtctgaattttggactaatattaggttcctggaggtattatgagaggtttcttcctaatggtgttgtcttcgagaagacatttttcctatgctggatttgagcaacaaccaaagaagttcgtaagtccaaagattcgtttgctaaacattgaacaagaactgaaatatgaaaaagaaaatgcagaaatcaggtatgctagcagaatccaagcactatcagtgttacctttatgtgtagtcatatttaaatgcaccctcggttcttcccctatttctaactgtattcttattttatctaggttgtctgatcctctacaatgccaataaatctttgatgctgaatggaatatgatttatgacaaagttggataaatgtgtgaaaaagtggggcaaaaacagtcctttctcggttggcaattggtggtcttgcaacataggtatgcatccagttgcaactcattcttttatccagtattttttgcagatgacgatattttcgtgctgtttgtattactcttcagacatcaatgaataatggcattgatgaggtaaccatgtttgttttcatgtttttaggttatagattgaactgagtcgtaagtatggtgttgatagctattttggcaacaaataagctcaactatagtgatcctttctgttgaaaaggaacttgttttttttgcgaattttttgaggtaaggcaagtgggcaatgaatggttcaaatattcagtggttgtcctggtcaaacagcaagcatagtcctttgtgacagtggtttgttgttacagagatttgcacttgtccttttgaatgctggagctgcagtctgcaccttcttaaggtgatagctctatgccctggtttcttgagatgtaagaaaatttgttctatagccgtcagttattattgcactgaattgcatttattggagacccacctgattaaagactgtgatgagcaacacacatctttttttcggtcttgtatgattggtcagatgctaattgaagctttgtttttttttcatgagacataattgaagatttgttgtgctgctgcatgtctacaaaacatagaatataaatttataaatgggacgagcaaaatgcctatgctttgctatgggtagaagaaaatattctaatttgtcatagcaaaattttttaatcaaatatgttagtatcacttgattatattagttcatgcttttactccaaatagtagtacattatcttagtattttacattttaatattaattgtataagtttctaaaaaacaccaaactcggttggtatagccgtataggtgactcaaagcaacttaaattgagaattcaatctttatccatgtataaaagaaacaatgtgtcctataaagtataacacacttggtttgtatttctatcctgtcgtaaaaagagacataagttctagctactactccctccgtcccaaaatgtagctatttctagcacagtgtctcgtcccaaaatgaaactatttcttcacctacctcctcctctcaaccaatcacaaccattcttcttcacctactttctcttttcaaccaatcacacacttcctccaatcattctcacatactttcttaatacccgtgccaacctcaaaaatggcttcattttgggacagaggaagtatttttgtttaatcatgaaatagaacctttctgagggccaagcaagccaaatgggactgcaccagtggtaagatgaaagtttttccttattcacatcaactatctgatttgcatttatttttgttcatagagattaaatttgttccaagagagtgcaaaatctgtcatgtagcatttatcgttcgacaacatataagttggatccgaatagatgatttagatcttttctttcactactctgctttggagcaaataaatatttttcgtcatcttgttttgtttgtgctatgacgaagtgtattatcttcttgattttcttacttgcagtgtcctattgttgttaagggcgacaacactcttgcatggatgatggttcaatggaaaaattaggaattgcagcaccgacaaaagttcacctattgcactggtgcaattttgtaattaagatattgtcccatgatgaaatgcatgtttgtactgtgtgacgattttaaattaaatgtattaccatgttaatagtaatgtagtattaagggttgattaattatttttgtttgaaaagtttagcctaggtttggtaaattgaaatttaccatgttactatgacatgtatgagaatttacagattattttttgggccaaatatattacaatatatatcattgtttggtttttcagattttgacattagtttgctaaaatatgtatcttttagcatttggttgtttactttgcattactaaaagattaacaatacgccgttgtgttagcacgggtatattactagtttacactagttttcgaagttaagggtgcatcttatattcatatccagtcctatggttgtcggatgtggtagtgaactttttcctaaggggtgcgcaacatgttgtcgaatttttttcggatttagattttttttttaatatttacagaaataatctatcgaccaaaaaaaattgcagaaatagcccctgccgcccacctctggggcggcaagctgacgtggcaaacgggggaggaacgggcagtgacggagggagggttttttttgcaggaaaacccttgccgccctttggtggggcggcaaggggcccgaatgcaaaaaagccagtcagggccggctattttgcaggcggccccttgccgccctctggccgggcggcaggcctcgctgcctataaaaggcctgctgcccagcccctagccctcattcttctctcctcaattccagtgaaaaaaaaagaagagaggggaggagaagagaagaaggggcgaagccctcccggattcagacgccgatttcaggtaatattcatagatcctatatgtgactattgagttaaatagtgtgtattctttaaaaatttgtttgaataaatgcattatatttttagggttttagttgtagtaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgagagaccggctaagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgagggaccaagtgctgaagtaaacgagacttctgtgaaggaggtcaacgcacgagaggacgggggcgtagtagctctagtgggcattcaaccaggtggagtggctgacgagggggagactgtcggtgccattgtggatgaaatggagagggaggattctgacaacgagcatgtagaggaaggtgattcgtcagatgatgagacggatattaatctagcagaatgggctagtgaggatttttttgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattagacagtgtcagttgttaccaagcatacatgttttctacctggtgttcagaaataccacaggaacattacatgtgcatttgttgcatctgagatgtatgcgcatgtcatcaataatcttacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatacaagatggtattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctagcattctgcgagcgataggagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggaactctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgtgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacgtcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagtttttatgttctatgtcggcatgtggatttgcttgtaattcgtttcgaacttatcgatgtgtttatgtttcgtcgtgtaatgtcatacttcggcatgtcatgtctttaggtctcgtgatgtaacgtcggactaaggcgcctaacgtctttaggtatgctgatgtatgtcggacttcgacatgtaatgttatgttatattattgaactctacatatatgttaaattgcacgtcatcgttatgtaccattagtaacgtttgctatatttaaatagcctgtactcttgttgtacataattaatctcatgattttattactatttcataatttttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgttttactataagttagttgcattgtaacattttttataatgacatattaatttgttattgcaggctacgtgaggccggcctcttaccgatgtgtcggctggtggaggctgcggccggcgacgcggacccggccagacgatggactgtggacaggtccctcgtagcagctttggtcgatagatggaggccagagacgcacacttttcacttgccgtgcggtgaggtagcccctaccctacaggacgtatcgtacttgttggggctaccgctcgcgggagacgctgttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcgtacagccgatgtttggaggcgtacttgctctggctttttggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgattggccgccctgaggtggaccagcacgtgtacgaggagtcactgtacgaggagcgaccagaggtcgactaacctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgatgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttccgcgtgatgcggcagttcggcttccgtcagccctttccagtaccgtttccgaccaccgtcccagctactgttcaccggtaagatcttgcactacgcttttcgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtactagccacgcacccgtactagggtcaccttcgctcccttggagcagcagccccacgttgcgagcactagagacctctacgccaggcaccgcgaccaggacttcgctcgtgttgtgagtaccctgcatcgcaccattcctttatgttttcatgtctttttcttcatcaaattttacgaatatttatgaacaaattaaccatgcaggtcgacgacatcaaccgggtcgtcgttgacggttcaacgacgatccaacgtttagacgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccacacggaggtaagtatttttattactacttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttccacaatcaatttacatacattttatgtcttagcttacaagggtcccgttgtcgatgtgtaggtttcgcccagtttgctatgacgcaggccgcccacttctcctaggctgcagggtcagcgtcacaggcagccggcacgtcgagtcagggtccaccactggaccatgctgggacctcgtcggaccccttcctgtcttccaccgtgctcttcgacatcactgacttcgacttcgcttcaggctcgacagaggacgtcatcggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcggcgtgaggcagggccagtagagcagtcttctttttgtttacttgcttcactttccaatactgtatgcttgtgtaatgactacgttgttgttatatgtgcacgataccttttggcgcatgcacgatacctttcggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccacacgttcacatgtcaggggtatcactcgattttttgcgcctatataaatcgccttaacgagtgaggcctcacaatctttcagaactcagtcacattcagtactctcttccccacttgcttcattacaaatccgactggctttcgtcaatggctagacgccggggtgttgaggatccaaactggcgtagcgatccttgtgtatacctactaccaccttggtgttagcgtcctctctgcctatgcgatgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactgacgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatgataagaatattttgattacatgattccttattttctcacaacatttacgaactttgcttgctttacatctattctttcctcccaggaaccaccaaggagatgtcaatacagagaatggatagacaccagaagggttctaactccacctagccgtattgtgcagcttgaactaccagagcaatacagggttactaaagcgcggtttgagagaggagagggatcctcacgtaggggttagctattatcggacaacttggcatattgaaatttctactgtcatgcttccttgtcccattattacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacctagactgcgataggcctatataaattatccgagtactaatacgtcgaatatggtacaaaataatacctcacttaacatatgaaattgcacaacaaccaacttcaatacatttttataacaatattaacaagttttaccaataaatacttctttatttattattaacataacatagaaaaatcttttggccgtacttttttcatctgg

SEQ ID NO: 48153 - DNA, 26074 bp, Oryza sativa
  unsure (1)..(26074): unsure at all n locations
tcggtccaccaagaccaccttcacggcgaccgaacgcgagacgagcacgtagcaccaccgctcgccgtgccgcgaccacgtgtggcgcccgctgcctccgcgacccaacccaaacaagaaacaaaaacgaaaccaaaccaaaccccctcaaaaatctcgacgcgtgagccataagcccaggcgaccaccgagaccgaccgacccatccaaccaacccgagaccgagaggcgagcagcaaaaaaaaaaaaaaaaacaaaaaaaacaagacggccgcagcagcttcctctctcgccatgcccccacacctctcctcctccctcttctcctcctcccctctccccaccgccctcctctcctccctcacccgccgcgcccgcgccctcctccccctccccctccccctccccgccgcctccacccgccgccgcctccctctccgccgcggcccgctgctgacgcgtggcatcatggcctccgccgccgcagaggcaccggccccgtcgccctcgcccaccgccgccgcgaacagccgaccgcggcgggtgctggaggagctctcctgggacgactccttcgtccgcgagcccccggcgacccccgatccgacgccatcccccgcgaggtgcgtgcgtcgctggggtttactccccgcttcgtggctcgtctcgtctagtgcccttcgctttgcttgcttctgcttcacccggtgattttgtgctgcttgggtgacgcaggtgcttcacgcttgttacacaaaggtgtcaccctcagcgcccgtggacaaccctaagctggtggcgtggtcccagtccgtggctgacatcctcgatctggatcacaaagagtgagcccccagaattattctagtagctgttatgcatttatgcttgccgtccctagattattttggttttggggggtatccctgatgtctgtggataaatcagatgagggttggacaggctgcctttgaattagcatagctcgcttttttcagatgcagtaagagatactgttttattcgaaataattagctttccgtgattggcaatgcgttggagcatatacctcgatcgaaaatagtccgttatggatagagatgtaaatgagaagtggaaatttgagtgtgtataacctgcaaaaatattacaaaacctatcatatcacccttggtagcacatgagctcgaactggtccatacagcacctctaacttatgcattcactgttcgaagatttagtgtcattaccttttgcccaccagggactcttatcgctaacattttaatttatgcccacaacactgacaagtaaggtgaaaattttattcatttatgtttttgctgatgtgctgcagtgtgggtgaaagtggtgttgcctagagttaatgttaccgaaactttccaataaaaaatacaccttgtctttaagtttttgaagaaagttagcacagagaaaaggattactaatcagatgttcaaaattcgaacaccagagcgaagtattacatggtacacagacatggcatcatgacactcgtgtcagaatcctaattggagtggtgtgtccgatgcggcataaaaagtgggcacacataatacaactcagaatcggactggagtggtgttggaatacgacttggacctgggtgcctgattcggcaagaaattatttgcccatgcaatattctttttctgtgttgcccaactcaaacttcttgttttttaatttgccacatgataggccaagtgtgctgtctggcatgttatcagcttcttcttttggctactgaccactgaaactgtttatgacaagttggttttgctttttatacagatttttgtactggttgatttgttacaagaatactgtatttcttaagttgcttttgatcttgatatgatctgttaatgaattaagctgagtaatgcatttttacctcctaccaactctcattttctccatttttgtgtagaagcatgttcattgttctcttccctgttactgtcatccattccttttaatcattttgtatccttgttggtctactttcaggtttgaaagacctgattttcctcagctgttctcaggagcaaatcctttggttggaggtgcgtaatactaatgcttaacattctcttcatatgattgcacaagaaaagcaacacaccttctgatgaacaactacctgcagttcaccttatgcccagtgctatggtggacaccagtttggttcatgggctggtcagttgggcgacggacgagcaataactcttggagaggttatcaactctcgaggtgagagatgggagttgcagctcaagggctgtggaaagactccatacagccgatttgcagatggccttgctgtcctccgcagcagcattcgtgaattcctatgcagtgaagctatgcatggcctaggcatccctacaactcgtgctctttgtctagttgaaactggcaaatctgttgttcgagatatgttctatgagtatgtcatgacatctctgttttctgaactacatcatgctcgatctatttttctttctaaatttactttagaaacagatcgttccatatccgaagttgtatatctcattgttatgagatatttcttccttctatctaacatggtcacaaagattaaaaagagaacaatagatgatatgagtctctctatagaaagaatgatagatgatcaataatattattatttaaagctaaatatgaagctgccaataggcaaaaataataatggtagcgtgtttctgaaaacgtggtactattttaaacttttaactgtatgtttatggagaacatatcctatccgcacaagcttcccgtgcacattaacagccaaatatcacggaaaattctagaaaaaatatgacatgtactcttaatagtattacacatatctacaaagtcttatattcaaattcgctatattttagctgtaacaaaaaaaagtgaaaattttgacagttttaagattaaaaatctgtcataatttcgtcttttcgttacgattaaaatataatgatttgaacatgaaatgtcacagataggtgtaatactatttaaagtatgtgttcaattttttctagaaattttttgtgacatttgctagttggtgtgcacgggaagcttgtatgcataggatatgttcccatgtgtatgttgcttgagccacatatatataccagcataagctgcagtgggcctgctactgaacaagtctgttagcttctttggtgatggttgtgctggggatgtagaaattaccctgaatggcacgaatcatgtggtgatggctcattttcgtttttagcacatgtgagtttgagttttttttttccatttctttagtgcatgactgtatgtggaaatcatatttggcatattccagtatcattagtctacataagtaaattgtctggttttcatgatatatataatagcacttgtgagcactaaatgttgaaatgattaccccttgccactatgtcaactatgattcttggctgcaatattacgcaaccgagttactgcagctgctaactgcttttgtccacaagtgtgtgtagttacataacaaagcagcagcgaccactgtaatgcagcatgtagcagctgctctaagattcttcaggtttccttgggccatataacacgtccttcttttaagaaagtgcataattttgcccccccccccccaattttttttatttttattaactttgtattgaatactatcatacaaactccattgtccctttcatttacctactgttgattaacattaccttagcggctttttcataaagaacactggttgccaggacctttccccttttttttttccagaaccttccttttgaaggttttagtaattatgttgtatctattagcatttgtttatgatgataaatctaatggtttgtctttatatatcagtggcaattcaaaggaggaaccaggtgccattgtatgccgtgtagcaccatcctttttgcgttttggttcatatcagatacatgctacaagggacaaagaggaccttgaaattgttcgtcatttggcagactacacaatacgtcatcactacccacatctcgaaaatattaaaaagagtgaaggtttatcttttgaagcagctataggggactctccagcgatagatcttacttcgaacaaatatgcaggtaaatatcattatgtgctattttctttcagtctactcattgatatttaaaaggctaagtattctccccttttaatccttggttacagcctgggcagttgaggttgcagagcgcactgctttcttgatagcaaggtggcaaggtgttggttttacccatggtgtgctcaacacggataatatgagtgtattaggactaactattgactatggaccctttggctttttggatgcttttgatcctagctatactccaaatacaacagacctccctgggaagagatactgttttgcaaatcaacctgatgttggcttgtggaatattgctcagtttacctcaccattgacagctgccgaacttatcagcaaagatgaggcaaattatgtgatggagaggtgcattgttttgtccaatatttactgattattacccatgattatgtccagatgtatcatacattttgatttctgtgtactgcaggtacgggacaaagtttatggatgagtatcaatccataatgaccaggaaacttggtctacccaagtataataagcagctaataggcaagctgcttaacaacctggctgttgataaggtcgattatacaaattttttccgtcttctttcaaatgtcaaagcagaccataacattccagagaaggagctacttgttccacttaaagctgcactcctagatattggaccagaaagaaaggaagcatggattagttgggtacaaacttacattgaagaggtaggctttacttttggtaatcgtttattcagtttgtttctctaattctattttataagtgcactttcaaacccaacataatggtatagcacatcaatatattatcaatgatttttgtcttgcttgttggtgtttgggtatgtgtttgtcaacccctgtcattttgtgaagttggaatagtcatgtgtacaaaagaatgtcacaaggcagaaatgagtggttgtttgctcccgttatatgcttccaaatatttacaatcatttacatattggattatattgttttgaaaattgcatcaactgttggttttggataatatctcattcattgttaatgtatcatcagcatgctaatcaattccctgaattattgacttattctgccaatagccaatatgttggtagatcctctttgcttcattagttcaaacatttatagcgaactacagctttgagaaacgacaagttgtaaagaggctatttggacatccttgatctaatgatatatttttttctttgtgaagttggtttcaagtggcgttcctgacgaagaaaggaaagctgccatgaactctgttaatccaaagtatgttcttcggaactatctctgccagactgcaattgacgcagctgagcaaggtgattatgatgaagttcgtcggttattgaaagttatggaacatccatatgatgagcagccaggaatggagaaatatgcccggttgccaccagcctgggcatacaggccaggagtgtgcatgctgtcctgctcatcatgaaaccaacattccatcacgtcaaatatgcaaacttgttttttttatattatttttttctgtataggaggtttaattttgagctactgctatagtgtctaaagcatcacatgctattttactgccgatgcatatcagaaactggtgttgttaatcttcgagttatcatattgttgacggtagctaagcgttcatagcagttgggaaatagagccaccaaactcatccgattttcttagatatagtgctttgttgttgtgaacagattatattttcgcagatgaacatgatgtgcatttagttttagctgtccatctaattatgtccagcaacatgagaggtgtttatttacttcaaattattgtgttgttggtacacatgcaattaagcgcattgtcgccgtacggacgatctaataccacacaatgtgaaagcaattagttataacataaagattatttattccactgttctttgtgttcatggaacaaaagtaacattttgttcagactgattttgtttatgtagagatacaatcgaattgctccggattttgtttaggatgttcttaaaatctgctttcttggtattgagtttctttggttccactacgtgatcgttttcctagtttctttaattctacacagccgttcggtggcggaggacgactaaacaggaaaggttcagtcactacaaggaaaaaaaaacaaaaaaaacatttttctagtattatagagagactttttaaatgcctttacaatactttcacaatactataaaggtattttaaaaaatacctaataagtgtcttacggtaagaggtattttataaaatatctataagatggtagatgtattttctgaagacattaaattctaccacaatcctatgaaaccaatgtaaaaaaataaaatatttttccttgttttcgccaatccttaactcatgattaattggacaaattattctcatctataaggcactaaccaactcaaccctaagtatcacttgtgtgtatttgccttgagttacttatatttagtcatttagttttttttattctaagaagtgtctttatcgtgtttaaagtgtctcgagaaaatgcctttacaaaccaggcacaatttaaagcgccgtaagaatgcctctataagataaaatctaataaaatgtgctaaaaatatgctaaggttacggtgcactgagttattattcaatcttcaccggtcagctcgtagattctctttcacctcagtatatttcattgcccacaaaaaatggggaacttccttgtcatatttgcagccttcaccggttagctcggagattcccctccaccttagcatatttcgttgcctcaccaagaacggggaacttcctcatcagatttgcagctctgggcccacaatgttgtgtcttgcgcccctccgggaaggaagagagaggaccagagagatgttggcgtcgcggtgacagcaacaggctggtgcttgtgatgaggatgtagcgacgtagggggtaggggagaaattatcgctgccacccctgtcattgtgggaggaggagaggccgctggcagtgaggaagataggaggagctcaaggtcgaggccacgccactgaggtcgatccagagccagcgagcttgatccgtagctcgacagcttctggcccaacgaggtggagccccgcttgaccctaaatgggtgtgcgccgccgcttcgctcatcgccactcgcaaccacgacctcacctgctccgcttgttgagccacttcgatctgccgcctcgaacgccacctcgcctctaccgctctgcgccgcggcagctgcaggaagaggaggaggggaggtgtggcgaccggaggagggggaggcgcagtggagaagagaatggaatggccgacggaggagaggagaaggggactgagagggaagtgacggagaggcagaggagtttgaggtcgaggccgtcatcgatttggagccggcgctggcgccgctcgggctgcccggtactgtcgccgcatggaccaccgcgtcggccgccgccgctcaaccccgacacctcgctttctctggccttggcttcctttgctggtggggaaagaaagagaggagaggcagagatgaaaagtaaaagagattggtattggtagtatccattataagtaacttgcagtgtgaagtataaagcttaacacgttcttagtctaagtggcatgtgaagaacggcaaatatcagggacgcaccgcctaaaaagtaaggtacggattccttaaaattgcttttgcccacaatttgttcattgtggcgagacgctccacggtttagccacactttacatattagttgtgtccgccactgaacacaaagtggattttaaactctcaaagggaaggtttcctcgttgtttacatgacactcaaatagttatggaaaaaattaaaaccatttgagaagatgtattaatatggatatattattccacaaatatgcaagttaaaattcaacttctacatttcgcaaagaaaaaacaaatttgattgtgattatacgttaactagttatagtttaatttattttttcgttgcaagatatagaagttgaatttaaaattgcatatttgtggagtgatatataacatattaatacatcttcttaaatgtttttaaattcttttataatcattagagtgacatacaaacaactagaggacatcccctcgagagtttagaatagttttcccactaaacgaacagcagtgtagcgcaagaaaaatatctacagtggtggaggggggtgtttggttgaacacctcacattaccgtactttttgtgaacgctactaagacaagagttattaaaagtatgagtctacgacgtgtggattcaaagctaaaaaactgtggcacgtcaaagctatggcaatgaaccaaaattggcaggctaagagagtttggtaattggtactgaaccaaacagcccttaagtaatcgagttttcggcttgagagtacatgaacgtgcgtgctggtactcttgtcatcaatcaatatcaccaaatcgacgtaccataccagatcgagtttaactaagaccagtttgatttcgtgtttgatacaaaaattaagatggacggattcacaagagagcaccctctacttaagctttacattacaaggccaaccagcagctgcctgccggccgaccactgcgtgcgcacgcgcgcgcaataatcaaccaatcacacacagtacgcacgcacataaaaaccacccatagccttcacgtacgcccggacgcacgcaccggttcgtgccaagctcaagggtagatggttctcgggatgatgatgtcgccgatgttgttgtgccacgggtccgagaggtggctggccaggttctccagtgggccggtgcccgggtacgccgactgttggacgcagaaacccacaaaagccagcatggccaatcgccctacaaaccgatcgataatatatacgcatatgttatcgtctccgtttctaaatatttgacaaccgttatcgttattaaaaaaaaaaagaaaagttgggtgcattgcataccgttcttgatctccttgagcttgtactcctcgaacttgacggggtccttggagaagccgagggggtcgaaggcgccgccggggtacttcttcttctcggggtccttctccatggtgcgctggtgctcggcgaaggcgatggcgacgaactcgatgaccaggatcgtcggcagcgtgccccatggcaccgggttgccgaggtacgtggcctggccgccgggctccgccgcccactcctgcgcctgcacccagttgcccagccccagcgcctccggcaccaacaccccaggctgcacaagcgtgattcagttcagttcagttcgtccatggcggcgcaggccatgccatgcggagatcagaatcaagaaccataccacagcgagcatggcccaccggcagtggtacacctccgactccttgaaccgctcgaagttctccggcacggtggcgaggcccagcgggtcgaacccgaagtcactgcacgcacgcatggcaaatcctagctttgtcagtctctcgctcgccacggacgcacgccggcgaagacgtgtcgtcgtcgtcgaacgcttgtgcttacccgggagaggagccgtcgaggtgggcggggcgtggctggcccggcatccactcggcggacatggtgacgcgcccggaggtggtggcgtaggcgcagaccggcaggcggctcctgttcgacgacggcgccagcaggctcggcacgcccaccgcgctgcagctcctcagcccgctcgtcgccattgccgccgccgccgctagcttctcctcctcctcctcctcctcgaacacaccagcaagaagacgaagtaggaagaagaggtggccggtgagtggacgccggaatccgtggcgggatattaaggggggagcacgacgcgagcggccggagacgaggccggggatgggggatatccgaatcccgccgccgattggctgcgatatccgcgcgcgcccacccccattgggccacgtcggatcgtggcatcttttgcccgtcctacgtggcactcccctgcatttgccttctgctctgattgtctcgggctctcagctgggccaagccatgcaatgcagtccacatatccatgggaccatgtcttcttactccttcactagggaaaatctgacatgtaacttgtataaatccacaccaagtgtccaattccagatgatggttttgatccaaaggaagattttttttttcccttatcctcttgaattgtgcatgaaaggaagattttttttatccaactagtatttacagaattgtgaaaaagagcattgttttttcaaaaggttgggttgggcacaattcatgctattaaaatgagatttttaacttgttttattttttgctactgtacatgtaaccacagtgggtacttcctttgatgcaaaggatgatttttttttatccaactactaggcaactagtacgatgttcgccacaattaaaaggttttactgacttactccgtatctaaaagagcactgtcttttactgaaaggtttgagtttgatacaatagatgccattcagatgagatttttaacaaaaaaaaaaattaaaggacgatttggcttatcttattgtttgctactcactccgtcacataatacttgtcattttaggttgattagtataaattaaggtttcaaaaaaaatactatataggtgcgttaccaaattttgctagacctcacatgccgcatagatcaagaacaatattggctacatgctttacagtgaaagtcacttatagtgggtcccactaatatcaccttcacttttcatgtatctctctcctctcttcctttccctgtcggcagagaaagccaaggcgccggaggataaagcgaggcaaggtcagcgacgaccgtcgggtggagcggcgaggtcggcggtgctcctcctctctacattttccctggcagaggaagcgaggtggctcgttcggtgacggcgtcgagcagagcagcgacagcgcggcccatgcgacaccggtgctgggtagggctccacctctcctccccctctgaccagtgggtgacagcgcgatgggagctcagcggcacgcgaacgggaggcggcggggttgatatggtggcgagggcaccaccatcggggtaggggtcttcccgcttcaccgcatccgtacccaatcgccggcacaccaaactgtcgcggcacgtggaccacgccgactcgtctacctcgtccacggttgtggctggcatcggcctcgagctttggatccggtgacgtaggggccgcgagctcagcgaaaactcctcggcgacgagcccggcgatggcgcagtgtggagctagggggcgacgacctgcttggctcccttcctcccttcctggttgacggaggatgacggtctccctccctggccgccgagacgagccgagctctctttccaccctctcccttccctggcgacgagtgtgggtcgacctgacgatgctgatattttttttatgaacagtgtgtctcagtttggtcacgcgttcttggtttggtcacaggaaacacagttggctaggaatatcctacgtgtaagcttgaggcagaatgacacgtaagcatattgttaaagccctaatgcttcatgtttgaatgtgagagggtgggtggttaggataaaatgggaagaaatttgaataggagatattgatgggataaatggcactatatgtgacaactattttaggatggagttagtacatgtaaccacaggggaaaaaaaataagttgggctgggcccattcttggcccaaaaaagtgttcattctgtcatccataggtactaatgaattctgctgcgctctattgttgttctggtctctctagatcagcttatcttccgtaattccgtaaagcagtcagtcattcagccccattgattttccttgatcagaactgatttgcatcatctttcttctttttttctgggaacatctttctttctttctttctttcttttgacaaacaagatgaactattctgaaattaatggaggatgaaaagggcttgtcagtggctggctcagttcaggatggctgtctttgcttcatattgttgcaaagtgtttgtatagtcttcacctgtgctatcaatgtattcattctgccacggaatcgtatgctgaccaattaccggtgtcggatgaaatgaagggcacatgatttgttcaaggaccacaagcaaaacaacgtgcagaaaaaagtgtttgttaggaaattatgtggttgtggctaactggtgcctttgtagtttctagttgcacacttagcacaattgtactaattcattaactacatcaccagtcaaaagcacatgcgcttcgtcgatgactgaatgattctatgtgaaaccgttcacagaccatcataataaaataaagagacaattagcaccgagggtccagccaccaatagcatgtcttataaaatggagtaaatttcacaaaactacaaaactacaaaactacagatacttagatcaaattatcataaaactatagatttaagaatgtattacaaaactacagatttagcgtcaaatttttcacggaactacagatttaatgcaccatatcacaaaactatagatttagtgatgaagtaatcaaagaactacatattctagagtttagatcatagcactattatttatttaaagttataaaaatatgtagttttatgataaaatagttttaaaatgtgtagttttgtgataaaatagttgttaaatcaatagttttgtgatataatatcttaaatctgtagttccgtgataaatttgactctaaatctgtagttttgtgaaatacattcttaaatctgtagttttgtgataatttaatcaaagtatctgtagttttgtgaaatttactctataagataccgtctctctttaaatatagaataaattttagaaaatcctatatttataagttaaagttgtagaacatcatctctctcgttttctatgcgcacgcttttcaaactgctatacggtgtgtttttttgcataagtataagtattactatgacccatggtacatagtattatgattataaagcttcacaaaatctcacctttgtgtatgttgagtctgatttacttacaattctaaaatatatagtgcatataattcttttaactattaagttcttgaataaagatgataataaggttgttagtttaactcttctttacttaaaaaaaattatttcaaatatactgaaactaatcaagattttaataacggtggagttctatgaaacatatataccataaaacttgtggtcatgtgctacacgtcataatacttgtggctttgtacaactttaattttctaaaatttgcttttaaacattgactttttgacatgtttgactacttatcttatgaaaaataaacatgagaagaaatcatgttttaagtatatttaataataaaataattcgtagtatatttaggaatacatagtttttttaaaaaaaatgattaaacgtcatatcaaaagtctatggtgactttatttttcaatttttatataacgtttgactcctcgtcttatttaaaaattttctatgattaatagttttattgttattacatgataaaacataaatagtactttatgcgtcatagtttatttaaataagacggacaatcaaacggtgtacacaaacctaaaaatgaaggtttttttttgggctgggggagtacaagacaatgttgtttacaaattgtactagtactgatatgatttgatacatagtataatgaatttggccagaggtatgtctaaattcgtagtactatgatgtgtcacattcaattttagattggttttttatggaactgcgagaggagtacaaaacaacagaggaagtagtacaattatttatgctgaaccagcttcagtaataatcatgcagtaatcccagaagcagttattccaaacaggcaccagcaacaaataaacacatccagtcatgggggtcagaaccaccaccctgatggatcttggctctagctcctggttttctttctttgctccctccctgcctgtcacccagtcttgggatcctccctgttcttctctccctcttgaatcccccaagagcagataaagagaactagtactaataccactacagttaatccttaagcacactgtcatttgcactaataaaaatctcattcttgtcaggctaataatcacagtggagctagatcatctcgttttcaacggttggtagactgtaaacaaagtgcaaggccgagctgagctgagctgagctgcagcgagtgacagctccacagaaaagcaaagcaagcaagctacctctctctctctctctctctctctcggtagcttctctctcttgctggctggctctctgcgcgtggtgtgtactcctgctgtccctgctgcggctacagctactgttgcagctcgagcacccagaaggccagaaacccagaacaagtctcacaccctcctcctcctctcgtccatactagcaccaccgctgctgctgttgctcctgctgctgtgctgccgccgcctgctcgtccaagaatcttccagctttccccaatactgagcagccaactcctgctaccgcttcttgatctgtgggattttcttcttgtttcgaatccaagatcacttccaatccatagttttggcttttggcttccctccagcatcagtgaaaattggttctttggaggggaagaaatggatagcggctggatatgcttcttgagccagattgctgatttgatgcaataaggtaaacttcctcctttttttttctttttctcttctcacctctattggatggttcatctcttgaattagtttctctctgtctctctcttttattgatgaaatgaattagtttcttgtttttgttcctatcttttgtgggttagtatattggttgatgtattccaacctgagtttaatggggatatttgttgtctgaacttgtcaagttctatggatctcaatatgagacacttcatttatgcttaataaatcgattcccccagagatatctgataatctgaaatatactgttccaatagcttgttacagtaagagtaagttcttgtatgcttttcttgcagatttctatcttatttcttgctgcagtatcacaaatcaaactaggagaactgactgagaagtgaaatattctgcttccaagaatcaatcagataaactgattccaagaaaataacaagaagtaatcagataacagaagcagctgcagctgcagcagtagcatctttctgttcccagtaattgcccaatccaactccagctagatttaatcagatagagaagtaatctgctggattgaaatccatgggtaggggaagaggcagagggaggaagctcaccaatggcaggagccatgaggacaagggcagcagcggcgaggaggttgtgcctgcgaggaagaggaggggaaggccgcagaagcgcattgtcgacaaggtggtggatcaagcagaggccaagaatctaaccgagggcgacgacggtgatgctgactaccaacaaggcgaaggagaagacggcggtgcgaagccgaaggtgtcaagaacggagaagagctctgcagggaagggcaacaagaggaacaggctgcccaaggaggaagaaagctcaaaccttgaccttgaggagaacagctcaagcacccggtccagcaacgatgaatccaccaggtccaatggcttccggcagaatggcagccggcgtaagagcacgccgcggcgagccgcggaggcggggatatagcttggaaactttggaatagggtggggaggacagtttcatcagggattggttcttgggttatatcatcagttaggcaagctgctcttcagttttgtcatcttcagattcggcaagttttccttcaaaattttgtcatgttcatgtttgctaggcaccaacatgaatgtaatgtaaacatatactaatccgcgagacatcggagttttgcttctggtgatgaaaattgtatgaactagcatcggcttatggtactactatagctagcatcaccaatcttgttgcaactttgtttcatctcatctgctttacttttgccatttcagagatacatccatcggagttttgcttctggtgatgaaaattgtatgaactagcatcggcttatggtactactatagtctatagctagcatcaccaatcttcttgcaactttgtttcatctcatctgctttacttttgccatttcagagatacatccatagctttttttttttagataagagtatttttacctggcctctacattcaactggatatatgcagtttttttaaattaggaacttagccctcaaataactcaatctaaaattcgctcctgtgaagatttgaactcagaaccttggggtgttactcaggtcactgcaatcattaggctatatgccctttcatcagtgttggctgttactccttgttcttgccagatcaagataggttgactgttgatcgattgctgcactttgtcttgctctaatcaagatagcttgattgctgatctatattgcaaaggccaaatgactataacatgttcattctgttcactggtgaagtgcagacttcatggaattcagatgtcataatatctttttgctgggcatctagggttccttttgctggattcaggatacactataaatagtgaagcatagtatcctgtcttagattggtgaagaaacagtgcttttgtggacaatttgcacaccatgatggatgttttcaaatgatgtcaaattatcaatctagcatacacgaaaggaagattttcagggtatttgattctgcagtgatgatgctgtcgaaccatatttctgccctagcatttttttggcaactggccttgaaccattatcgaccatattgtaacacaaattgttgcctcctgtctggatcaacagtaagtctaaccacactaaaacctaatctaccactcctagtatttatcatcatggaacaaaaagattcagacaccatgatagtatctccactgagccatgtaagagcaagtttaatagtatagccaactattggctctaaaatcaattatagttaatttaatagctaattcatacaatagttacctataaacatgtactatataattaatatctggtcccacctatcatgcacacatgcatattggagtctgtgctacagctggctacaaatgtgtagctcgctgcttttatctctcatcttttatcttcttaaaatatgtttatagctgacttatagtatgctactgtacttgctctaaatgtgatccctctgcattgttggctgcacttgtcagaattcgttttttgtgtagattgcttctctgacgaccatctagaaagcgtttcaagtggagactgaactttcaattttgccatttcaatttcaggtttcaacaaggcttaacaaaaaattcagtgcctattgccggatttggcatgtacgatgggcctaggtacactcggaccgttgaaattggtggtttgtggatgagcattttgttttgtggttccttgctagttgctccggcaagccgtagtggtagtgccggtgacctaatctagaaccaaagatgggtcctcctgtttttggaatttgtgtaggtttagtttatcatgtatatatatgggaaggataagttcatgggtgagaaagttgaatcttgcactttctgccagcacaaatagtagatgattccgattttctagtattttccttttaaatagaagttgtttcgatattgggcttttgatattgtagagaattgtatcgactatcatcccatgtaatcggataagagatgtaaaacaatcttattatgatttttataacgtgcatgagcgagaaacaatcggagatagaaactgttaaggccctatttggttcaaagtatttttcaaagaaattgtaaggttccatttccttcaaggaaaaaccgttgtagcagcgtttggattaaggtttcattttcttcgaggataatgtttggtgaagcactagggttatgtgaaaagacaaatgattaaaagtcatggtaattaatatatttttctcaaattcctccatttcaaacacaaatatgcctatattgcctatgttttttcattcctttgttttgcaattatgcattcctaagttctttcctatgcttaattcatgtggtttgtttttcttagtttcatacaggcatgcaagcgatgggcttggtatgtgttttatgatctaacctcaataaagtattgtatggtacttttcaagagataccaccgaaaaaaaaacatggtaataaaaaggtagagaaattctgttatttgtagctgttgaagcaagagtaaggactctgcctataattttttttttggatggtaatccccagctctcagcatcaagcgtagattctcaagcatcggtcttgagttagaatgggtttagtgacgtggcgataatgtgacaccgtatcccagggtgttttccatggatgaaataatttttgaattttccaaattagtaaacagctttaaaaatcatgaattccactatagagtatttctaatatagattagtttgtaggtacaaaataaaacataatttgtctgcaaaatataatttaaatgtactaaaaaccattttcgtgcgaccaatttttttcactacacctaaatttatttaggtttaaatcaaatgtgcaaatgaagtgggaattgttccataatgttttgagtttattactaacttttaaaattcacattattaaacaaactatttaaaaaaaactaagtcgcatattgtgggttttagaacctagatattttgtctacaatagactaggttgtcatctataagatattccactctaaagaataaaactattctaatgccactcaaaaagatgtaatgctgtttttccactttgaaaccttttgtattagttagtatggattcaccatttattgaccattttgcccctgtgcttttaaaaaaaatcccccgtgtgcattccctcttcatctaacagaatatggcaaagctcagaagcttggagtggcaaaaacagaattacaacttttgaaaatagcatgataacaattacattggagtggaactcttgaaaatgataaatgttcaattttctcttagaatgaaggttacttgcataaacaaaatcataaagaaaaaaagagttggatccataatcaacttacctcccaaagggtatgtttcttgtaggaagcaattcccagtcctactttagccacattttttcactagaaccaaacacagttttacgggggatttacaattatgacattgcaattttttacataaacaaccaatacttaaattgaaaagctccacactttgccctgatagcaaagcctgatatatgacacctggaagtacacctgaagcactaaacagcagacaaattatgcccttttttatttgtaatcagaaggataagccttcacatggattttgtatcagcaaatgccaagatctcgctgttccccggtggcatcacgggcagcacgacttgtaaagcaactggacataatgaattctgttttttttttctttctccaagcaccaaatctgcctataaatacacaaaccttagtgagaacagcagcaggagaagagtcagtggagaaagatctactgctgcaacaaagaacagccatggagcttctctggctgctgctgttgctgctcatggcttcctcaacatcgtcgcggtccgaaatgaaggcgggagaggtgatcaggagaagccaattccctgaggacttcttcttcggcacagcttcttcggcataccaggtatgttctagaagcttctggagagtactggaagatgtgtgtatctgtgtgtgcatcacttggccctttgttacaaactttttgatgttgcagtatgaaggtgctgtgagggaaggtggcagagggcccagcatctgggacaccttcacccacaatcatccaggtctccttgctcctatgatcctatccaagattatgttttttactgtaatcttaacccttatctattcttaagcatatcaaatttatcaatctgactgttacatactaggatatttaatgtgatttaatgtgtcgacaatagtaagatttgaaacaggactatgcaaaattttaacctgttgtcaacttggtgaatgacagggaattactttgaacaatatcatagcagccttctgactaaggaaaaggcaagcaaagctagacaagatcaagtcaactgagttataacacagacacacagtagccagtaggaccttcaaccttagaagtcaaaaccctctctgaattatgaattatgacaaaacttcgtacacaatatttatgctttttaagcagttgcaaatgtgtgaatcacgcaaaagtttctatttgaaaaggaggtataggagatctgcgcccttgattaatagtggaagaaaggatagaaattacatactccttctgtcacaagataagttgactattggagttcaaactttgtcccaaaataaattgattgttaccttcttgcctaccacggtccacaaatcaaagacagtcagactaaacatttccaaactggcaaaacaaaaaaggagaaaaaaatggttaccaaacttccaaacaagcaagcacagacaatcctgtgatcttctggttgtcataaagtaataccacttgaaagatgccaagatcagaggccactccagaaagagaacctagttaagtgcattccttccatagcatgttagacattggttaatttagtgaaacacaacatcaatgtaccaacctgtaccacaaaacctcctacactagacattgtatattctttagtcttttgacccttaaaacaattagggtagaaggcacataaaacaccaatctaatgcttgattgggactttaaagcacttcagtcatatggtcaatttgacctacgagaaaccaaaagtagtaaatttgttatgtaggtactataaatcttcattctaacctactaacaagatcaattttacggtccttgaggaggtaccatgaggtacaaaaaatttagtgtaaaatttggtatctcatagtatctaggtaccaagaggtaccaaatttacaatagaaaaaggcggtacctcatagtatctcctcaaggaccgtaaaattactatactaacaaaggaaggggagaaagaagaagcaaaaggctagtgaaaacaaattttcaagcatctgatgatagattggaacttttcttaagtagtttaatttttgttagatgatggcttaagtagttcaatgaccgctattagctatcactactttattactccatgtaaccacaagcaaataaacagcttagttttcgtgtacttaagttacagtccacatggttcaaaagatgtctatagagaacctaattaataagctactggctatttatttttccttatatacctcaagcacttggttattagacaactcaaggatgtcatgcatgaaagaagcatgtctaaatcatgtttaattaactgacattcagatacggtgcttcataatcaaactaccaataatttgttcatgcagagaagatagcaaatggaagcaatggtgatatagcaatagattcctaccaccggtacaaggtaatgcttttaagataacatgatcaacttgtaatattctctacacaagacctaatgtttagaatatgctaatatgttattcactaagtgcaggaggatgttggaatcatgaagggtttgggcttgaacgcgtatagattttcagtttcctggccgagaattcttcctagtaagtgattcctcctttattttactctatttttcgttgaggcttggagcatattccaggtaccacttatcattatagctgctcaaactaatatttttccattgatctgcaattgaacactattgtaacttaatttgatagctgtatagattaaggaaagaaaaagagtaaaataagttgatcgcaggtcagtaccttatgcaatgatgatatttatatagatggaaaactgagtggaggggttaacctagaaggaatcaaatactacaataatctcatcgacgagctaatttcaaaaggtagagattacatatttccgcagtgtaaattcaaaacaaattgctcttattactatatgtttacatcttaataatgcctaacaagcaaatacaggtgttgaaccgtttgtgaccctttttcactgggactctccacaagctttagaacaacagtacggtggattcttgagtaacctcattgtgtaagtaaagcatatgactcttcctatatgtacccgaaatttactgatactccaattactaataagaaccatgatgaaatgacaaaacaaaactggaatcccctccctgtgtgtatcttcttattactaatgaaatgatgcgctctcatgcgtgttcggaagaaaaaaagatatgacaagaaaaataaagcataggagttaattaacagcttgtgccaacattatcagggaagacttcagggactatgcagacatctgctttagggagtttggtgacagggtaaaatactggattacattcaatgagccttggagtttcagtattggtggctattccaacggcatattagcacctggaagatgctcctctcagggaaagtcaggttgcagcaagggagactctgggagggagccttatattgtagctcacaatcaacttttggctcatgcagcagtagttcagatttacagagagaaataccaagtatgacctagttttctttactgtgaatttgtggttattttcagttaaaaaaacagaggtaaagatcaataatataaaatgcatttttacagacgaagtatgttaatagataaagaccttttagttttttttttctcgaacatgcagactttttactaatgaaaacattagatattaatggtaaaagaaaaggcagatgtagatagatagttcatttccgtagtttttgctagcttatttgttgaaacttgaatgtgataatcatgtaatcatgcaggggggacaaaaagggaaaatcgggattgctattgttagcaattggatgattccctatgaagattctaaggaagacaagcatgctaccaaacgtgcattggatttcatgtatggatggtgagttcttgttatgtgcagtacggcaaagagctcagcttcatacttgaattttcagatcaatacatacagtattttttttctttttctgatcatcaaattgaataggttcatggatcctttaaccaagggagattatccagtcagcatgagaacattggttggtaacagattaccaagattcacaaaggagcagtcaaaagctataaatggatcattcgacttcatcggtctcaattactatacagcaagatatattcagggtactaaacaagatagtaacagtcacaaaagttacagcactgattcactgactaatgagagaggtaatcattcaagaactctgttttctgttctccaattaattgaattactttgttgagctagctaatggttttctgaacatgcaaccatagtggaaagaaatggaacagatattggtccaaaggtatgatttaaatcagacatcatcatgttcttcatatgtacgagctagttcatattattacacattcaatatataatccgttgtggtaatcagtggataataaagaacacatatagttaattaaacatagaaggaatagagttaataaataacacatatatagttaataaaaaaacataaatatatttaatttgtatccaggctggttcatcttggctctacatctatccaaaaggaatagaggaactattgctatacaccaagaggacatacaacaaccctactatctacatcacagaaaatggtacggcattctaactgtttaccaaaagttgttctgctgcttatcaaaaaataaataacactcgtgttacaggtgttgatgaggttaacaatgaaaatttatctcttaaggaggccttaattgacactaccagaatagagttctaccggcaacacctattccatgttcagagagccctaaggtaattttgatgacaattaattgcttgacaatatagtggacgaaatcacaacaaatatctcattgtttcaatataatttggatcgaaatggttaagtatctgcgtcaaaataaaaaaaatactgtcatggaatgtcaggcaaggagttgatgtacgaggatactttgcatggtcactgttcgacaatttcgagtggatggatggttacagcgttcgattcggcattaactacatcgactacaaggatggactgaagagatatccaaagcgatccagccaatggctacagaatttccttcataactgaagtgtgcgttgttaacagtatgaatctatacagcttttgagggagaaatattcctagtgtaatgtataaattggagtaaatttatggtactaaaaagttaccggaaaatatcacagattgtagtgttaaactgttaatatgtggtagtaccttgacaccgtagaggtgccagaaggtatcaaaatttacactatatatatatagatcgtgttgtgttgtccaagcttcagcagtagtaccaaagtaactctctttgtggtaagatgcagcaaactggactgtaacatcgcagaactagctactttttctaacacaatactggagcggaacttcatagaattctaattttaagatgtacaatactagtttgaagtatcagataaccacttgctattgtaccgtgaaatttatagtaattttaagatgtacaatactagtttgaagtatcagataaccacttgctattgtaccgtgaaatttatagtagcatgtatctaattaaccccataggggggtatattctacacaaactcgctacatagcacagcaacaaacataaactattcaaatcattgatattaagatatcgattatttgatattcaaaccattgatatctgcttgttagcaatggaatttttctccacaacatatttaacttcgccatcttcagtctttatcacccactccggggcagcaatcatacacaaaagaacatttgattcaggcagcaaaaataacccaagtacaaccagacaagttgttaaagtatgaaccttgatgtaatcaaccagctttcaatctcatcttatttcaggtacagtcatccggctagtacagtcatccagctaattgactaacactcgaacttagtaaagtattgatctctccaattatatgcaccggcctgccatcaaatacagttgatagcgttgtctcgcagagcttcttgagttccctggtttttgtaattgctgcctcctgtcacattacaaagctaatcactaccaaatctttttggctatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48154 - DNA, 5543 bp, Oryza sativa
  unsure (1)..(5543): unsure at all n locations
caataagaaaaccaatacgaaacatttgacttcctttaatttaaaacgaaggggacaaaaagtagtagttcctgaaaggaccttgatgtcgcctagagggggggtgaataggcgttcctaaaaattatcacaacttcatagcatattagagagataataacttttgattcaaatcgaaacttccggtatgggattggaagttccggtctcaatcgaaaagttcagcggataacggaataaacactagctatgaacttatagctcaaacaaacaaaatgtatatgaatcaaaaggtgacaaataagatatctaagcaagatataaggtcaccaactaaatcaaataagcatgcaagtagatcgggtaaaaacaagctcaagcacaatatgagagaatgcaagaatgggcaaaccaagaagggagacgcgcgatttatttcccgaagttcggatccacggatcctacgtctccgttgaggagccacaagggccgagcctatttcaaccctttcctcacgaggttgcacaaatgcactcctcggtttcactcttgatttcttcccttgcggaggcgaaatcgaagccttcacaaactttccgtggcacaccacaaccttgggtgctcaccggcaacgcctagccgtctaggagaccttagtccccaagagtaacaaaacaatcgaagatttgcttgctatgaactcgagtgctcaaagtatggagtgaagctcactagctctcaacttctcaatcactcaatccaactcttttcccttctcaaatccctctcataaagaggcaccacaaaggatggagtgaagctcactagctctcaactcctcactctctcaatccaactctctccccttctcaaatccccctcacaaagaggcaccacaaaggtagggaaatggggatggctatttggctttggatgtgtctaatactccccaagagcagcagccactcaaaggaggggtggaggggtttatatacccgagcccctcaaaaactagccgttggaggccaagactgtaattttcggagtttccgaaaagcattttcggacaagtccgaaaacttacagaagcaaatctcatattcgcagccattttcggaatgtctgaaaattttcggagttatccgaaaaattttcggagtttccgataatttttcggactttccgaaaagcgaagagtaaaacgactataacttttcgctcgggagtccgtttttaatgaacttggactctatggaaagctcactcagaggactacccaactcaaccaacaacaaggtctaaaaccactcaaaggatatgttaaaacttgggtttctctcaaggtagcactatgataggtcactttgagcaccgagacatacacaaacacctcgacgttgcatccctcttaatagtacggcattcctaaactcaaatgtaaataagaagagaactataccattaggaatgcctttttttcatctttctttcattgtcttgagggacgccaatgccgataccgtttcaccatatattcttcaaataattgatgcggttacttgtagctttaaatggtctcacacggtccatcatgacaaagccgtcactcgcccttcaccaccggatttggttcttcggcgccaagccccttgcttgcccttcaccgccgcatggtccatcgcgaccgagcatcgcttgcccttcaccgtcttgtcataatagccacttcgtatcacacatcttcaatatcttcactttgtcattcttggtattgttagatgtaatgatattacttgagcatcaacacctttgtaatccttgggacctatttctttcattcaactcaataaaattattagtcccaatgatccggttgtcaacctacacatgttgaccaactgatcgcaagtataaaaggatatgaataaatgatgagtattaatcaacaccacaagtgtcatatactcaaatatatgttcaagtgtaaagatcccaattaaatgaaggtgaataatttggatcgattacatgcataactaaagtataggatttgctccccctaaatgtatgcatacaaaatatttgtgtgaagcaagagtatgcataacaagatagtaaacattgagagcttatcctatataagaatagaaggcatttatcaaatatagacaacaaaataaaaacatacctgaaagtgcatctaggcccctaatgattttgatgattgattacaatgcgattagagaggactaacacttttattcaagcaaatgtgaaggttgttatgtcctcgacatgttgtaatgagatgcataccccatgaatgcgacatcacgatgcaatgcggcaatgatcaaatggtatattgtatcttttaccttgcattgtgtcgtaggaatgccgtactattaagagggataccacatgcatataattggtagaacactagtgctcaaaatgcttcatctttgtgtgagttgaaaaacctaagtcaaaatttcaatcccgagttgtttcacttgtcacaacacttacaccgggtttctttgcaagtttttcaacatctcttgaaggttttggaccatgttttatgttgggtttgatagcccacgaaactagcattccatagagtccaagatctttgaaatcggagttcggagtaaaaagttattgcagttttacttgagcaacatcagactatccgatttgaaatcagactatccgatgtatcggactatccgattcttcacagaacttcactctctgtcttgatttgaaaaaatcctatcgagtgagtttttctaagtatcggagtatccgatgtcggatcagatagtccaatgatacagagactccgaaatttcatagaacttgagtctctgtttgaggacgaagtttttgcttctaaaatattagatactccgatttaacattagatagtccgatgtctcggaaagtccaaaatttcatggaacttcgttctctgtttctagttgccttggaggtttaaaatatcggactatccgatcttgtatcggactatccgacgtgggctgaaagattcccctccaacagccacatttttggggatctataaataccccccacctaacccttttctagggttacccaactcatttcattctcattcactttgggttgagcttggtgctaaggtgctttggatctttgagctctttctccctctctcaaatccctccttgttctttgtgtggtggatcttggtggttgtggatttggtgtttgagggcctagtgtgtgtttcactcgatcttgagcactagggtttgaccaagagttatgtggtgtttgttactcttggaggttgagggctcctagacggctaggtgtcactcccgagccacaaatctacgtgtggttggccgggagaagtttgtgaaggccggattcacctccgcaagaaaagagataccccttagtggaaggaggagtgcttagtgcaacctcttgaggaaagggttagcaaagacccggctcttagtgagcttctcaacggagagtagaatcccctcaaggatttgaactccgggaacaacttcgtgaacttcatcattggtgatctcccttcatcctctttttagctttgcttaattgtgccgctatagatctagtcgctgtttgtgccttactcttgtttgtgtgatagatctacttgttgtgcttcattggtggatcagacagtctgatccaacatcagactatctgatattttcggatagtctgactgtggatcagactttccgaccttatttcagttttagcttccgcataaagttttaaattagcctattcacccccctctaggcctaattgaccctttcaattggtatcagagcctaatctcctaattaggcttaaccgcttggagagatcatgtcgggtcaaacggggaatggcaaggatggtgataagggagctacgtttccttatgactatccctccgcatctacatcttatgtgagcacctatagcggcaaagctccgtacttcaatggtacggactatgccgcttggaaacataagatgaagatgcatttgaaatctattaaccctttgatttgagaatagtcgaaaaaggctatgttttgcataatcctgaggaacccaccaaggaggacgacgagaacgagcacaagaacgctcaagccgctaatgcaattcttagcgtcttgagtggaagtgagttcaaccgtgtggacggcattgagagtggcaaagtgatttgggacacgcttcggaatttgcatgaaggcacggatagtgttcgtgagtcaaaggtggagattctcaaggggcaatttgagtggtttgtgatgttggatggtgagagcccaagcgacatgtatgatcgattgagcaagatcgttaatgagatcaagggacttggctccacggacatgaccgatgaggttgtggtcaagaagatggttcgggcaatcactccaaggaactctaccttggtgaccatcattcgtgagcgtccggactacaagactctcacacctcatgacttgctcgggcgtatccttgcccatgacatgctcgagcaatagtccaaggaggccatccaatacatcaaccaaacctcaaccacaatcatcaagaaggaagacttggcattgaaggcgaaggaagaagaagaagagagtcgcaagagcaagagcaaggcggagatcgatgatgaagagatggctctcttcgtcaagaagttcggcaagttcatgaagcaaagcggcttctttaagggaagttcgtccaagtattcctctaacaagtcaagtggaagacactccgcaagggtgtgctatgtgtgcaaagagcccgggcacttcattgcggattgccctcacatcaaggattgcccccacttcaaggaagacaagaagaagcttgagaagaaggagaaacacaagcatagcaagcatgatcgctatggccaagctcaccttgggatgatcttcggctccgactccgagtcaagctgaagtgaagaagaaggagttgccacgttcgccgtcaagccttcatcaccaccgagactcttcaactactcaagtgatgaggatgctcccatttgcctcatggcaaaggagcctaaggtaccctctcccctcaagtcatttaatgttgatcttattagtgatgaggagaaagatgttgaggatgaggttatggatgacgagttgttcaaatccatagcaaaggaatccataccacacttgagtgagttgcttgggagaattgagaatcaatatgcaacccttgagaggcaagaggaattgctcattcgtgagaaagagtggtctcatgaactcaagagtgaactttctaaggagagagagagaaatgaggctttggtacggctttacaagcaaaccaaagagtctcatgctaatcttgaggtgacaaacgctcaacttcaagagagagtggatggcttggatnnnnnnnnnnnnnnnnnnnnnnnnnnnnnnnnnnnnnnnnnnnnnnnnnnnnnnnnn

SEQ ID NO: 48155 - DNA, 1947 bp, Oryza sativa
tttattaaagtcaaagtaatttataatctgaaacagagggagtatctattagtgggtctaaaattctacctacctgatgcatagactgattacataaaaacaaccactacacatgcttcgaaaacatgtttcgtctatttttttcctaccacattacctaaaaccattagatctcattttaaacttttttaagtttatttcttaaaatatttaatttatttatacaatcaaattgatacttcactgtaataatgtgctcaataatctaaattaaaacgacctaatggcccagagagcttaaaatactaaaagttgctggttggtaatcggcttctaagaatttgaaaaaattgaatttcccagtttctgatttctagttcattttgtttattttacaactatagtttctcagaatcttaatgaaaagttgactgtttatgggagcttctgaagaagctgcatctgtcagaacttagaagctccaaaaacatgctcttagtcatcttccttttggattatgtgtcaaatacattctttcttcacaatatatgttttagcagcgtctaactgtatggtttatgtcctttaagtgtaaccccacgttctcatttctcttctttaattacgttgtatatgaagaaatttcctatatgatatacaccctccgtttggatattttggttttgtccaaagtcaaacttatttaaatttaaccaagcatatagaaaaggtatagtagcatttataactccaaattaattttattaaatctatcattgaacatatttcaataataaatttgtttggaaatattactatgtttaatataaattgggtcaaacaaaagaagtttacttcaaataaaataaaaacatcttacattttgaaatagagagaatagtccttagatggcattgtagtgggttataataatctccatgggtacaactcgttttatatttcaaagtggaaaagtcttcttttctctaataaggggatattctcttattttttgcatgccatttaaatagttatgaaaatttgataatatagatcagcacataatatatcactccacgaacatataattttaaatttgatttatactccatccgtcccataatataatggatttgttcccagctaaaaacaaacctctctagtctaatagcaacaaacaaaacgaagattgatccccaaaatattgaagaaagcctgcagatatctaggttggaaagcgtacattccctttgtcagaggttagtggaggaggtaatggagtaggtgtttctggtcgtggcttcggtggtactggtcacgggacgggaggtgccatttatagaaaagattggctacaatagcactttatgcacttacttttggctattctacatgggcaaccctgggaaatgggcttcattcaagtcttggtcttttcggattcacttatttacgtgcattttcttaaggaaagagcctatctacccaaacctgatagatggatgtaatgaacctagcatagcgaattcttgaagttgaatataagaaagaaagcctacaagtatagaaagaagtgctagtatcaaataaacataagtagttgagtcagcataagtagtttattgcttacgccctttgcttcttctttttctcctagatcctatattgcttcccccttatagtaatgattttcaggtcagtttgagttacacactaagctgcttattacaaaagggcaactcgcttacgatccaacatgccaagcctggtagcagaaaaggcatgcaacaaatacctagcttgaaaactagagtataaagtagtttagtgaaaaggaaagtagtttagaaattgttacaagaatgaaaacaaaaactattaataaactgaatgcaacaaagaatacaaagctaacacccgaggaaggaccgccgctcctttcatatg

SEQ ID NO: 48156 - DNA, 3073 bp, Oryza sativa
aacattttggatagatagtccattcttttcttccaacgttgaactcttgactgtgtttgtttgctggtgaaaaaaactgtttctaaaaagaataaggccggtagaaatgctaactaaagtcgtagtgaaagaccagttatgaaagagaaattcagtcaatccttccaatctagtatctataaaagaaagtaaagatgggatgggattagaagcactaatcaaaggagatttatttgctgtcatcgagcagggctgaatagatatctgttctgttggcgaatctcgggcatcttcatggctaagatcaaaagaagtgatttaattagtaaaagaaatcgatcactgcttggactccccgaatgggagttacttttcttttcttcatgcaacccctgcaaagtaaaggtgaacctaccttacccaataaggagtacggattacccgtgtaccgggcctagataatttctttaattcgctacaggtaagggttagcacaatactccctaagactcaatcccgcttccttgtgcggcttcgtcgaggaattacctcgttagcccacgcgaactagctatcagctattagatagcaataagaacacctttctttcgtaagaagggttaccgaatgattgggaggggaagtaagcttggagggttttaccagtgtgtggcatttaacaacattcgtaagtcgttccagctttccaaaaaacccagtctcgcagagcaccaattaactcttttaggccagtctcaggagtttatttatttgagcctctgtctcggataagattagtgcgagccacatccaaatacctcggtcaaattattctgtttattattatattaggccgcaggtggtagaatccctctgtctcacgagcaaaacagccaagtaagctaagtttggatctggtaaggttgggttaaagccaaagtaaggaatgaatggagaagcacagtctggctctataagtaaggaaatatctctatccggttatttgtagtgaaaatcagtctcgaggggagcaagcaaactccaaattaatatgaatacggacctggttcaacaagtcgaaagtcataggaacttagagattcggtttcttatgtaactcgcttgctagaaacaagtcttggatgccacaacttcacatccagtcagtaagtttgtaagtaaggtaacttaagaaaagcgagccagataagattgttaagaatcaaagcgagtgctgcagatgattctgattttctagtaactggtcgtctgtacttaaatcaaatgaaacaagagagcccacttcttacttcttgcaggtgtttgggaggcggctaagctacagaacttgtagttcaagtttacgagccagattggacggaaggagtataagattcagatttggagctaacgagcctagcaacagcttagttcttttgtaggtaatcgatcgaatccgcctagaccggggaagatttctaagaaagcaggtctagcattttaaacaacatttgccaatgcacaaagtatggtaagtaaggtaggcttagctgactgatgcttactaaatcgaaactttgacttctatatccaactcagtctttcccttaagatctctgctgttggagatagcgtgggcggcccctcacttttattcagaactttgatggtacgaagtgcccagtaagcctggctggaagaaaggaatattaattacaaccacttgtatacagcttagttggactcaaaggatataagggaattggcgctcgctcggattcattttccaggtcctacatgttctaggactatagatgatccaacatgcctatagttttcattattgttttatgctttagcctccttttataagcacgcccatgcgagtcgatttcaagatgtcaactttgactatctttctcttcttactttacttatcccttacattactttacctagtaactttgaaataggcatatcttgtctaccttccatataccctagcatttctactagttgttttcttgcatatatccaacctgaaataccattgcttcttgtaggtttttacttctactttcttgactataattacctatacttgccatcccgtctttctattccttttgaaagtcaacttgtgactgacacagccttcgaagctatgaaaagacctattatgtatagagcttgacatgccaactactatagctatagtaagtagttctagctattcctacttgtttttttcctacttgactagtgctgacttctttgcctatgaaaattcttattattctccaaactgtggtatctgaaatgacccactttcctgagcaaaagaaatcttactatagcacggtcttacgtccaggaatggaacattccatctcttcttgtccactggtatagaaagaatatgcattttcttgacccaccgaatcctaatcctcatcttcaagggtccaccagggcttccaaagctagactatcctcggcaaagaacctaagggcgctccaccagggcttccaaagcgaaactatcctcggcaaagaacctaaggaattcctcgaatcgatagactttcgtacaacggcaaacagagagagggttttacgctacttcacagtcataagcaagggtggaaggtataactctagccggcaggcaggagggaacgaagctctttcctgatcttgggctagaatccccgacgttggtagatttcgcagtggtgtatcttaggatcttaaaggtaagcaacagggttaatccctatcgaaggaatggggcttttcttcacttcagcacttcccctcgcagtggattccactaggttcttaacctcttcccaattcttaaactaaaacctgcgatgtctaatccaactcggcacctaaccaacttgtcagcatcgtaagtttgcctcaacattccccctagaaatagaataagaatgtaaatctactttcatttatttattagggatgagactttcttatatatttttataataagtatgctctggagtaaaaggattcgaacctttgcatgccgggaccaaaaaccgat

SEQ ID NO: 48157 - DNA, 1722 bp, Oryza sativa
acggtcggttcccagggagagggggaagggagaagcagggctcgaagaaaacgagccgtgcaaggacgcggggatatagcaagtaagctgcaaggttttccctttaggaacggctacaacaagctcgcgactctaatagaaacaaagggtcagctctctgctctatttgcttgcaatgcgttgcctatcaaagtcggcgaacgcttccaccccctcttgcctttgttacgcaacacgccaacaaagaaccttggttccgttgcgccctgtattccgaggcgaccatttcgcgtggttcgacccatttcccgatccgaaaaatccgataacgtacctatatgagtgggatggatggtaaatcatttgcagtctttttcggcaggacctagacacggaggttcgggaagtagcgcatgacagcattcactggtgaaaggactggtagcagcgagagcatcatagttgacatggtcggagctacagtccccatatccgtctctactctttctgtaattgactccctcccgctcccccttttcctttgaaatggttgagggatatgaatctggatcccgatcttgtctctcggactatcccgtagtggttctgtgaccgtcaattggatctatttctttcacacggtcaactggcattggtttaactaactggctggctgctattgattgatatcagagcccgagcctttgcccctttttgcatggtctacctcctatcggctactgaagcccgagtatcaaactactgaaagcggaggttcaaatacctcggtacctgcttgatggtgctggcagatcgactacttggtctggggtgtttcgtatcaatccatgggggctttagtcatagcccccgcctctgctttgttcccgctctaggcttagaccatccttcgtcagtgcttcctgtgcttctgattatggagctgtacgaccttccgggtcaacgaattaaatgaaacaactacctctcccgtccatcaaaaagtgttatttcctccagctctcgactccgcttctccctccgatgccggtagattaattcattgacaaaacccattgattcaaagcaagaaaacggatgcgcgtgctaacgctttcgcgctagtgcactcaatccgttgcttgtttggaacaagagttttcataaaatggttcttttatgcaattatgaacgggcaggtctcttgtggattcctccaacaccatgaatgaaggggggagtatgaggaaggccgattttctttctatatgaagatgaaaaaaggatcagggtcaaacatttcttacttttgttgagtatgactgaatgaggaagagctccttatatggtatcactttaccaccatctgaaatgcgcgaaactccgattggtggaagccagtccatgaagattcccccttctcttacgtgaaattcccctctttcggtaagcatccagtatctcagcaaatgaacatttctctaagcttatcctgtagcttatacgtcgttagaaagctgctccaaggatccaacgaatagctaaggtttgttgacgatccctggctacaatcccaggaacatcataaatagtacctgcgactcctactttgaccacttcgcatattggctttatattatctacggcgtcaaccataagtttgattacatcgcgttcagttcgagctaggcggtgaaaagttttataaacaatagcacgaac

SEQ ID NO: 48158 - DNA, 9982 bp, Oryza sativa
  unsure (1)..(9982): unsure at all n locations
atggtctgctaactaattctggtgaacccaatgatctgtatgaggcacttgatgataaaaattggaagggagcaatagatgaagagtatggtgctttaatgcgtaataacacatggcacttggttcccgcaactcagggacacaatttgattgattgcaaatgggtttataagataaaaaggaaggctgatggtactattgatcggtacaaggctcgtttggttgctaaagggtttaagcaacgttatggtattgactacgaagagactttcagtcctgtagtcaaggcggccacaattagactaatattgtcactagcagtctctaatggatggtctttgcgacagctagatgttcaaaatgcttttcttcatggagttcttgaagaagatgtttatatgcgtcagccacctggttatgaagacaagtcaaagttggattatgtgtgtaaattagataaagcactctatggtctcaagcaggcaccaagagcatggttttccagactaagcatgaaattgcagaatcttggatttcaaccgtcaaaagcagatgcttcgctcttcttttacaagaaaggtacaatctccatatttgtgttgatatatgttgatgacatcattgctgctagttcttgtgaaaaagcaacttcggcattacttcaagatttgaaagaagaatttgcccttaaggatcttggtgcattgcactatttcttgggcatagaagttaataaagttcatgatggaattatcttgactcaagagaagtatgctactgatctgttaaaacgtgtcggcatgcatggctgcaaggagatcaatacaccgttatcaacaatagataaattattggcgaaagaaggtgagcctctaggtgcggaggactctacaaggtatcgaagtattgttggtgcgttacagtacttgacattgaccagaccggatatagcttttccggtaaataaagtttgccaatatctacatgctcccacttcattgcactagacagcagttaagcgcatattgagatatctcaaaggatccttgggacttggtcttcgaatttgcaagtcagattcaactctagtaagtgcgttctcagatgctgattgggcaggatgtccagatgatcgcaagtccactggagggtttgcagtattcttgggagctaatatgatttcttggaatgctcggaagcaggcaactttttcaagatcaagtaccgaagcagaatacaaagccttggcaaatgctactgcagaaattatttcggttcaaaccttactcaaggaacgcggcataactcagccgcgggctgcatgcttgtggtgtgacaatattggtgcgacctccttatcagcaaatccagtcttccatgcgtgaactaagcacatagaagtggattaccactttgtgcgtgaacgagtgtctcaagggttgctggatattcggtttgttcctttggagatcaagtagcagatggcttcacctgtaacctacctagaaggcaatatatacaaggcggcctccattgtggaggttaacacgcttcatcaataggttacacaaatttacagtgctaacatgactgcatctctacacgccagcatctccactgtgctcggatcactgatatggtatatcttcgacactcagcagtgacaaagtttcctgtattatcccgtgcaacaattcctgcacccgcaactccatccttcaagttcagtgctccattagtgttcagtttcatccatcccaaagcaggtggagcccacttctgaaccacagccgatgggtcctcctgagatggaatctccagagatttaatgagctcatcaaccaattcaacagaccttaacgactggtacttgacatcgccatggttgtagctgtttcggctcccccagatggtccacattacagagactgcaattgccgcctcccgtttgctcatgatatctgcatccaacacgtcccacgaccatgtagctgggtttaaccgtggcatcttgagatcaaaaagatcctgagccgcactccaaaacaattttacatgctcacattcgactaatgcatgaaactttgtttcattgtcattgccacagagaggacaattacttatttctttcatatggcttctgcggagttcagcagcacagggtagcaaatttttcaccacccgccaccagaacactcttatcttaggcattatccggagtctccacagtgctttctaggtagcctcgttacccgtggacgatcccgtagcaggttcagacaggccacaacgctgaatgagttccctgtacgcagatctcaccgtaaatatgctcgttttgtcccatgcccaagcccaaaattcatcttgctctgttctcggccttggcatgttcagaatagcagccgcatccaatggaaggaaaatccgctgcaccttctccacatcccattggtttgtattatgcaacatgagatcggcaactaactgaactggatcatcagtcattctccctaacggcttcattgtttagtagtccatctatccattgatcatgccatatttcagtggtacgaccatctccgatcctacagatcaatcccattctcagtacctctcttcctttgatgatccaagtagacgaggcacctcgagggcaattagcagatagaatatctcctcctttgctgtatctccccagcaaaacacgtgcacaaagactatcgggcctgtccagcaattgccaagcttgtttggccagcacggcatcgttgaaactctcaagatcccgaaaaccaagtcctttttcattaaagaagcaaataaatgacttcaggggcttgtgtgttgattttgttttgaacacatacttgaatttctccttgctacctaataagagttcaaaagaaaggaaggccctattccagtcaaaagtactctttacgctcacgagcagtcctatgaggatcccccctggttctgactatgattcactagggcgaagatctaatataatctggttcaagttttccttttctatcgggccatggatcaccttccttttttccatttttttaacttgatcacgcaacatttctttctgctttgacccaattgatgactttgtcaaactccgtaggtagggaggagtggtctttcaggattggtccttgtgtttcactactgtacacggaggacctcctcttttttatgcatcttttgatttagtttttgcaatacctcattcacttcaagggcaccccattgcaactaatgaataatgaatttgctgtcttctatctaggccgacaccgggattcaccacaaccctttgttgtattcttgaagtcaatccatagtcatgagttctgattaaagaaagcaagccatacatacatcagtgggctgagaagcaaatagttcccccgccactccatgctatatttcctgccttgaccctatcaagcaagagaagagggttgggggtgtgctgtgatggtcttactgatatagaacccttccctcattgaaaagaaagatgccctcacccgatagttcttcttgctttagcttggataccggataagttgatctgattcaagatatcttagaacacagcacattcagtgcataggccggccatcatctctctccttggataagcaggatttagcaggaaatatcgacagcatttcctatagaaaagaagcctacttggttgggtgggaggatgaaaagattctcttcctactggaagatggcactgttgaagtctggagagcggaagatatttaagtaaggatgttatgccaggtagcattcggtacaagagtgagacggaggtagctccgtagaagaaagtagttttgcaaagaagcttgttcttcggagtagattggcactacggcactactagcttttgaacagaagaaagagtttgttttctcgtcataagtgccaccaatctcgttcaggcactaaactagtttctgggaggatggatggttgtcccttcttctcaatagaatccgatagacaagaatcgaaagctgcagatttttttattcctcaagtaagtcagttgatgattcaattccatcaaagatggcaagagcggggcatctagattgattcgtttttaaggttgttataccgaataaaaagtattctgattctctgttgaggcaagctattcatcattaacaggaaagatcccaaagctgttattgcaaacatgggatagcctgactctacgctacaatctctattttcttatgatattgaatctggcttctattattgaatcaggcttctattattcaatctctagttaccgtgggaaaagaaagagataagagctcttagtgcatgcctttttttttgtgattcgagcagttcttgtcacaagatgatgggccagagaaaagtttgataggaaaggaaggcgacagttaaataaaaaaaaagaaagggaagatgatactgatataagagtactgctctttgccctaagattacgatcagtcactttttatgtttcaatcagctcctcacttcttattaaggttttcgcgaccgacacctagttctttccacatcactccactgtttgagcaatttccactctccttcctggtcaaacctatcaaaaccttcgttcaagaactcattccagcccatgccttctctgactactcctttcactttttgaagtgtatttatttggaacaactttaaatacttctcgcacttgtcaacccattccctcgttctcccctccattaaacataggaaatttaaccccaatccagggtcaaacgaagatacttgttagcctagcatcatgtgtatctgtagccttccctatttttgacaatctcctatttcttcgtagcacgtgtctccttcctatgttccgtcccctgttactggataagtagattttctgtttgaagtgcctagaagatccagcaaacggaggttatctctcccgccttgagtttcggtcttacgcattcaagcctagaataaggcctaacaatagggtgtaaactttagcgaacttccatgcttatataatccaatcaattgcaccatgattaatccactagacaaaaggaaaccacaatcactacattaaccgagctatattagccgcgctttcaagagcacacatagaaaccacttaacagtgactccttctgttagctattcatttcctgggagttcagactgacggttaggttctttttctaaatttacttaagaacttttgggcaaaggatacaccggaaaagaagaggagcctttgttcgtttggcattcgttggggattcatttctcgttttgcgattagattcattgctcgtcgatatggtttagtaaaaaggttttttctttttgaaaaccagattcatgcccagaagaggatcctctatctgctctcgaagcagtcgtcagcctaagcttaggttttaaatccttaggttgaccctacccctttttcttcctttccctatccaacccgagctctatcggtcatggctttctcctctcttcaattctttccgcccaaactaatccgcactagccccaaaccctagccctgttgtctggattcccgatctctctcctacaagaaaaacctattccactaacgactctctttgtcttataacttgctaatacccacatgagaaacggtttcccctcgctttcagcctcccattatgtcgtaggctctccggaccttccattatatttgagagatgaaatgcgtaattcaagtcatcaaacgagcataatgaaacatccaatgcctcgagagaggaattttagagacattgctgggcccttagcctgccagtcaacttcagcctgagatgtgcccgtcaaaccactcgaaggcggcgatcagatgtgttacacattcaggagacttgacaaaaatggctaaagatctacaacctctcaaatatccctaactcatactcatgtgaatctagttcccaggatgtgcactagattcacactttcatcttaagcatgattatacatagcaaacacaactaagatgaaagaaacttaagacttacaacaacttaataattacataggccgaccggccaaatagacttattagagaacagcggaagcttgactacccaatcacaagcacaccgactaggggtttaccccattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctactatactacatgtaaggcatatattcaaaggaaggcaatatgtagttcaatttcagcataaagcaagttttgttttgcaattcttttgtaaaggagttgatgcttcaattaacaaagacaagttntaagtttcattattaacttcttcataattccatcataaacaatctctttttgccatacttaacaataagtcataatgtatcaccacatacacaactcaacacatttatcaatttcaaacccatgtcacatgatcacatttttaaaacatagtctatactcatgacacatcaccaaagcgctcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagagcctagccttgcaccagcacgatacgtgttcctccatcctaggcatacttggaatatacctggaaccgttaagtggcgggcccacgccttaaacttaacgccgtggtggcggacacgacgggaacccaccacgtggcacaataccgttgtattggacacgcttagtcacctaaactaccacgtcggggtaaataggaagctcctctgaattatacgaactcatacacaccggcctaccagaatgcaaagctagtcctaaatagattactcagcttaggccatcccatactagcacatgtggatgtacgaataactttaaatgggtgacacaagttcggtccttatcgacttgggcaaacactccccctatcggtatgcaactaacaccatatgcacaccacttgccgcccaagtataaaatcacattttacatattttagttcgtaaatacccatcatattcattttattccaacaaaggttcatatatcaaaatcatattttaattatagatggaatgagcatttgcatagttctaagcatggctaagcaagtagttacaaatagagcatatataaacccatttgagcacaaagagtgtactctaaccatttctaggggttcaaacagtaagaggatcaattattcaaggtggggtatgcagcaaataggtcataactaccttaacccaattttaaataccgatataatctaagttcacatgcagctttgcaaacaaacattttcattcctcaaatcatgggattcaatgtgttcaaaggatgggaggagaaaacttgccttgatcagagaattgttagcacctaatccacttcttcaccgattatgcaattatctagaaaaaggacacgacatgcaattaaacaccggaagaggtgaaaatccaaaatgctctaaaatgcatgatttatgcacagtgggttggaaatgatctaaaatgaatttaggtgaaataattcctattttattttattccatttgggagttatgaattttagaatttttatcggtttacaatagtatagtcttaggtagtgttatgaaatacttttgtaaagtgatttttattagattagacttcacaggggtgtggagatgtgttttctaagactaacacatttggtttcacaatttttggaattataatgaattctttatgcattttacaagttataacgtgttttagacatatagtgttttatatgttcatgacttttgagttataggttcagaacatgctacttcctgtttaagttgaataaaaggaataattcgcttaactaaaacatttttagttcacatgtttatggtctttactactatggttcatattttataaactagagatgctctaatctaaactagcaatatattatattaacctagaaattgttatatgagctaagttcttctaagttttagtggatgaggatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacaaaaggtgacaaattttattttactatgttgaagataactatttgctggttctatagaaactttgttcatttcatttggactaaaaataaattttctacaagttttacaaattaatggctgctctatgttagtaaattcttatatgaatatttagagacttttactacacagcaagtatataatcttatttcataacttggaaatacatgttttagtgatcctacataacttaagtttattcaaattgaagctaaattgggttctacatgaatttctaaagtttagcttatctaaaactaatcattatagagataatagttttagaggcatttgatgcaaagtaagtcattacttttatttaacctaatcagagagtgtctgatgatgaatctgcagtttttgagtttgtttcaaaatgagttgaaatgaattttctatgtattttataagtttgtacatgttttatgcatgacttatcttagataaatcttagagacattatttgtacagtgagtgtcaagttttatattcctggaataaagttcataacttcaagaatctacagcaactggaatcacttcaaaatgagcttcatttgattttatatagattttacaactttgtgcatttttctgctaaacatgtatttgtttgggcattttcctaatttttcttcagattttaaaggatgggtccacatggctgtgagggaccaatatgcacaaaggcccttgaggtttctaggaatcaacccgcagtcctaggcccatatgtcagttactaatattttgcgcaaaaacccctggtttctcgggaaatagatcccgcagtcccctagttttaggtttgtatgcaaaacgatgcttgagttttagtttatttacagattattactggtcctacttgtaagtgactgttccagttgttaatacatccctgggaatctttaaatttcaaaagccatgcccttgctctggacagagcagagcagcagcacagccgcgagcttcacagcatcaccagtggcgaacaacggcgattcagcttaagctcccaaaacaaaaagtgtagagaacaaccgtgtgaacctattggtggctttctggcaagatttggtgctctatagcggctgttagggtgttagaggcggtggctaagctcggcttgcacatgcatgtgggttttgaggctcgatttaatcgtgcatgcgtatgataaggactctagggactactaggaggctcaccaagaatcaaacgcggctcggcgaagtcttggcgacggtgtactggttcggcgacggcgcaactgctacggtcgtcgtcgacggtgtactcccgggcttctactgcatatagagggtgcatgcttcggtttagatcagcacaaggtagctctaggcgaaaaatattgcgccgaagctcaccagagaaggagaaagaaaggaatggcgtcggcggccagagttggaaaaaaaaaagaagaggatctcccaccgtggtccacctcgcgtcgattccttcgggattcttgatctacagaagttgatgaagctc

SEQ ID NO: 48159 - DNA, 13621 bp, Oryza sativa
tgaacggaaatggagctcaccggattgcgacggcgtcgaggacttctctcaccggcgccggagttggcacccccgttcccggcgaatccgaggcggggtacctcggttcttctgcgaaacgagacaggggcgagagagagtgagagttggtcggccagtcgggttaagtacggtcgccggcggagatggggaggaggagctcgccctcttccgcgctcaacgcgtgctcacacgcgtggcgcgcggggtctgagtcgtgggcctgtgtggagagggatgtgaggctgacaatggggtcccactaggcaagagagaggtgtagaaggaggaagtgttggacagggctgaacctagcctaaggtactgacaagtggggccaactcgatggaaactaggccagggagagagatatgggtagaagactggtaaacttgatttttagattaattttcggaattattttctcctctaactttgtaactacataattcaatgtgtggaccaaattaattagtgttgattttactggaggtaaatgattacacctagattccattttctttggttgcactaaaaaataatgggtggactgctcacagaaattaaacaaagatgggctattagaaagctagattgaatttttaggaggcttaaacagagaaggaaaattctagaaaaattacatttattcatgataactaatctagtatttgaataaattattttccatgttcacttatgtgcagttaaatgtacttttggatgaaatatggttttagccgattaaaatttaatttgatttcttttagttgtctgcttcgaccgattaatttgagatatcaacttgagtgttaacacgttaccaaattacggaggataagtttgtgctaatcattgtccacataaatttttccatgattttatcttgcacaaaatattttagagaattaagttgacctttatttgtatatgtgttcccacttcataattgcatctaatattattatagggattacattaaacttcttttagactgagaagatgatatttgagtttaatattaagtccacatgttatcacccaagattaactataggtttgtttagtgaagtaattcttttagattatgctcatgggatctattatagaatgcaagaccaaaactccaaatgcacaaagaactcgagcctaggcatgcattatgtacatgtatgcttggtgacatttctagtctaatgttgggaatgaaaaggttttattttgttctcaaattttaatcatgcaatggtttaagttgatcatcacctaaattaaaacggaaatttttggctctcaaaattggagaaattaacctctaactattttgataagaaattttaagtcctaaaatttcgggtatgttacacattataagctagatgactctactgtgacatgttatgacgatctggaagcccccaaccatagatagatgctttgatcatccaggttttgccaatccacgaactgcatcgtataataaccgcggatatcaggcgtaggttgaccttgagtggttcactgaagggtagggctatctcttccctttccatgcctttgattcatcccggattgtgttgatgtgcacatgaacaaaagtgcacattcctatccccgaagcaaataaatcagatgacttttccgaagcaaagaagaagatgatggctctacaaggcacaacaccaatggaacagtggaacgggtatcttttagcaaagcaaagggaaaggaggtatcataccaaggggttgaagaaagggtttaaccagcggattcgcatatctttttccaatggcttccgcatccctagttttttaactcctggtttcgggtaacggttatgggtttggcccccttcccttggcgagcataagaaccattcgtatacgttaggagcagaagttgacgtgggtatactcttcatttcatccttttcattgaatcccctatcctattatccagcaacgcccaagctgtcgatgatcacctagctcttgttggaagcaattgaagtatactctacatcaacatgggattgaaaaggtgagggcgtagcgagcgctagagctattcctacgaaaaggggagctattcctatgattcctagtatccgttcatcgatagactgtcctcgggcaagggaaatatactaacactattactcaacccataataccctttccaagggctcaaaacgggtctttgctacaatccaatccattttcaaacaaaagaaaagagcaagttcccacaggcgaagagctgcttccgagaaatatttatcttcttttaccccctttacgcccttcgcggctgctaacaatgagctaatacacaggaacggcacggctcctacaccgcttaactccaataacagaacctggtcccacatcccttgcatttgataatgaaacaatcagaatttgttgaattgaacatatttcaatctcatttcttttacgtggttttggcaactatcaattatctctttcctcggcttcctacacggatatagccgtaaacggtatctagtaggcaacctgggaactacattagcttagggggatcgggtagcgagcgctctcctcggcaaagcacatgattgagatttgaattattgtattgtgaataaaggcatgaaaggaatttaatagtagttaggtattaaaaagaagatctaattcaagtggtaaagcaagtatataatgatgataaagtccagaggaaaggaatattgtttcacgcctgcatagacaagtaagtctgccacgaacccctgtccctgccaagtagaaagctagtaagcaagtactgaacttcaatcctgcattctcactcttgtttttgtcgctcaatccaaagaaagaaataggaatacgaatcctcatccccaaagcctgggtcctagactactacgaatagaaagatttctatggatatcctttgtatcaattttataatgcttatcacctccttctgagctattcccacggtgcctgagcagttgccattgagaatgttgtggggaacgattgggtgacttagcacaagcagcgcgtaacaggtcctttgcagatggtaagtacctggatttcagaggcattgctagatgtgtcgacttgcgagacgagattgcggtgtagctcttgaaagaaagaaaaagaggggctcagtaacggcaatcaacggctcctcggaggcaacctagccaattgagtagagatatgaaatgacgagcgaattacccgattcctattatgctacgccccgggatagtaatagccttgtttcggattttctagcgatgactagccctttgacggctcctatccctagacaccggcccctggtaccaatactagagatttgccttggctgtagttcaaagaagttcttcggctttgggaagatgcgaaccttataccattgtccttggatagatatgaaccttacgcgggcagcggatgagcatatccctagaatacctgcctatcctacctaacgctgggttgaacctaacgctagagcgagtactacgatgcaagctccttttacaagcgatacctttgtctttggtgcttgagttgtcctcctagcggtgtgctcctcggtttcggaaatgacatattgaaccggtatctttagcaaagcccaaatccggcagacccctttgacggcatccctcctctaaagctgcttccttccttcaagcaacgcattcacgaaccaatacgtagtacacgacgtagtaaatcaattaaataatgcaatccgggttaaagaaatgaaatggttgttgccttctcggacaagaaggaaatatcactctctatctaaatgatagaagtatttaatcaaatcagaaagagccctgggatttgaccaaaacggcataattgaaagctctcgtctctgccgctcgcctaagaaaaggtatcgggttgctccgtgatgacgaataagcagcccagaaatgaggggaggagactctgcctccatagtataagttgctatccacttatgcttggtttgtgcttgaccacgaaatcttgcctcccaccatcatgaaagacagatgatgatgtcgatttcttactgtcgagacagcctgtccgaatccaaatcatttgacttcctcctttgcagtggcgaggtcgttgattcctataaatcaagatgttttgttgcctgcttctttttatgagccttctctcttggatggtattatccactggtatattgtgaaagtctctacaaagacgaaaggaccccatgccttctttgaaaatgatatccctcttcaatgcttccgctagccctagactcggaatactctgcttaagagatccccctctccggccagagaggatttgagtacaacattgattgcggaagatctttgttcctattatttcaaagcctaactaggcgcgcagcggtgagtgcgagctgctttcaagaaatgctggaaaagagccagtaacgctatcagtgaatagagctggtgtaaagtccggctaaagtaccatacagccccacaggtttagccacacattcacagagcatctaatccatcttttcccatgccaaggaaaaacaaaaaccaaatcacctcttagtgttgcttagtgctcatgtgcatcctactgggtagtcctaaacttcagtagttctatgaccactacatgatggaatttaggctatagtaacacaagttaaggttcccacagcaatgagggctttaaaatatactccctccgtccctaaatgtttgacatcgttgacttttttaaacatgtttgaccgttcgtcttattacaaaacttttgtgaaatatgtaaaactatatgtatacataaaagtatatttaacaataaatcaaatgataggaaaaaaaattaataattacttaaaatttttgaataagacgaacggtcaaacatgtttaaaaaaggcaacggagctaaacatttagggacggagggagtacctcccagcccttcatctctaggacgtcggactggtcaagcggtactatgcacccccactttggtataccctcctaagaggagtacttgacagtaggtggtgggtttttggggatagtatgactcggcccctggaccatgccaaccaagacttcccaccaggttttcctatttggggaaaattccagatatgcaagacgcatatgcatgcaatgcttaggtgtagtgaggtggtgtgtgcttattgcaaataggttaacccttagtttatacaaactacatttttcacaaaggaaagaaatgggaatgttggtgaattttcaagtcaagccatttatatttataagccaaaaacctttgatttaaggcttttattcccttgtggagtcgcgtgttgtacgcccgcattttggcaccgcttgccacatcatcattactttggccacctaagcaacccagtagaagaaaaaggggtttagagtcgccacctgaaaaatcactgaaaatttggaataaataaatggatatatatatatatatatatatatatatatatatatatatatatatatatatatatatatatatatatatatatatagtggctatcttccttcaagtgagagagaggatcgagaaaccatcgcccaaaggtgctttcacgaaagccggtctccgggggtaaagaacctttcttcactcttccagccttccaaaccatccactggattttcatgttcgtaagttgaaaggaatatgtgtgtgttgtatataaataaaggactttcgatttagcgttgtcatttttacgaggttttagataatccaattttctgtgagattactttcattttgactgaatcacttgaatcagttaaaggagacgaggcttctggcccagccagaggggctggagaggagagttttgaccgcgggggaggcaggtccagttaacggggagaatccgctaggctgaggttaaaaaaatcttccaaaactttttctttagagatagaattcctcccgagaacacacgaaacaaaaatatgaactaggtaaatagaaatggaaaagagatgtttccaattcatcacaaaatctaaagctttttctacatccatatgatctactttagtagattggtattgcccatataatgaaagcagatcttggtccatggagtcccaagaaggttggaactccaacctgtccgatgctttttcggccaaataaatagaaaagtgggaccagcacaatgagcaagctgcgcgaaaaaccgcttctttttccggttccgcaacaacttgggcgaaatggggttctaccgggaaaccatggtcgagtttttgaccttggttactggtcgagccactggataagaatctctggagatctttcctctccacttacttgtaacaggctttccctctgtataagacttcttccgaatggcataattgtcctgtcctattgacacctcgatctttaaagaaaactgactcctccttctcttttaggatttgattgttgttggtccttttttcagtaatgatctcaccatagtagttcgcgcgagggactatcttttctatcgcttgcttttcactctcaagacaacggtcggtctctctatgctataaagcgaagcaaagcgcatggcgctgaaagttaagaaagctcaaaaacacacacgaacacaatgcaaggcatagcataaatgagaccgctgatcattttgcttgacctttttctatgctttttttgggtgactcaccaaccgaccgagcagtgatcgatgacaaaatggtacgaacaaatcatagtcgttgaccattataccgtgctatggcacactactagatagattgtatggctccgttggtgactttctgatcacgggtttcatttgaaaaactccaacgccattcatcttgcgtccggtctttcatgcaagagttttatttttggccgctactacgttcgtcgaaaacttcttgatggcaccatcatctcattaccttatttttgcccttcgacttcggctatgaccaatgccccacctagctgaataggcgtaacaaagctacctgaaaaaggcaaggtgcaccttagattgaaatcgacaaattgcgttttgccagatggattctttagaaagattcccggataaagttcagtaaaatatttagttagaatctaaataaaggtgcatacgtgggcgggcagggggccccactacttcttcattcaggggggctagcctcatgacttcccactgggcgaggggtgcgcctaacccacctactcattcatcaattacggtgttcagctgacttgcacagaaagacccctattgtttagtaatttggcgccccatcttttttttgattgactgttgtcaactaatcttttcaatgttcgattctactctatgttagaacatttctgtgaatgctatttcgatctaagtggtcctattctctgtcccgtgctaggaagcattactcttcttttcattccaaattcttctataagactgatacgattgattggtctgtgcatttctcttattacttttttgtatccccttgttcctcggatacaattcgatccttctacggccaaatctcaatttgtggaaagccttcgatggcttccttatgaaaacatccatttgtatatgggtatagacggtctttcattattcttagtgatattgaccacatttctgatccctaattgcatttcagtgggttggtctggtatgagaagttttaggaaagagtatattacagcatttctaattcgtgaatttctaatgatcgtcgtgtcctacatgttggatcctctactattctatgttctttccgaaagtgtgccaatccctatgttgtgcggagctgagcatcttctattcgctgggatcaagcttttcctctgcaggggccttttgcagtaaaccccctacgggcggtcccctgtcgtcgtaaagtagtaaaggtccccgcgaagctttcgggaagaggggtagtcttgtgtgtaagcatagcatttctagtcgaaccaccgaaccacacatctttttttggtgggagggtactccgagtagtgggtacctcgtaggacctcgacccgcctactcaggtcttgtatggatatgcaggaaggggtgctcctaggtgtgtgtagggggtgtgtttgttcacgagaaaggattcctcgtcaagtcagggggagggggggtgtggacacacttgcgcgaattcgggtaacggctacaagggataaaaataaaggaaactgtacccgaccagggatggacgtaaactcgtaagctaccaagggtagggataatcatctaggtcttattgtttaaaaaaaagccgccccgccacagcaggcaggttagttcctctgtcgttgccagagagttcttggcgaagagaccttaggataagttgctaaaacaaacgggggaggggggggatcgacccgttcagtagaattccgaagaaagactgttggcagcaggtggagacatttctttggcccccttccaaataaatgcgggcagggtagagctcggcggagggttcgagaatagggtagggtcctgtcctaataaagaaaatcaagataaataaaggggcgggtccctttatgcatgcatctttgtacaagtggaggccggaaagatcaaaccaatagaaccgctcacatcacagtagtcgtagttgcgtaaaggccgtcagtcagggggcgaccataacataaggcaatgactttcacagatctctctatcgttagatataacgaacgggcgggtttgaaaggtagggtttttgacggccctaccactagtcctgctagccttctttcgggcaggaagcagaccgggcccgacgagcgggcatctcccgctatgcaagcagcatggttcgccaccactcgagaagcaaaagattcgagagtcaaggcggaaaagacaagcatagtggtctaatgacaagggccgacgacggaagtctaacgtacagttccctgagaagggagtggctacccactggagctttgaccaaccaccaccggtcaattccgctttggggccacccttgactctaccatcattataggggtatggggttcgagacaaagaaagatcaaggcagcatatcagtttttcctatatactttactgggatctgtttttatgctattagctattctgttgattcttctccaaacaggaaccaccgatttacaaattttattaaccacagaatttagtgagcggcgccaaatccttctatggattgcttttttcgcctcttttgccgtcaaagtgcctatggtaccagttcatatttggttacccgaatcccatgtagaggcacctacggctggatccgtcatcttggcaggaattcttttaaaattgggaacctacgggtttttaagattttcaatacccatgtttcccgaagcgacactttgtttcactcctttcatttatactctaagcgcgattgctataatatatacttccttgaccactttaagacagatcgatcttaagaagatcattgcctactcctcagtagcccatatgaatttggtgactattggtatgtttagtcgggcagcggccgttaggtcacctattttgagttatggacacacaagcaaggccaaaacatgtgtgccgggcgtgcgacccatcaacctactagcaataggggggaaaacttagcatgtcgcaacaaaagcatcgattcgaggcgtcagcaaaacaccgccgtctgttcctaaaacaaaaccccttagcgccccggggcgggagtgggggacggccctatgcagacagcaacagcaccggctctacgaagtccgaattgaatcttttggttcccttgaataagaattgttgggcgcggcgaagcgagcgcttctagctgtttcgcttgcttctttcttattgtggcggctattatagcgtggctgaaatgaccgaaaagcgagatgaacctttcaaatcaattgatatagatggcctgatctgttctggtagatcgaaagggtatctatcaataataagggttgacctctttctatctattgatgatacaagatatctatctattctggatccatcagaaagaaatcgatatgtatctgatggagtctacatcgtatgtagagcgcccaagcgcttttttggccagctcaattctattatccatcggtccaatgcactggcgcatctcatgggggggggaagcaaatgtagttagttgtcttgttgttgttcgccgcctcgacacattccccggcatcgtcccacacagaaagaaagagcgtggagccccagcccgacctgtaagtccgctaacgtaaagtgaggagttgagcctgaactggcgaaccgaagtcactttcgtaaccatacttcctacagctaacacgtgttcggtccagcgggaacgcgcagcgcaaacgaacatgagctgctttaccgaatatcccccgctggccatcggggacctagtggtaaggccatgatccgcagtgcaggggaagggatcactcattcttctattggggacaggtgcacgaacgacaactccaaatgtcagacatccgtcacctatacctaccgtttaggtggcaccagcgagatccagctaaggtaaggaacttcgtgtcgcggctgctccactccgctgcggtcttttgaacagaacttcgttgccttcccgcgcgcgaaacgaatgggcgcagtgtcgtgggtcagttttggggcggggggcagagagagaccagaagaatgattcatttggatcaacgagccattcgcgattcagtagaatgtctctctatccatatctattctatctttatatgacgggccataaaaaaaagaagtatttttttatggcatgtgagatgatcgcgcctagtagccacatatcagctgcgctcaatttgcgggatttccgttggatctgatctttcgctttgacgaattcggacctagcgaatggaccgtagaacggaaagcgccttctaaacaactcggtagaagggaaggggcctatgtatttgcatgacccctgcggatttgaccctacctacacccggagccaatcccctagcggtcctgccaccacgccgcagaacaggagctcgtgtggaaccttggatttctggcgtaacagcggtggaagttataaaaatattacggccacataacataggggcctacgctaaggtcggccaaaatatggacacccgaagggcctggcacgcacaatcctatcctatccgagcccgtcattgcatgcacttcggacagccgtctgtagcatcataaagagcacctccctttcgaggtacccaaatggaacgggctttatttgtgttgttggttggtctttctcaacgtggtctatagcacgaaaaaccattctttacaagatagggccgttcacatgaaagataagaaaaaaatccattcttcatggtcgggcgcatttctccaaatcctccaggatcacaagtggaacgctaagcaagggtggggaggctgcgagctccatgtcgaacagaaagaagcaagcagggggtgttgccatagcgtgtcggggagcaagcgtaggcaaccaaactaaataaggctaaaaaacaagtagctagcgtttttaagctggctgccttttctagcgcgcgtactcttctgtggagtcgcacggaacgagccttgtcttccctccaacgactagctcccttttcttgttccggtcacccttctcttgccgtggaaggacttttgcctgtggtgtggtccaacccgtgggcggagtcgccctcatccccccattgctcagtgctccctgcagcttcgctgggctttacccgcgtggacgcgggcttctataagagaatgaaaagctctctctttacaataaaatgcgaaccgcgcggagcccacccttttttgttttctgccgccactgggtggccgctggggaaacacagcccggccgcctgtcgggaaaggggggtggggggatgggcctacctatcctgagggagcatgttgagaggttccatatgccgagccaaagggcagaacttcagtgcgtgatcgtagtatgtcacctcgtctcgtcctcgcagcatcgaagagtacttatgcactatgttccgattcactgataaggaagatagagttggggtggaggtctacaatgtgatactatagtatagtatgccccggggggaaagatgcgcaactcaaaacggaagcaggaagcgtgttgtaaaaaatgtcggaggttaccagatctctgagactaccatcgatccgatagagcggatcgaccagaaaagaagtggagttagaaagccgtatgataggtggtaactatcttgtacggttcggagggtaagcggcgtactctgggggaatattaggctctatcgaacatacagggaattgggggtagcattttacttatgttaagtcatggactggtttcttcagccctttttctatgtgttggtgttctatatgaccgacataagactcgacttgttagatattatggaggtttagtgagcaccatgccgaatttctctaccattttcttctttttcactttagccaatatgagtttacccggcactagcagctttattggggaatttctaatcttagtaggagctttccaaagaaatagcttagtagccacattagcagcgcttgggatgattttaggtgcggcgtattccctttggctatataatcgtgtggtttctggaaatttaaaacctgatttcctctataaattctccgatctaaatggcagagaagtttccatatttctaccttttcttgttggaggggcgaccgtccgttgaactaccaaaaaagggtcaaccaatgtgatcatgacattgtaggtgcttgcgatgggacggatgcaacttccctcataagtaatgggtggcatagcccgtagcagaagtcccctttttttatccattttttattaccacagaggggcccgccctggtgggaccgagagaaagaaaggacgggggaggggggggcgaccatacatggcaattctcgaccgtgtctccgagggacagttgaacgagcgactcatgaatgcgtccgggtcggacgagccaataactcgaacgtgttcggtcagttttttgagcaagaatcacagcgttaccttaccttcaccatgatacggactccaagttcttatggaagagcacgaggagtttccttcaatatgatgatgagaatggaaaccagaagcacgactgggtcttcgtagtctgggatcaaacttatatatcagtcacagtaacgtaagcatgagactttttggtagtaccggtgaaccagatggccgcggcaagggaatctgggatggaggactcgtaatatctctatagatctggcaaaagcgaaagacccctaacgtcaggggctgaccactgagctcactcaggcctcgctgggcgggccagagtgggtgcgaactggaattgccatagcttatggttagagcaat

SEQ ID NO: 48160 - DNA, 2605 bp, Oryza sativa
acactctcaacggatcctccatgcgctgtgttgggcataccatagttcttccgtgcgtctttatcgtggcggaaacagaacaagagggaaagacccggctgactcgcccagggctcgagggcgagccattcgagagtgagtcgaattctgtttacgttctcggtttggtttgggcccctctcgatcttttgcgtataagggaggggggaaggagtctaaatctatggacattaatgaaccaccattgatggacgttgcacatgacacgatcaattcgacttgacggtccggtgctaatagaagtcgcttactctccgtctagcgaaggtgccaggggcagggcttttttgtagtaatagtgggtgggtctcatgggatttcatctatgccggccgtcagaatcaaacgagggtcgaaggaccattcgattcattaagggggacggcccatttgtaaggcgggggccctgatggacgacatcccccggcctcgattcttttgcatagtctgggggccggccgcagcagagctgcagggcatagcggcaccctcgcctggcgccattctcggacctagcagcagatgggcgggccgggcctgaatgaagagcggaccacgcactcagaccggaagatcccagttgtcctggactagacaagtacgtagagatcttcgtggaaccgaggagggagtctcaatcgatcttttctaggattcaaactcacgccacgcacgaagatttttctattgatagagttaagggctcggctcccctgactctaaaaggttaggttactaccaacttgcctctacggaagaggtgtactttgtattgtctgggggttatattatgggacggagtacaagttgaagaaaaaaaatattaagtacatattagttatagctaagaaacggtgatattgtttttcatatataacccttaaattgatacccgagatcttctatagctgctgtagtagatatatccatttttgcagtaaattaattattaaaaaaatagggcacaatatagcacgagtagtgcacgagacaacaaagaaattattgatgaggtagctagctttaagctgttgtgggaggtcatcgcctcaccaactgcatgctaaatatatcgatagatatattatgctttgttatattctgtcttgcctaaccggccgcatctcccccttcctccactcactttaagcatcgatcactgcttggtactactacgtcgcttaatcacttcttgattcctttgctaacctactactccactacttggcctgccacagtttgatagctagcttagctagctagcgatcgatcgacgtcgtcgttgatccatcgccaccggcgccggcggcgatgtgcctcccgttcctctgcggcggtgacgaccccgtgaaaaatagcgaggtacggccgccggcgaggcacccgagagaaggtccaaacgacggcgacggcggccacaagccatcaccacctccgcatgccggcggcgccgtcaacggcaacgggggagctgctccgcctgctccggcgacgtcgccggacaccgaggtccgggcgcccacctatggcgataaacagatcagtcctccgaaggaaggcgcagctgggaagccgcctatggtggtcccggcggcaaatcatccgcaagctcccaccggcgaggaggctaagaaggctcacggcggcggcggcgccgtcggtcgccgcaatggaatttcgtccacggtactcacggcgccgccgccagtgggacccatggctgctccagcgacgacagtgaaggatgctcctcctgctgctgctgctgctgccgccaacgacgtccatggcgatgctgatgagcaacaccctggctatggtgatcacggcgaggtcgacgaccgcaagcctcgacgcagatcatggttgtgaggtgagcaatggcacgcaactacatattggctgtgctgtgaattgtgatcctcgttctttatgcatatgccgctctcggcgctgctggctggtgatcaacgatgcatatatacatatgtgctatatatatttttacaggtttgcaaaaaataaagagacattagttgctaattgttgttcttgtgccctaactagtttgggtgtaatattgtgttaattgttgtattttagtatgtgcacttgtatgggtgttgatgaatcatggacatatatcagtattgcatgatctcgattataatgcagagcaaaatctgcaaatttgttctttttgttttatggaaggatgtaaattaatcttgtcaacttccatctgtttttgtattagttatctgtgtttagtttcatctccatcatatcattgacgacgatttaatcgaactagctaagcttgctaggcagtagaatcatggtctcatggataactggtggagaaaccatctttggtcggtcgaccagattttacaatagttccggttgtattaaaaaccggaactaaaaatatctttagtcccggtttaaaagctatagggtactttttcaatctttagtaccggttggtgttaccaaccgggactaaagatctatttgtagtcccggttgataacaccaaccg

SEQ ID NO: 48161 - DNA, 5561 bp, Oryza sativa
cgctttctccttctttttttttaagaatctgagattgttgtgtgatgtatttgatttgtgtgtgatgtgaatatgtgatgaattttgtaaaagttgtgatgtaattttttttaagattttatgatgtttttgagtatttgagatgatcgatttgtggatttggagacaatttgaggatgattgatttgggattttggggacgggatggagtgaaatcaatatatttaaaaataatgaagaaaagaatataataaaaaggaacgggaaagaacaaccggattagcctctttagtccaccaaccggactaaagatgctttatctttagtccctgttagtaacaccaaccgggacaaaatcgatttttaccctcggttttttcacccgggactaaaaataacgatatttagtcctggattcgtagtcccggttcaaaaaccgggactatagggggttacgaaccgggagtaataaccctttctccaccggtggatatttaacaacaattgtgcatagtggtttgtgtttatgctcgtgtggaccaacggaatatgttcccaagccaagatgtcacaaaatgcatgactctcactcgtttggatgagaaagaacctcttcccattctcttggcacattccattcattaatgtaggcaattcagaaggaaagaggagggggggtggggggtgggtttaaaacgtgatcgacagtaatttgcatgtttggtagacaacgtttctcaattaggaaaggggaacagataatgtgctgtttaaaatataaaaagtgcaccttttgctgaaatcttactactctcgcgtttcatattattagttgatttaacttttgttttagtcaaatttatttaattttgatcaaatttattaaaaaagaaaacaacattttcaatactgaacaaccatactataaaaatatatttaatgtttcaaaactaatttagtgttataagagttgctacatttctcttaaattttagtcaaatttattgaagtttgatttagaaaagaaagaaaaaatcaaaacgactaatcctacatacttataaagttcatctccgctaagtgtagttaatactatttctcacttctctcattaagccacatcacccccaattatttctagactttggatgattgatttatggtctaaattatctcttctttcttctctcataaaaacatgcaatctcaattatttttaggctcaaaattgtatcaaattattttagctttgatagtaaaactacaatttatttgtacatattatgtaacttaattttccgcagcaacacggtggagtattcatctagtagtataaagcaaaggagagtatacagctagtactccttcgttccatattgtgacttgtggtgaggtcttttagttttgtccgcaaaaaaataattttatcaagtttatgaaaaaatacatcaacatctgtaatatgaaattagtttattaaaattaactatgaaatatgtcttagtagtatacttacttggtatttaattactttttgtacaaattaggtcatattacataacttggtcatgttagagaacttttgactttagacaaaactaaattaccttacatggaacagagggacaacaaaacgcaaaagtataacatagagtcatatatataaaagcatgcgtaggtcatggacattaaatattagttgatggccaagacatgacatttatatctaagatgtgatgtgagataagaggtatctatactatctttatagttgatggccagtaatatagatggccaaatgggtcgctcggcatggcttggcccgagcacaaccaaggcacggcccaaccaacacgatgtgccgggccgtgcctaccccgcaccaacagcccaggtatggcccagtcaggctcgagccgtgtcatgctagccagaagacacaattagcccaacgggcccatgccagactaggcaagctaaatctgagacaccttgtacatctcagttttgcacaacaaatgcaaagatgtaactaagttacaacaaattcattcataattttcacaacaaagggaccacatacatcacaattcaattattcacaacttcacaaatctacacaaagccacaaaggtaaagatgaaagtagaacacatatttcattgataaagtaggtgtaggtgtgtagtgcaatggttgcctcgttaaaaacctttcgaggtaaaaactcgcacctcatgagaaaaccctagaaaggaaaagagtacagaccacagctttcaaatgttcataataaagtcttacgagtccaattacagtcatctagtgtttacatcatcatcaagatacaaattctcaaagtacttttgaagctccatattgtccatggtatgccgagcctttgcatctccgtccttgagcaatgccatcacttgcaccatgtatatcaccccacttacattttcatcctcgctccgtgtaaaagagttaacccgggagtgatatggttggaaggaagaggctttataagttggttccacccttgcaaaactagcaaggtggtattaaacatgcgcacacagctctcatggaccacacaagcctcatcctaattgggccaggatgtcacaaccaactggcaactgaatttgtttcttttgcagcaataagtcaaaaatcttgtcggctttattaatgtcaaagtcatatttctcctccttgtttgtatccttgacccattgacacatagttgtcttcttgaccttagaccactcggccaaactgatttcaaggtcttgatcatcatctgagtctgaaacacaactataaacatagttgaccttcttgaactttttagcctcctggaatctttgttcatgagccaataccttctgaacatggtgtgctaaactctcaaagtcttgtgatgaaaatttctcccttatcggcccaatcaatccctggaaagccagatcagccagtggtgaatcagccaaatttaagctaaaacatctattccttgtatctctaaatctctaaatataatctggaaacgattcattagccttctacctgattacggtcaagtctgataacttcatctcttgaacaccgctgaagaagtatttacgaaattgtttctctagatcatgctaacatctgatagaattgtatggtaaagaagaaaccaagtgaaagccgatcccgataatgatagagggaaaaacctaattctcagagcctcgacagccgatgcttcaccacattatgccaaaaatggctaatatgctcatatgtagtcacattatcctgccctgaatactttgagaagtttggaatattgtatcggtttggcaatgacactctgccaaaatattctggatatggatgccgatacatgatcccactatctttaggcttaatcctaaattgttcccttaccacatctacaatcatattggccaaaggttgctgttgaactcctccttgatgttgctgctcatactgattatttattggttatgctggagtttgaacaaaaggaagtgtgtcctgccgatactgcaatggtgacagcggttggaattgattattgatattgaaccttggatttttctaatactggaaagcattagggttcgtgttgcaatacttgtagactcttgccatctactaagacataagtgctaagcctaacatgatcaccctaatgcggaatccttaggttactgaccgttgtttgaagccattgatgctgtttcccttggttttgtcggtgtagaggtagtagtggtagcagtagcagtgtgagaaccggcttgatcccgaaggggtcgccggcgatcacctgcggggtagcggcggccttccggtcgccacctacactgtcccggaaccaccacacgttgtccctccagcactcaacttgatcggatagggttttgggaattttcggggagaagatgatcgtggagagatcgtcacctatccacgacaccggcctcccctattagtatagcgccgagggagatcaggggcaatccaaattatggaaggatttggcgctaccgatcaatgcgcgtaatcacgtagttttggaaattgaatcgcgttaatcctgggtggaaaacggcgtcgagattttggcaatgggtggaaaactgtcgtccgagatttcctctcgatttccatgccgagagatatattttcctaacattctcccccctgatcttgaggctaatgagtttattcttagaaaaatagatttactaaggcaacgtgtcagggtagtaatcatatcctaccaagacaccggtacctatagttcactataaaacttcgaaagaactctatctaatcttaatgggagttagttaggactaatgcccctatttccaggatcttagtcttaatcaaaggcaatcagttattcccatgccggctacatgatctttaaataaattgggaggtaagcctttggtgagcggatccgcgagcattgacttagtgctaatatgctggtttgatcctggattctatctttcacaacatgatacttaatgtcgatgtgtttggcagcaccactcgacttgttgttacttgaatagaatactgcagctttattatcgcagtatagtgtaattggtctagaaatgctgtcgaccactcttaaacccgggataaaattcttaagccatacggcccgccccgttgcttcataacatgccacaaattcagcctgcattgtcgacgatgcagttaaagtttgtttagagcttttccatgaaatagctccgtttgtgagagtgaagacataacctgatgcagattttttagtgtctacacaacctgcaaagtccgcgtctgaataacctaggacttcaagttcttcagatttcttatatgtgagcatgtaatccttagtgccttacaaataacgcaagacctttttaacagccttccagtgatctaaacctggattggactaaaatctaccaagcatcccgataacaaatgctaagtctggacgcgtacagacttgagcatacataaggcttccgacagctgaagcgtttggtaccattttcatctgatctgattctaatttatttttcgggctttgaaataatccgaatttatcgcccttaactattggagcaggtgttgcagagcacttactcatattatatctttctagtactctgctaatgtatgatttctgagataatcccagtactcctttagacctatctcggtgtaattcaatgcctaaaacataagatgcctcaccgagatctttcatatcaaaattagatgacaaaaattctttagtctgatgcaacatattaatgtcactgcttgctaacagtatgtcatctacatagagtactagtattataaattttccacccttagtcttaatgtaaatgcaattatccacctcattctccttaaatccgaatctcttaattatttcatcgaatttaaggtagcattgccttgacgcttgtttaagtccatagatagatttcttaagtttgcaagccaaatggtccttgcct

SEQ ID NO: 48162 - DNA, 3007 bp, Oryza sativa
gatcttctaagtggttcattttcgatcactgacggttgagaaggttcttctataatttcttcattttgtgcctcagaagtctgttgagtgtcattatttaattcattattattttcaacagaatcggtatcaccagaattttcatctggtgttaccacggtatgagtcacgggtacacaacatgaggtaccaaatttattggaatattattttcttggatttccggtgtaacattagcccgaatttcctcaagattaatttcccttttctgtgagctcccccagaattcattattttctaagaatacggcgtgtctagattccacaaatttagtgacacggtccgggcaataaaatcggtaccccttagatgtctcggggtatccgataaaatggtagcttacagtcttaggatctaatttctttagttgtggattaaatattcttgcctcagcacgacagccccacacacgcaaataatttaatgtcggttttcttccggtccataattcataaggtgttttgggtaccgacttacttggaactcgattgagtatgtgtgcagctgttttaagtgcctctatctataaattcacagacaaaatagaatgactaagcatactccgtaccatgtccataagtgtacggttgcgacgctcagccactccattttgttgtggttctctaggcatggaatattgggcaattattccatgtatctgaagatattgggcaaatggaccaggactttgcccataaggagtaggtctcccataatattctcctcctcgatctgatctcactactttaatttttgcattatgttgattttcaacctcagctttgaatattttaaacttatcgagtgattcagatctatctttaatggggaaaacatatccataacgggagaaatcatctgtgaaggtaatgaacgagtcatatccatcaatagatgttactgggaacggtccacatatatccgtgtggattatttctaatggacacgtgctcctagtagctcctttcttaattttcttagtgaattttcccttaatacaatctaaacaatgatccgcattcgaaaaatctaagggttgaagtatctcttccttaatgagacgctccattctccccttagaaatgtggcctaaacgacagtgccacaatttcgaagacgtctcattatcattacaggcattcaatatattcataatatgatcatccaaagagagcaaatagagcttgtcttgcacgctagcaagaccaatatcaatattattatacttaataaagcatttgtccttagaaaaattacaatcataatgtcacgcccggaaattcactaataatttccgaactaatttgtgcatgaaatcctcgtccaggaatcagccgaggtacacaaactgacaatttaatatacaaatccatcataataataacgttacatacttacaaaagaaaagaaaaacagcagcggaattaacggtctagcgctggcttcagctccactcccataggcagctcaactagggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagttttaatcaacactgaacagcacacccatgctgtacaggcccaaccatcctgaacaaccatacccggctgaacagatctaactccaaaccaggagctaagcaaattattaccagttattacatccataattattgtgaaaggtgtgagactaatcacgaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccgtggacttctcgccacttctcagtctggcgcactataatgaaccatgctatacaaaggataaagccgttgcccacgctggcttgtggttggtacggttaatgtctcacaacagtagctcgcgaaccggtccttaattgtcatgagcacaaccatcaaaaccatatgctcacaacccaccttaaccaggttttaattatcaattaattaacatcacacgattaaccatcgtgagctaccattaaatataaccataaataataatgtagtatatatgattcatcccattagtgagctaatgtttctaagcattgctaagcaattatatatataacttttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcgatcttcaattaaccttcttgatcacttccgacgcactcacgaaccttcgcaacgacggaaacgacaagctaacacgcaaaacgaagaaaaagactaataaaaaccaaataaacagtacataaaaagtaaacaaacatgtagatcataattttagatgaattatgagacttgaacggcctcattccgacttcaaatgaatttattatgaattttacaagattaaatctaattaaagtccatttaaaaagacttaaataaatttaattcaatttatggacaatttt

SEQ ID NO: 48163 - DNA, 8610 bp, Oryza sativa
  unsure (1)..(8610): unsure at all n locations
gagctagggaccttggccgggtgattggaggacacctacgcgtagaggacgacgaggcgaacccaacggtactcaccacaacgacaaacgacgaacgatgatggccggcgacgaagaggacggcggcggcggctcggcttgacggcgacggcggagctccggtggtcggcggcgaagggggacgggcggccgaggttctcctcaccacggcgcacctaacggcggcggcggcaagcggcggcgacgacgcaagcgacggcgcggcgtggctgaagacggccggcggcggcggcgaactaagtgcgcgcggcggcgactctacggagcacgggagaccacgggagatggggcaaacgaaagaggggaactagggggtcctatttatagccttggattgaagagatcggactcctcccgcaagaaatcgatccgagaaaatcaaaactcggttttggagataaactcgaaaacgagtttgattcgggcaagatactcaaccatttgctccgattattgaggggaaagatagaggaggacgagaggataaaatcccctcaaaaacccggaagaaaaagagccggattggagcggatttgagggagaaaaggggcggctcgggcgacggcttgggctcggccggccggctgctagaggaagaagaagggcctgacatgtgggccccacatgtcggtgcctagagggaaagggtttttgaactttttcaattaaaaaataattcgtgaaatgatgtttcatttattaaaaatacttcccttgctcaaacaattcccagaaaattctagaaaatagaggaacaagcaaagtatttaataaaattttatctaacccaattttatattgagatttagcacattaaaattagatcttctcttttaagcttttaaaatcatttctaataattccttttaaacaacaatttataatttaaggattttaaacaagaaaagcacttaacaattataattagatcattattgatcaaataattactgaactgttctctgtatcatttacatttaggaattgagctccgaaaaatccgagaaaattccagagagtataattaaccatggagaatttaataaaaattaaatccacccatgctttatatttaggaaattttatttcccacatttaacttcacttgtaaattaatgaacatttcatataaattctattaataatttattaaataatttataaatcctaacacgaaaatcagggtgtgacacataaccactgttcgttaaaaccattacagaaataaggttcctcttaacagagggagcataaagaacatcatgaagtaaaagattattgccgcttggaagtcgaagatgaagctccccaacggccatcactttaatttcagctccatcagccactcttaggatccgctccccctttcttagcgtcctcatggaaaggaatccctgtaatgagttagcaacgtgcacagtggcacctgagtcaatccaccatgatttatgagaaaattcaacataaagtaattcatcaacattagagacaatgtcaacattagtacctttcttagcaagccaagcccgaaagccttcacagtccctctgtgcatgaccttctgccttgcaaaacttgcaaaggaacttaccagcagaattttgtcctgctggaacctgagctttgcccttatgggcaccattagaagcctgagtggaaggagtgttgggtttctttttcttgttttgggagttgctggactccccttgatagaactttttcttgccgcctttagcaccatgaaggaggttcagctgatccttatgcttctgtttgtcagccttctgacgatcctcctcctcaacagaatgagaaatgagttcttcaatggaccacttatccctctgattattatagttaatgatgaaagactcaaaatcagaagaaagtgaactcaagataaaatggactagaagatcatcattaattcccatgtccatactcttaagctctccattcatagcacccatctgtataatgtgctttctcacaccatctttataattatagcgcatggacgttaggcgcttaattatagagctagcgtaagacttagaagaactcctgaagttcctattaatattttctaagtatgtcttaacatcatcagaatcctcaataccactaataatgacagttgatatgacactcttgatgtacatgagagaaatcctattggacttctcccattcattagttttctcacgatataacttcagtttctcctcataatcgtgctcaacactaaaaggctcctcaggatggtcctctctaatggcataatcataatcaagtatgcctaagttgagcaacacgtcagccttccacttagcataatttgacccatcaagaggctcaatgagtcggatctgaccaaaagctgaaaaatcatgaaaaaatatccgtaagtacatatatgcaattaatttgcgttggctcaattaattacataattaaacaaaaataaattcccctaattacatcaccgttgggcagaaataattttgggaaacataatcataagtaaatttacgtgaatttataatcaacgttggtcagaaaataaattcatatcatggaatacaaatatctagacaaatttctcgttggttccatttagctagaattaaattaataagcctccataaaaatttcataaattttcagcaattttaagcaatataaatggtactaatgcaatttctgaaaaatacttaaaggtgaattggaaagaaaaaaaatatataatatttgggccggcctggcgcgtgcggcccatgatgcacggctcggcccaacccggagggcgcgctgcggcctgctaatggcggtggcccgatcggaagcgatccgagccattcgcttagatggacggctcggatcgattaatattagtaaaagagaaaaaaataataaaaaaaataaaagtgccggctcaaccctaaccctaaaaaatttccccattcttttcctctctctctctcccgaaaaagcggcggcggcggctggcgatttcgcagtagcggcgagagcgcaaggcggcggcgcttgcgaggcgacggcgcgacggcgcgggaggcggcggcacgcacgagaggtggctgagtgcgcgggaagggcggcggcggcagggcgcagcggcaacggcggtggggcggcgcggcgacgacgcgcggcggagagggccgcggttctcctccgcgcgcagccagggccacggcggcgagcctcgacctcgcgcggcccatgggaggcagggcaggcgtgaggccggtccaggacgacggcgaggacgtcatcgagcgcgcgggcgagctgatgccacgcgcggcgacgacaacatgttcataatgccagtaagtgagtttctaatttggggattttagtgttctaatcttggggaattttgtgattagggtttttgaaaattttggggaaatttggggattgttactatccgccgaaattcacctccttctaatttctacccaagccttaaacgattaaacaatgtaaacatgaactaattagccttgagcagtggtaatgaaactttaacccgagcctaattaatcattaacagaacatgatcatgaggaaattttcatcaaaccgaaagcaagatcatggcattaggcttcaaaatgggatgatgggatctgaaggcttaaacattggctctgataccaaatgtagactcttgccatctactaagacataagtgctaagcctagcatgatcaccctaatgcggaatccttaggttactgaccgttgtttgaagccattgatgttttccttggttttgtcgatgtagaggttgtagtggtagcagtagcagtgtgagcaccagcttgatcccgaaggggtcgccggtgatcacttgcggggtagcggcggccacactgtcccggaaccgccacacgttctccctccagcgctcaacttgatcggatagggttttgggaattttcggggagaagatgatcgtggagagatcgtcacctatccacgacaccggcctcccctattagtatagcgctgagggagatcgggggcaatccaaattattgaagttatggaaattgaatcgcgttaatcccgggtggaaaacggcgtccgagattttggcaacgggtggaaaacgtactgccgtccgagatttcctctcgatttccatgccgagagatatactttcctaacaatactatgggccgattgtctgagatccaatcagctggtgtgaagatggctgagtttgtggaggaggaattaatggtggctggcttgtaatcagctgagtagccaatggctgtgtacttccagaaaattgtgttatcatgaagaattgagccagctgctctgttatcatggtgcttggtcctaaagtcccggatgccgatggttgttttggttgtaatgatcctagtgctgacatgaagtttccttgaggctgaccactcccaatattagtcttgatttctctatacttgggaaaaacaccacttggaaaacagattggtcctcctgtcttttcctcaacaattgatccatcaaccactgacttgatcaaatttgacaatgtattgaccaaaatgccagattggttgattaatgcatgatgcacagctgaatcaacatgatcttggaaagtcaccggatcaaatttaccctccttggcatcatcatcctcttgacttccctcagtcttgacattctttgttctagatccttcttcttcttgccctggtgattggaattttgtcttctaaattgcttttccttgacgggttacagaaaaagtcttgatgtagttttctctcacctgttgcatcacttgttccatctctgccttttgctcatcagttaaattttcaactgtagcagggataacgttttgtcaacaacatcagttattgagtgtgatgacatgattgaacaatgaaacttgtcccactaggcgtgccaaaagcgtgttgatgagaaaacacggtggcctaggagatctgcttagctccagtgaaggtccaaggctagacttgagtgtatcaagggtgtgccagctgatttgatcctgcaatcaacaagaaagacaaaaacaaagttagtcagtcgatagtcgatcgaccgatagcgtatcgttggtggtctcaaccgatggagttagaccaaatcggctatggactggatatatcaaagaatattaaaccccaaatatcatcggctgtaacactgtctatcaagattgatgaagaagcataagacaatattattaaaatagccaatacaacaatatttggagctagaaagataatgtactagctaatactctagtacagatctatataggcaaatcaacctatagtactataccaaatagagctcaatgctgtctatatagatgacaaatatacatgaaatagataaagaaacatgtatattgggtaagatcggctgaaagctcgatgctacccctacgagcaatccagaagcaggctagagatcatgattctaaacacgacttagtaggtcgaatgtactgatgcaacactaagtatgaaaagaaacataatatctagacaatcaagccgtagactgattttcagggtggtagatgtctaagctaatctaatctaacaagacgatttagtcgataccggcggaaaccctaaagcgagaagcagccgatagagctaaatcgatatgctaagactagattaacagagacgtatgatagcaatggtcatgatacaaggactaagatatctaaaacgacataatagccccgatagcataagccatcaagatgggttaccgcttgcgaagcgaactcgtcgaaaagtaaaaacgaaaagggtggcgatgcgccgaagttgtattggattgtgccccgtattacaatgctaggagattcatatttatacctcaaatacagactcagtctattatggacacgactcaaacctttctaaagataaaatacaaacaaaaccatatacggcggtctcttgccaaatctaacacaaactgatgtaactaaagatacaatttccttaatcgagctctctctctaattggcaatgacagttattctaatctaggcccagactgagcccaagtcatactatatcgactgtatcgaccatcggctacatcaaccttgatcaactcacactttatttcctgccgatatggtgtccagccgatgtgcagtctgactccaaattcaactcgattccacatcaaaactactttgatcttcttccttcttctctgaatctgatgcgaaattccgttgttaacaccatctcttagttattaatagttctctatccttatagtgaacttaagtttgtttactaatatttattgttcattttttaactgttcgatcaccgcatgaagctttcatggccgaggaaggtttcttgtggcttgatttctctgatctccgagccgtctattgtcgggaaaggatgaacgcacatttataacacaaataaatcaatagtatacgtaagcttgtgattattattaacaagcttcttttgtaagatgcaatacatggatgctgagaagacaaaggaatctatcggatacctggatcccagaagaatgtatcaaacacagcataccatgacgctatcagcaaactccgagtagcataaagacaagatgcctaaagagatagcggaatacaagaagggctttcacaagaccaagttgcttactgtcgcagagtacattggacgagcctactgggtgccatgttcgaggagtcgtagcgcgacctcgtcgacgaggggttgatcgacggcgggagcatggacagcttcncatcccgtcgtacgccgcgacgctggagcagnnnnnnnnnnnnnnnnnnnnnnncggttcgtttgccgtcaaccagctggagcacgtgatgggaagccgtctagccgtggacgacgacccccatgaccgccgtgcagtcgggccagggtggcgaacaaccagcgatcaatcttccggacgctcgtcgaagcgcacatcggcagggcgctcgccgatgagctgtttgttcggatggagaggcgcgcaggagagctcgccgaggagctcggggacgagatgggggtccacttccacatcgtgtgctcgctttcactcgtctgacgatatctacatcgtacactgtcctaataatgaaaaaatatattcaaattttgggcacaataatttaaatataataattgtatttgctaaataagtctgctggaaatatggtcataaattggcatattttaatttagaaaaacaaaataataaacatggcatgcgagtaggaaatgatcaagtgctagtgctaaacataaatatgctaagggcaagaaaaaacatcatctacaaacatgtagaagggctttgttgctcaaagacaagatgttgttgacagaaaacacgaggcctgggagatatgcttaactccagtgcaggtccaaaactcgccttcagatgtatgagcgtgccagtcgatttgatcctgtaatcaacaagaaacaaagacaaagaaaccgtggttaaatccataaatgatagccgatcggctaggtgccgatgacatatcatttattttaggccgatgtcatatgtgcatcgatcggcaagtattaataagcaaatcagaactaaatctactccatcggccgtagatattaatgatatataatccttgtatcaatatatacttaaatcaagtgattgggatagatcggtcgccttgccgagacagtataaatcacttagatcgaaatatgtattaatagtgaggttatatatattcatagcatagccgattagatagatctagcgtgtataggctaatactccgataccactctaaattaagatattaaagcaagtagaatataccaaacaaaagcctaatatacttaaatgcaacaagatcttaatataaagggcagatttaacatgtcaatcaagcatataggataaaagtagttaaatcaggtaagatcggctgaaactccgatactactctaatcggcaaccagaaggcaggcaagatattatggttctaagcacgacttaatagatcaaactcaactgatgcagcattaagtatgaaaagaagaataatatctagtcaatcaagccgctggttgtttcatggagtggtagatatcttacataatctaagccaacgtcgctatttaacctaatcggctgccttctaataacagatgctagccgattataggttagatgatgatattatcgaagattatatgagatatatgataactcgacgaattacataaacaaggttagagtatcgtaaagatggaagcactaatcccgagaacacaagccgtcataacaagttttaaatcttgttgaagatcgaaaccgatgcagctcaacccgaaagcaagaactcgtcgaaacaaaacgaaagtaaaaagggtggcgatgcgccgagattgtattgcacgtctgttattaattacatagggctcagggtctatttatacccgagaattacaag

SEQ ID NO: 48164 - DNA, 15759 bp, Oryza sativa
ttaatagatacaattgccttcccaggactctatccatgtatggcaatcatctcaaagcacatcaattcaaacccgatgtcggatacgagtcatattgtcggaatcggctgtatcacttaacccagtctgactcggtcttagccgatctcagtcgtagccgatccgaattccagccgattcttactctgcttccgtgataatcctcatcttcgattccgcttcgatctaatcttcatctctggtgctgattttatcaaatttggtcgttaacacatgccccccaagtccgcgatatttgataatgttccgaatttgccgtgtacatactctgaacaggtttcgcactttgccgttttccgaccgttattcaagcgctttaaatactaactgctgcccccgagaaatctcacaccgttacttccgttttcaccgcttaagcgaaacactgccttctctctctccggcgattcctccgacgcaaaaagcgatttccaggcgacttcatctccggcgagatctccgcccgcagcgatgtcgtcctccaccagcccatctgtcgcgccatcagccgagtatgctgaggtaagttcccattggctagatcccctttcttagcagcagatcgattttctgttgtcttatattgctctcctcttctcggttgctttggatttatagcatctctccaacctagttgcgattcccagcctatcgcatgaaaactactactttctcggcccagttggcaatcctgatcccaccgagttcatcattggtgaaaccaataggattccctttagattaaccaaccctgatctaggccactggaagaacacctttaaatcttggccgtctctagagaaaaccccacccgagaaaagttggactacatagttcaagcgtatgtcggcaagcaaaagagttcactgggacgaaattggaatcggccaagcactcgacctcaccatagcaaactcgaccaaagatgaacccctgatggcagctgcctcttatttctggtcaaacaccatcaatgccttcttgtttaatcaagggccgatgaccccaactctcatagatatcagcatgatcacgggcctggatgtcacctcatcggccaaccctatgagttcgaatacgaagaaccaatacgacttcaagaccaagagcataggtggctggtcaggctatgtagcagcatacaagggccaaggttcggtcacccctcgagaacatgtggctttcttgttaatgtggctagagaaattcctcttttgtggatcaagctgtggtcctacaaccaattggcagttcgtagccgaagccttagagacaaaaagacaatttcctttaggcaaaatcctcctcggctacttgtaccaaatgctaaataatgcatcggctaagttagctgtcggctcagtagtcggagcagatagaccatggtggctactgcaatcctggctaaatttggtagtcatgaggttcgtcaattagccatctgtaacagaagctgaattcccaagattagagccgattgtgaacaatgacggagaagaactcactcatcggagatgcacatcctatggagagtatgcttctacaccaactgatgcaggagcaaagctatcggctgagctactcaaagattggttttgcagcttttttgaggggttccaaaaggatgctcgagtctggtttctctatgaagattcaacacttctggaaaatccattggacttcagatttgaagacatcaacaatgacatatatcaaaagcccagagaaattttctcatctgcaatcagtccgtgtatccttcctgtcggcatccatcaagggagaaacatccaagtttcctatgagttttatcatccaatgagttctgccagacagtttggaatgggctaactcctaatcggcttattctttgccgataagatccagtgccgaggagaaatctcatcaaccttaatgatggatcggctgcttaatctccaagaacctcctctaggcagcattgacaacataaagctggcaaccttcagaagcaaagcatttgacagatggtggggcgaatggaagccgcacttattccatcaatcggcttctatgtatatgacagacctctttccagatgttgtccctcaagtaagtcttaactcacttgattttcatttgaataactacttaaccgattaatccttggctaactttccttttgacttgcagacaacagaatcctctcctcctatccagagcaacagtggcaaggatattgagtttgccccaggattgattcccaatggaggtgggccatctccccccgtcatcggctataatgcccccaagacttcagctcttcttcaagggctcatcagagaactagccgatgccggcaaaaagaggaaaactagatcatcggctgtagatacttcagccccagctccaaagaagaaaactaagacgaagaaaaccacgccagctgatgatctgcctgctctagatccatccattgaacaagctctggatgaagaagtaattgaagacgatgttgatcaggtcgcagccgaagtaagcgatacataaagaacaccatcggcttcacccaagcagacccctccaactccttctgctctagtccacttttcaagagtaagcaactctctttgatccctcttgtaatcattttaccttatggccgattactcacagatttagtaattgcagaaaaagaagactgctgtgaagaagaaatcggctgcaacaacatctaaaccagctccaccagtaagatagtctcaattcttttcattagttaattctcagccgattttgtctaacacttgtctcttttagcctccttctcctccttctctttctgtacaacaatcatcaagtgaccagactccatcggctgtagtgagtcaccatgtggaagaagaagttcaaccaactgctcctgctatcccagtaagttttctttgacaaaaatactcagatcggctatgcctatttgatctctaactctctttaaatcattgctgcaggtcttagccgatcttttctcttttcacatcagagattatcttgatgaaggagaataagacaccacaagcaaagccttagcccctttatccgatgatgtgaagaaaattctagaagatatttctcatcggctagaagcatcatcgctggatagcttgctagttgattgtggctcaattaggactcggcttcatgagattcaagctctgatcccagatgagctagctgatatcctcactccagccgtttatcttgagcaacatcaattcaaactggagaaaaccaagttaagactggctgaacggcagaagcacaaagatattgaagctacaattcaagtcaatcggcaactggtgcatgaagaaaaagcaaaacttgatcaattatctgaaggtccgatcaggtctaatattgattggcttgaagctcggaagattgagctcctggcacaacatcaagaatgcaatgccgagctagacatagaaaataaaaaactagccgatgtcccaaaatctgttgaagagcagaaggcaagactaaaatcggccataaaaaatgttgttgatctgaccaagtgtttaaaagtcatccctggaaccgatgctcaagacgccctagccatagaagaagtagaacaaattaggcgaaaagctatatcggctatccagcgatatttgtctcagtgactttctatgtaatagaccttagaaattttttgtaatcggctaagatacttccgatgtttatcctgacaatcatttgtgccgattaatctaacttccaaatttcgctcaaaaatttgctaaatttgcatcttgtgaatatatgtgcccccctaattttgtaatgacgaaggcattgagaaaattataatctggactaagggcgatataaccatatcggccattgtacatcggcaaaacagaaccgattacaatacaaaaacagctaagggcgagataacaatatcggccattgtatatcggcaaaacataaccgattacaatacaaaacaactaagggcgatataacaatatcagccatctcaaggcgatgtaaacacatcggctatcatgcatcaacaacactaacagatcatgcgttaacccaaacacttgggtaatatttgttcaagtacttgccattgagcgctcgtccatagacctcgccatcaagccctcgcaacatatatgtccccttagacacaaccttatagatttggaacggtccttcccaattcggtgaccacttgccgaatttgttatcccgagttccaatcggcaaaatcaacttccatacaagttcaccttccgaaaaagtcttggataccactttcttgttgtagtgccaagcaactcgttccttatctttggtaaccttagcaagggctcgcaaatgcgattgaaccaagtcctccctttcatcagccataaggttataatactcatcggccgtcaaaccatcttgcaattcaattcttctggagccgattctaacttcccatggcaaaacaacttcatgtccataaacaagtttataaggaggaacttgtatcgacccatggcaagccatccgataagaccacaatgcttcggctaaacgagtatgccattgccgaggataatcaaaaattttccttttaatcaacttaatcaagctcttgttagatgcctcggcctgcccattagcttgtgcataatatggtgaagaattcaataatttgatacccatgctatcggcaaactgaacaaattcatcggacacaaagattgagccttgatcggtcgtaatggtttgaggaataccaaatctatagataatatgttcttgaacaaattgtatatcatccccagaatcaaccttcttcaaaggaatcgcctctacctacttggtaaaataatcggtcgccaccaatataaacttatgccctttacttgaagatggattaatcatacctatcatatcaattccccaacctctaaatggccatggtttaataataggattcatagccgatgtcggcgctctctggatcgccccaaatttctaacaatcttgacatcctttataatatctgaaacaatcttccagcattgtcggccaaaaatatccagcacatcgaagcaaccacttcattttatgagccgactgatgagtgccacatatctcttcatggacttcaccgattgcaacttttgcctggtcggcactcaaacatttgagcaacaccccatcaatcgtctgataataaagctcatcatctagcaatgtatacttcaacgctttatatcttaatttccgagaagccgattgagatggatcctgtaaatatcgatagacatcatatctccaatcatcggctgttatggcgacaacttcaatcttaacatatttgatcatcggcttatatcccgatgccccttgggctaaatcagtagcttcaatattctgctctcgaggtacatgcttcaaagttactagccgaaattccttcattagttctttggcacttctcattataaaccattaacgtatcattcttgcactcatattctcctgccaactgactgattaccaacaaagaatcccccatgatttcgatagcaccggcttcaacttcctttagtaactgcaaccccttgaggaccgcctcatactcagcttgattattagtcgcataaagtttaatagtataagcaaactcaaaacatgccccccgaggggaaattataactaagccgataccacaaccatgagtacaaactgacccatcaaagaataaagtccatggcacaatctcatccgagccgattgaatcatcatgatgatcaacaataaaatcggctatagctggccctttgatcgccttcggcgattcataccgaagatcaaactcagtcaaggaaaatatccactttccaatccttcctttcaaaataggagccgataacatatacttgacaacatcggccttgcatatgacagtgcattcattggatagtaaataatgccttaaccttgtacatgaaaagtataaacactccacaggggaatatctagtctctgcatccaagagccgacggcttaaatagaacacaaccctctcctttccttcgagcttctgaatcaagaccgagccgattgacttgtcaccggccgacaaatataaccgaaaaggtattcctttctgtggaggaatcaaaactggaggagaactcaaatattccttaatattatccaaaactttctgttgttctgccacccaagtaaactgatgatcggccttcaatctcattaatggtgtaaaaggctctaaccttccagacaaattagaaataaatcttcaaacaaaattaattttgccgatcatctcctgcaattctgtcttgttctctggaggcttaatcttcttgatcgcattgacacttctttgagttatttcactccccctctcatgaacaagaaatcccaagaactggccagccgatacaccaaaagcacacttcgtcggattcatcttcaagccatatttcctggttctctcgaaaacttttctcaaatcggctacgtggtcctttatttccttagatttaacaaccacatcatcaatatagacctcaaccagccagccgatcagatcatgataaatataattcatggccctttgatatgtggctccagcacttttaatccaaaagtcatcactacccattcaaataagccgattgcaccaggacatctaaaagccgtcttatgaatatcttcctcagccataaagatctgattatatctcgcatttccatccataaaacttaatatcttatgtcctaaagcagcatcaaccaactgatcggccactggcattggatattcgtcctttggggtagctttattcaaatctctaaaatcaatacataccctcaccttgtcgttcttcttgataacaggaactatgctagaaacccattcagcatatcgtcaaggacgaataaaagcagcatcatataaacgcttaatctcagccttgacaggttcgagcatatcggctttgcatctcctcagaggctgctggtgcggtctaacccctggtttaataggtagccgatgtttgacaattgatcggctgagtcctggcatctcataatactcccaagcgaagcaatctctaaattctttcaagagctctattagcttggttctaaactctgaagataagttcttactaataaatgtcggccttggccgatcgcctggacctatatatatttcttccaaatcatcagccgacatgaaaccctgaccttgcttgtcatcgagatcatctactgcgtccttggtgtagacgtttcaaccctccacaatgccatcaaaataatagcttgggttctccatcttcaattggctatatatcagaatcgaaaacttttagaaaatctccatcccaaacttttccagataaacaatcaagaccatccatctcccaaagagctaaatcggcactggcaacattgactgtcctgttggctggcacaatctctatcttgttgcattgccattgaatcaagcattgatgcatggttgaaggaatacaacaattggcatgaatccaatcccttccaagcaacaagctgtaagaacccttcccatcgatgacaaaatatgtggtaggaatagtcttgctgccgactgtcagctccacatttataacacctttggtttctgatggattgccaccaaaatctttgagcaccatgtttgtcttgatgagatcttcggcgtttctacccaacttcctaaacgtagcacaaggcatcaaatttactgcagccccaccatcgaccatcgtcttagacatcggcttcccattgacatagccatttatatacaatggtttaagatgccgattctctgtctcctcaggcttttcaaagactgcctgttctggtgatagaaccaacttagccgattcttcttctacttcgtcgacatcggcttgttcgatcccaaattcggctggcaaggtaaaaaccatattaactgatgccgttacaaaacttttccattttgccaacctctctgcctcgtcggctgcaatatcatcggctccaggagcttgattcttaacgcgccactcctgcctcggctttgtcttctttagtcgatgactaattacttgctcgacctcctaaaaacgttctctgctcctcaacctttgaacccttcttttctgattctttgtaaaaataccagaaggacaccactgaatcttcctatcttcatcatcctccgggtcacgatcctggtttaccgggcccaatctttgatgaacaggaacccttgcatgcttcagccgattgccttcactatatgatcggcttgaactcccagtaacatcacctcatccaggacagttctcgatagatggtagcctcataccctcattccagcagaatctaaagaactcacagcccaacgaggataaaaaccaccattatcctcttcataacgcctctcctgctgcttgtcgtatttcctttgatacttgtttataattttagccgaattcacctaaaaacctctcgtacgtcccgcatcggctgttcggctagatgtgtgcaccatgttaacaggaaaaggattaccatcaaccttcatcggcctcttggaatcatcaaacttaatcttgcctccctcaatggccacctgaatctgttgcctgaaaaccttgcaatcgttagtagaatgagatccagaattgtaccatttgcaataccttcttttgcctaattcctcagccaatggaatcgtatgactagcagagagttgaatttgcttctctcagagtaacagatcaaaaatcttgtcaaccttggtaatatcaaagtcatacctatcctcttttccagaattcattacccattggcatggtattacccattcggctgcagctatttcggagtcatcatcatcatcatctgacacatacatgtaagggcaaacatgattaaccttcttagagttcttcctagcctctgcagacctctgctcgtgcaggtttaccttttgtataagatgtgacaaactatcaaagtcctcagatgagaatttttccctaatcggagcaatcataccctgaaaggccaaatcggccaattgggcgtcagtcaagctcaagctaagcacttattcctcatctccctgaacctcttaatatactcatgcacaggttcatcatgcctttgcttgatcgctgttaaatcggacaatttcatctcgtgaaccccactgtagaaatacctgtgaaattgcatctccaaatcggcccaactgttgattgacccatatggcaaagaagaaaaccaagtaaaagccgatccagacaaggacaaccggaacaacctaactctctgagcatccacagccgatgcttcaccacactgagctaaaattcggctaatgtgctcataagttgacacaccatcttgtcctgagaatttggaaaaatctggaactttgaaccgctttggaaggggaactctctcaaaccactcagggtaaggttgccaatacaagtttccagtatcttttggtttaagcccgaactgttccctcattacgtcagcaatcacatcggcccacggtcgttgttgagctgctccttgcgactgttgttgcatgggctcgaattgactgtactgaggagcaaactgaggttgagttagccctccttgctgatattgggcttgcggggaaggaggttgatattgatagttcaaattgccccctggtaattctggtagtttggctgaatatttcgcaccaagtgttcagggacaatatgaggtattaccgtatggtctagctgcacatgatggaccaaatgctctggaacaacctgattcagagcgtgttgtccagccgatggattcatcaagccttgctggtgaatcggctggatagcctactgtcttgatggcgtttgttgaattggctatacaatctgctgccttggtggcgtttgttgaactggctgcacaacctgttgctgaactggctgtacaacctgttggatcgggggtgtttgttgaatcggctgctgctggactggatcaacagtaggttgaggtggtagaaacatggcagcaacctgatcttgagttagccgattcgcaacctcccactatgttgtggttgctccctcatcaatagccgaggattaaccagctggcctggtgccgacgctgatggagcaggtgggggagtcgataccggtgccgtcggctgagctgatggtgcaatgggaggaactgttcgaataggctgagtaatcgtgatcaaaggcctataatttggaaagacacctccttgcaaataaactaggcctgtagcctgatattcagctattgaaccatcagctattgatttcatcatgtttgacaaggtattgactaacaccctagactgattaatcaaagcattgtgcatggcataatcaacccgtcttggaagttattgaaaaactcctgtgatggattgccatcctgattaagatttcctcctaaagagatagcggaatacaagaagggctttcacaagaccaagttgcttactgtcgcagagtacattggacgagcctgctgggcgccatgttcgaggagtcgtagcgcgacctcgtcgacgcggggttgatcgacggcgggagcatggacagcttcaacatcccgtcgtacgccgcgacgctggaggagttcagggaggccgtcaaagctgacggttcgtttgccgtcaaccagctggagcacgtgatgggaagccgtctagccatggacgatgacccccatgaccgccgcgcggtcgggcgcagggtggcgaacaaccagcgatcaatcttccggccgctcgtcgaagtgcacatcggcagggcgctcgccgatgagctgtttgtccggatggagaggcgcgcaggagagctcgccgaggagctcggggacgagatgggggtccacttccacatcgtgtgctcgctttcactcgtctgacgatatctacatcgtacactatccaaataatgaaaaaatatattcaaattttgggcacaataatttaaatataataattgtatttgctaaataagtctattggaaatatggtcataaatcggcatattttaattcagaaaaacaaaataataaacatggcatgcgagtaggaaatgatccagtgctagtgctaaacataaatatggtaagagcaagaaaaaacatctacaaacatgtagaagggctttgttgctcaaagacaagatgttgttgacagaaaacacgaggcctgggagatctgcttaactccagtgcaggtccaaaactcaccttcagatgtatgagcttgccactcgatttgatcctataatcaacaagaaacaaagacaaagaaaccgtggttaaatccataaatgatagccaatcggttaggtgccgatgacatatcatttattttaggccgatgtcatatgtgcatcgatcggcaagtattaataagcaaatcaaaactaaatctactcgatctgccgtagatattaatgatatataatccttgtatcaatatatacttaaatctagtgattgggatagatcagtcgccttgccgagacagtacaaatcgcttaaatcgaaatatgtattaatagttaggttatatgtattcgtagcatagccgatcagataaatctagcgtgtatcggctaatactccgataccactctaaattaagatattaaagcaagtagaatacaccaaacaaaatcctaatatacttaaatgcaacaagatcttaatataaagggcagatttaacatgtcaatcaagcatataggataaaagtagttaaatcaggtaagatcggctgaaactccgatactactctaatcggcaaccagaaggcaggctagatattatggttctaagcacgacttaaaagatcaaactcaactgatgcagcattaagtataaaaagaagaataatatcttgacaatcaagccgctggatgtttcaaggagtggtagatatcttacataatctaagccaatgtcgctatttaacctaatcggctgccttctaataacagatgctagccgattataggctagatgatgatattatcgaagattatatgagatatatgataactcgacaaattacataaacaagattagagtatcgtaaagatggaagcactaatcccgagaacacaagccgtcataacaagttttaaatcttgttgaagatcgaaaccgatgcagctcaacccgaaagcaagaactcgtcgaaacaaaacgaaagtaaaaagggtggcgatgcgccgagattgtattgcacgtctgttattaattacatagggctcagggtctatttatacccgagaattacaagatatgtccataccagacacgactattatctctaacaaactctaagataccataagtctttgcggcagacttttgcccatatttatctctaaggaatttacataaaatattctaacccagtctgacaatcatctcgaagcacatcaattcaaacccgatgtcggatatgagtcatattgtcagaatcagctgtatcacttaacccagtctgactcggtcttagccgatctcagtcgtagccgatccgaactccagccgattcttactctgcttctgcgataatcctcatcttcgattccgtttcgatctaatcttcatctccgatgctgatattaccaaatttggtcgttaacagatgcctaaagagatagcagaatacaagaagggctttcacaagaccaagatgcttactgtcgcagagtacattggatgagccttcttgaaatttcaacataaaagagtcataaaggccgcatacaactttaactaagtccagtagatttctttgtacatatatgtgttatttcatccgtgactaacttcatcgtcgttactatgtagcgatcattatatttgtttgatgatctacccgaagtacgacaccgtgacagtcttggacccccttgattataaccacatgatgtaccgtcaatttctaacaatcttcaaatagtaagtgatctgataaatgcatgtctaactttcatgaattataattaaatctcctccttaatgcgaatctgtaaatccatacaatgtgtataactactacaaggtaaaggtggagaactactgcaaacaagggagaaaccactagtgcatacatactggccagtaatactccacacacttaatgtatttcaattgttttacttgcaatatttaactagttccttctatgtgtatgtcatgaagtgtcacaagcaacttaaaagcggtgtcctctgcagttattacacatgcgaattcctcagggttaatgggaggtacatgaccaacgcagaggatgtaagtctctcgactcaacgtataagtgcaatggagaactgcacatctagatgttagtaatatattgtcgttttttcgtgcatgcagttgcctagaattgaacatcgaacaagctttgacgatgaaggcattaaaaatgtgcagcgggacctctgccacttcatccacaacgagtgctgtcatatccaaggacggttcttcgacccagaaggcaccctagcgacaagcgatgaatacaagtctcttcgggagtggaacaacgcgatgccataatgtatttattaattagatagtgcatttgaaatgacaaatataaaaaatattgtaacatattgatgacacttttcactaatgcaatatatgtatttttgtcagtattaattgtttgtaagttcctaatattatttatgcattatttaattagttgcaacattattgataaaaaatattattaaaaaattggcgtgtattttcctaggcgacgaggccttcttatcgcaggcgactcctacccattttcccaggcggcgcgtcgtgctcccttccacctaggaaaacatcttcccagacggaatggccgtccacctgggaagactgttttcggccgtatgcaaaaacattttttctacattttttctagtagtgaaggagaataaatgaattaaatatgaccacttggctgccttttgatgatgacggtttcgtcgtcggagagaaaattgccttattctggaaggtcaatggatgagaaaatgtattcacttggtatacttgctggatattgcgtgaggacgggtgaaatgtaggtccctattgacatttctttattttatgatttattttatatcagttcaaaatataggcattatggatcttcaaatcattggtttagttagattagaaattatatgtatagcttaaaaattatgcatattttaatatttattattatttttcgttatataaaacaaggaggggtacagtggacagctcaaaccgagaggggaggggacgagtagtattgtgtggtgtgcatgtgtagggagggcacaatggaggggtgtttttttttctatttttctaaataatttaagtgaaaactgatggtctaatttttttctctaatatatttttttctaatttttaagacgtaacacatgaagcggtttaagatttttctaaaagtatatatgttagttaaaaataatgaatcatctattcaagggaaaaccgatagtcaattttttttacaatctctaagatttttttttctacagaggatgtacttgtgatataatacttattgtcatttttttaatttttttgttcgttttgctatttcgtttatgttcaaatgatgtatttgtttttctaaatgaactatgggtaatgtggaccttaaattatttatttaactataaataaaataacaattcaaacaaactaaaaaatcggatgtaacttaagaattataattattttactttctaattattgatcgttttttattaattagttaaaagttagaagaccaagaaattgaatgcctgaataagttataggaaacttcccacttcgtagtcgtagttcagcatatcagccactctttcttctttgtctttatcaactcttacctcaaaaaccttttaattactgtttatttcagacaaagcaacagagcagaaattttaagagcaaaaaagcagagactactatattatatatactagatatacgcccccatcaaatctactcccgtagtgttcgcacggtggaatcaagagaagatgcaagcgcaggacgtaaagaacgtcttctgcatgaagggtgggcaaggggagtccagttacctcaaaaacagtaaagctcaggtaacaagtaaaactaaattaattacctaaatgccacaacaatttattgaagtttaaattctccttatttatatacgcaaagaattgatggagttcaaattcagcatgcaactttagtttcaaaaaaaaaaaatgaaatcagcatgcaagtagaggttattttgtttcctaagcaagttccttccctgtgcttgatcgagcgaaactggcaacaaaatgcagttgagaaacctgcaaatgatgctgtatgccctggaggagacactggacacgatcccgatccctccccgcgggccggggaagcttcttctgctgacggcggccgacctcggctgctcctgcggccgcaactcgcacgtcgtcgccgacgcgatcgtgcagcacatgaccaagctgtgtcgcgg

SEQ ID NO: 48165 - DNA, 5340 bp, Oryza sativa
cgcgacggcctatccagagttctgcttctacttctccgacctcccgagcaatgacttcaacaccctcttcagcctcctcccgccgcacgccgcttcctccggtgacggcagtgggcggcgctacttcgccgccgccgtgcctggctcgttccacgaccgtctgttcccggagcgatctatcgacgtgttcacctccaccttctccttgcactggctctctcatttacctacgcatcaatatagatttcaaggtgtgtaattcacctactccctccgtctcaaaatataaaaagttttagagttggacacggtcattaagaaaaatattagaagtgaatgataggattgtgactggatgagtagtgaaggtaggtgggaaaagtaaatggttgggaagagaaagttggtgaagaagttgttatattttaggataaatcctaaagtttaaaatttgttatattttgggacgaatggagtaattgaaaggatgggctttgattacacaggtgctggacgaagtcgccgatacgcggtcaccggcttacaacaaggggaaggtgttcgtgcagggaagctcggaggagatcggcgcggcgttccggcggcaattccagtccgacatggcgcgcttcctgcgctgccgcgccgccgagctgaaacccggtggcgccatgttcctggtcttcgtcggctgcccgtcgtccgccggccccaccgaccaaggccgcagcttcaacctgctcggcaccatgttcgaggagtcgtggcgcgacctcgtcgacgaggggttgatcgacggtgggagtatggacagcttcaacatcccgtcgtacgccgcgacgctggaggagttcagggaggccgtcgacgccgacggctcgttcgccgtcaaccggctggagcacgtgatgggaagtcgtctcgccgtggccgacgacccccacgaccgctgcgtggttgggcgcagggtggcgaacaaccaacgatcgatctttgggccgctcgtcgaagcgcacatcagcagggcgctcgccgacaagctatttgtccggatggagaggcgcacaagagagctcgccgatgagctcggggacgagatgggggtccacttccacatcgtgtgctcgctttcactcgtctgacgatatctacatcgtacactgtcctaataatgaaaaaatatattcaaattttgggcacaataatttaaatataataattgtatttgctaaataagtctgttgaaaatatgatcataaatcggcatattttaattcagaaaaacaagataataaacatggcatgcgagtaggaaatgatccagtgctagtgctaaacataaatatgctttgagcaagaaaaaacatcatctacaaacatgtttgacactagaaatagaaatcctatatactcgaagaacactccagagtatgttgaggaattagtattatctctgttgacgttgacattctctccggtcaggggcggatccaggaaaaaatagtaggtggggctgaacagactctaccctagacctctttagcggacttatattctcgtggttgcgtggaggatcactggtatctgtgttgtttgaactagaataatacataagcattattctttttggcatgttgacaaactaaaaatgtagaaacaattataaattttaatcactacctcacttgagacacaaatttagactgtctattagtattagaggtaaataggttaccaatttggcaattgcaacttcaaatattcaatcaccggctgctggctgctgctgctgcaagctgcgtccagcggaccagcgtccttgcgccctcgcggcctcgctggcttgcgggtcaccacctccccgtcggcgcgagcgcgcagcggcactggagctggaccgtcgcctagccgcctcccgtcggcgcgtcggcgcaggaccgccgcctggcggctggcgccctggcccgtcttgccacctccccggcgggcgcgccggcgctggaccgccgcttggccgcgggccgcctcccttcccggcttcccgccctccgggcccctcgtccgctcatggctcgccagccgccgccgccgcctgcttgccgctcgccgcacgcccacggggccacgggccacgctgcctcctagctcccgccctcgtcagccggtgtcgccaccgggcgtcgggcgcctcgccaccacggccgcctcccgtcgccggttgcccatcggcccgcgtccacggccggtcgaacgctactacgctagtgttagggatttggtagacagggagagagaacgccggctgggcggctggggaattcagagaagggagagggagagggaaccctggccgtgtgccgcgcttgagctacaggttggaggagtgggccgggccaaaattggaagattaagctcatgggctgctcttcatagccggcccaagtcgccaaaacatcgtcttcaacctccagtttctcctccagccgatcttaactcccacaaacggcgcatccatggaagaaatttttagtgggggcttaagggggtttccatggtcccaaggatggtagtggggtctcaagacccccccgcccccgcggtaaatccgcccctgtctccggtaccaccgttccatcctctgtggcgccgtcattcactccagtagcgccggtgccggtgtcagccttcatgatgtagaggaagaagatgaagcagaccgtcgatgcagaggaagtagacgtgttgcaaaggatgtaaccgatgcagagccgtcgcatcgcaggatgctccccccacccgcctacccttgcaggtacacaattagatagagtttcggaggcctactcatcccgagtacctatgcgcacaggtggtcagaaccggggaaacagtagctagcgcaaggacaaagattaatgttatgagattgttggaataaatgggctaggcccaatttattcccaataaattctattggcccataattaatgttacgagattcgaatttaactggagagatctcaacttaaatagagagctattagagagcacctgttgaatcgtttaggtggtggtgggactaccacacgcgcgccgagccgggctgatgccgaggcaaggcgtcattggctgctgttgctgctactgctctctctctcacattattttgcaactgacagaaattgaatttgtaacggttgagaatcaacaccattaccgctacaacaaatgacagtcaatcctgatttaattatcagattaactctattggttgctctggtaacaggcctattgattactccagcatcgggcagattcccctctcgcacactgtataaacccatcagacctgttgattactccgataacgagcacatttccctttcgcgcactatataaacccatcacaattactctgacaatgtgagtagattcccctctcgcgcactacataaacccattagacctgttgagtactccgacaaagggtagattcccctctcgcgcactacataaacccattagaccagttgagtactccgacaacgggtagattcccctctcgtgcactataaaacccatcacctagaaagacacatctcttggctttgtaacaaccctccctctagaaccgcatagccagcccatccgacgggcggacccacttacacatacgacttctgttacactttcgttctcgcttcatgtaaaagggttaaccgggagtggtatggttggagggatgatgccttgtaagttggttccacccttactaaactagcaaggtggtattaaacatgtgtacacagctctatgggccatacaagccatatcctaattcggctaggatgtcagaggctctgtcttctctagcacactgtttttgctctgtggttctcttttttcctttgttcgtatgctagcttctgtttctccggttctgatcaccaacgtacatgggtgctcgggacaagcatgcctttgaaactccatctgcttgtgtacctgcacgggtaggcgggtaatcaagtttttggggagaatcctcctacgcgactgctctgcatcggctacgtcttctgctgttctgcattggctacgtcctctggtatgtctacttcctctgcatcagctgtctgcaccgtatacttcctctccatcgcaatatcttccactggcaccggcgctattggagcaggagataacggttacgcaccaggaggagggaacaacaacataggagagaacgtcaacatcaatggaggcaatactaatgcctcatcatccattcagtggagcgttctctgggtatatctctattcttatttttgtgttaaatatattgctagacgtttaattttgtacctgctagcatattcatgtttagtgctagcactagatcatttcttacagcaatcgtcacgattacaatcttgtttttctggattaaaatatgccgatttataaccaaatttccaacactctttattagtagtagaaattaatccgaaccgttaatcttatttaatcgaagggttcggatctatttatactaccacatcagttagcggtactacaaacgtggaggggtactattgtgagaaaaaaattaggggcagagtatataatcgtcattaatttagcagtgattgaacttttttccttgttttttgattttttcatgaaatatgagcaatgccagcacaatggataatcatatatcgatttagccggggaaaaaaataaatgataaagtaacttctaatcattatattatattagtaaattactaatttactcctaataattctgatagtataaaatattatcagtagaaagcaccggagtattgttttttttttcttcttttttagatgaaagcctcgtcttgtttggctgcgtgacttttcgcaccacgctcgagaggaacccattgtcttgttccgcggtcaaacaatggattatccaacttggacagtagcaatctgctgtacctacagggttgttgcgtggagctacctttagttattccaaacaatacgcctctttggtaaacttcgaaaggaatgatgtgaccaacaattagcaatttgccactaccaatttatcgccagcggtaacgtggaaatcaccatccggacgtggtcgctactccatctgatttcacaaacatctgctgcactaaaaggatttttttcgtgtggtcaaaaatatttttccgtgcggaggtcttgcccgtctgcactaggtgtctgggaaaataaatatttgcgtgctggtgggtcaaccgtacggaaaaatgcatcttcctgtgcggtcaggttaagcgaaccgcacaga

SEQ ID NO: 48166 - DNA, 1388 bp, Oryza sativa
gccgctaggactgctgcttttgctgctgcggctgctgccgatctgcttgtgctgctgccgatctgccgttgctgctgcttgtgcgttgctattggctgctgctgcttgttcctgcagaagaacagcaaggaggaagagaagggaaaaaaaagttagaagaagggaaatttggggaatttggtgaatatttctaacttctttgtttttcttacaaaattagtactgctaggtaacccgttttagtccctagttgtttctaatttatatataagacgatatgtttccggtagctctatttttatcgaacgctaggctgaaaccgtattttcaattctggtattaaaccatcgggattcaggttagttgtcttaaataaagtttgtagtcatcgtcgatatctttctaacgctgctggtttcacttgattccaataaacggtttaggagaaacaacagaaacagtactgctgaccgggtccggaaatcaggacaataattcgttttccttaatctgggattttcagaggcataatctgattttgtgctccacatgaaagttgtagacaattttgtctagatgtccgaagttgtattatttgctagattccgttagacggtttgtgagttacacataaaatagtaagggaacagctatatatatttaatataaatcggtaaaaaactatatattttaggtttcgattttagtaaatgtcccttgtaactatcattagttgaatatagtggtttattatgcgtagttttgctccataggtgtgtggagggttgcaacgttgaaggagttgagttggattatcgatgaagttaaggcaagtacaagacggacttgtgtggtggataaactgtattgctttgttggtttcatttacccaattattattcgaagcttcctattatcaattgtgtggttttggtattatgctacatattcatatttcacttcatgttcaagttcacgacgttattcatgtttcattcttccggaagttttttttacattattcaagtaccatgcgtggtcatgggaatgcaatttgaatctttttgtttacattattcaagtaccatgcgtagtcatgggagtgcaatttggatctttattcatgatccttgagaagcgctgatcacgcttgctcggcttaccggtaatgctaagaggatattcacacctgcccgggagggaactactaccttttgtctccttcgttttaaattaaaggaagtcaaatgtttcatattggttttcttattgcattaaacctgtgtatattttactagttcaatattgtacttgctgagtattctttactcactcttgtgtttaatttggttttcaagtacctaatgatattgatctgcatgggacga

SEQ ID NO: 48167 - DNA, 21596 bp, Oryza sativa
gcaacgtggcgtagcgttggacagtgactggttaatattgcttaattactacaactgtttttactattttcaactactggttttaaatgcctgctttatgcaaatgaaccccgtagcctccgttggttatatcctgcatcatacctcctcttccggtatgacttgctgagtacagtgggtagtactcagtcttgctcttttcccccacaccagagttgaagttcttctcagttggagatgtcttgaagaggttggtttcgtcgctgccgtcaagggttgcctgtggaatggaatcgcctgctgcaggagtcaagtcttcaggcttagctcgcttttaccttttttgctgcatttgtaatcttttatatttttgtaagacgtggatctgtatgtcaacaattgtcatttgtgtaccctggctggtcctggacaggggtttaatacacattcagcttagaaattctggttcgtgaatttctgggcgtgacaagttggtatcagagccgaccttgaccgtaggacaagccaactggaaaacctaagagccctctgaaccccttttcatatgcacatgcctttttcacttggatttgtttcgggaaactttggggtttgatcttttgattttgggagaaaatcttggtcgcctatttaatcggatctcttgactagggacagtccagggttttagcaaaactttatttggaatttatttggcagtcagtcgggaattgttaggtggaatgtattaagttgtgtctagattcgatgggatgcagtctttatgcgcatcattattatcatgcatttatttcatgcattaagttattgtttagtcagttgcattagtgtcttttgtctgggttcatgaaaaatgttccatgcataaaaatcatcatgcttggctagttgtttgggccatttgttgcgttgtttaaatttggatttgagcatgtattgattcctatcccttgtctaccttagaagtcagacctgttcttcgattgcaagcgccgctccgagcttccgagtcgtcgcccttagctttatcgtcttcttagtctgtttgcgtgctagtttttgtgtttaggtttgttgcttgtgggttagtcggcggtcgatatcatgtgtgagtggtatgacagccttaattaggaattgcgtgcctctttttcagagttttaatcaagattaagataattgcacttaattttataagaaagattagtttctgagccatctgttttcttcctttctcttatttctacctatcctcgtccagatggtgaagacaaggaatgatccccgtgactccaacgacgccagtggcagcgaagagcagacagatgaagctcatactagtggtgcacctggcagcagttcatctccgccgcccgagaacccaacagtcactcagatgatgacaatgatgatgcaacagatgcagcaacattaccatcagatgttgcagcaggcgcaacagaaccagcagtttggtcctccaccatcacacgtgtccaaactgttagactttcttcgtatctagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggtgacccgtccagatgcaacgaaggttacttgggtagagttttgtcaaaactttaggaaggcacagattcctgaagggattgtggcacaacagaagagagagttccgtgcattgcaacaaggaaccagaacggttacagagtacctgcacgagttcaaccgcctcgcgcgctacgctcctgaggacgtgcgcaccgatgctgagaagcaggagaagtttttgtttgggctcgacgatgaattgaccaaccagctaatctccggagtctatgaggactttgagaagcttgtggacaaggctatccgccaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcaacaacgattacaacggtggcagtcacaacaatagtaagcagcacaaccacaactcgactccacccctactaatggcaccagctcagtcagatctgccagctgtgtcagctcagtcagaacaacccaagaagggggctgtaggaaagccaagaccctgcttcaactgtggcaagcacggccactttgctggcaagtgtccgaagctgaatcgcactggacccaggttcatccaggcccacgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactacccctcggtgactatagagatcaaaagatcaccgtttctatccaacctcatccttctcgaatctaaagacctagatgtcattctcggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatgacagctaatgagctagcagaggtcaagaagcaggttgacgaacagctgcagaaagggtacatccgaccgagtacttcaccttggggtgctccggttatctttgtggagaagaaagacaagactaagaggatgtgcgttgattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcaccactcggtatgggttgtttgagtgcacggttatgtcctttggactcaccaatgaaccggctttcttcatgaacttgatgaacaaagtgtttatggagtttcttgacaagtttgtcgtggtattcattgacgacatacttatttattcaaaatcagaagaggaacatgagcagcatctccgtctggtactcgagaaattgaaggagcaccagctatatgccaagtttagcaagtgtgacttctggttatcagaggtcaaatttctgggtcacatcatttctgctcaaggcgtggcagtggatccatcaaatgtggagtcagttacaaagtggaccccactaaagacagtttctcagatccggagttttcttggacttgcgggctattaccgtcggttcatcgaaaatttctccaagattgccaggcccatgacacagttgctaaagaaagatgaaaaattcaagtggtcagctgagtgcaaccaaagttttgaagaactcaagaagaggttagtctctgcaccagttctaattctgccagatcagacaaaagacttccaagtctactatgatgcatctcgccaagggttgggatgtgtgttgatgcaagaaggcagagtggtcgcatacgcttcgcgacagttgcgtccacacgagaccaattatcccactcatgaccttgagttggcagcagtggttcatgctctgaaaatctggcggcactatcttattggcaaccgctgtgaagtatacactgatcacaagagtctgaagtacatcttcactcagcctgacttgaatctccgacagcgaagatggctggagttaattaaagattatgacatggggatacattatcatccagacaaagcaaatgtggtagcagatgctttgagcagaaaaagctattgcaatgccttatgcactgaagacatgtgtggcaaattgcagcaagatcttgagcacctaaatttgggcatcgtcgaacacgggtacgtagctgccctagaggcacggcctacgctcgtggatcaactcagagcagctcaggtaaatgatcctgaaatagctgagctaaaaaaagaatatgagggtcggaaaagcccgagatttccatgaggatgagcatggcacaatctggttgggagaaagattgtgtatgcctgacgacaaagaactgaaggatctcatactcacagaagctcatcaaactcagtattcaattcatcccggcagtactaaaatgtaccaggacctcaaagagaaattctggtgggccagcatgagaagagagatagccggattcgtcgcactctgcgatgtttgtcggcgagtcaaagcagaacatcagaggcccgcaggactgctacaaccccttcagatcccggaatggaaatgggaagaaatcggaatggatttcatcactggtttgcccaggacatcgtcagggcatgattcaatttgggtagtcgtggatcgcctcacgaaagttgctcatttcattccggtgcacactacctatacggggaaaaggttggcagagctgtacttagcaaggatcatgtgtctgcatggggtacctaagaagatagtatctgatcgagggagtcagttcacttcaaaattttggcagaaactgcaagaagaattggggactcgtttgaatttcagcacggcttatcatccgcaaactgatggtcaaaccgaaagggtcaatcagatcttggaagatatgctgcgagcgcgtgcgctcgattttggtggagcataggataaaagtctgccttatgcggtattctcttacaacaacagttatcaagccagtttgcaaatggcaccgtttaaagcgttgtacggacggaaatgccgcactccgatcttctgggatcaaattggagaacgtcagttgtttgggacggaagtattaactgaagcagaggagaaagtcagaaccgtcagagaaaggctaagaattgcgcaatctcgacagaagagttatgctgacaaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgtttcatgtatctcaattgaagaagtgtttgagggtacctgaggaacaagctagctcagagcacattgacatccaggaagatctgacttatgtggagaagccgatttgtatccttgagaccagtgagagatggaccagaaacaaggtgatcaggttttgcaaagttcagtggagccaccactcagaagaagaggccacctgggaaagagaagatgaattgaaggccgctcatccgcacctcttcgccagctcttccgaatctcggggtcgagattccgtttaagggggtaggtttgtcacgccctgaggttcccctcccttgctctaaattcataaaataaatcgtccgaagaaattgtttaatttaacctagagatgaatccctaattaataaatacaaataataatcggaatcgacatgtggaatttttcttggattctacatgtcaaaatatgctaacaggatttttagtggaattttcagagcattggaaataattttaaccaattaaaatgagcaaagggcaatgttaaatctctggaaaaatcctttcttctttttctttttctttttcctcctttttcctctctccttgggccgtcggcccagtccattcacctcccgcgccggccttccctcggctgggctggcccaagccggttcctccctcctccctaacccctccgggtcaccgacaggtggggcccacctgtcggccccttcttccacctcccgccgccgctccccaagccggcaaccgccgagccgcccacgccgcccgcctcccccgccttccgcgccccactccgcgccgcgcgcccacgtcgccgcccaccgtccctactcctcccactcgcgcgtgcaccccgcaacggagggattcgaattcgaatctctctctctctctctttctctccattccccacgtcggcgagaaatccggccacctcccggcctcgtccgtctctcacgagccccaataaagcttccccgcactcccctccacctttttcctctttccgccgctctctcccgtgccctccatcactcccgcaccgctacacccgccgccgccgccttttccactcctctggtcgccgctcgccgccgctggagccgccgccgagccaatctgccgccgccattagcttcgccgccgccaaagctaccccggccgccgcatcccccatccaatcccgccgtcggggcccgcttctctccgcgcgccggtgagtaccaccatagccgccgccgtcggccatggctctcgctcgtcgtgggcaccctctctccctctaacctctcacacttcctctcttagggtgtcccggagctcggccgccgttcgctgtcgcccttcggtcgctcaccgtcgccatttgccgtcgtctcctcccgcgccggccgaaccccggtgagaactccctctctcttcctcccgcgcgcgccgccgctccccgcatgcgcgtcgccgcgatgtaccgtcgcccgcgtcgccggccgccgccgtcggtggccgcttgccgccgccgccctcgccctaaccggccggccggcttgaagccgagccaagccaggccgccttcctcctttccccatgagccgccgcccggtgggccccgcctgccagtacccctccctcccccttgagctgctgaccagtggggcccgcatgtcggcgccgccccaccccttgctgacgtcagccctggggcaatattgcgcaataaatacattaaggcttttttctttattagtaaaaacacagataatcttctaaaaatcataagtaattcatccgagctccgattaagtccattcaagtctcagtaaattcataaaaatgtatagaatccattaaaaatggttttgtttcctgtttcagtagacttatagcatgttttgcttgtgtgctttgtttgtcgcgtagatttcgcccgtttcgtcgattcgtggtttctcaaagaagttgctgtggttccatcagtgcgagagcaaggcaagtcatacattgcaattgatcatattgtacccaatttacaaatgtcccgcatttctattaaatattgcattgttttacaatatcatatgggatgggtcctattactcagctatatgttgtttcccttacgccattgataacttgggtattaaaatgactagatgttggtttaggagatgcttagccatgcttagttcaactagtgcacaaaaggggatcacactaaagcatagactttgattattggcaatagctttggattagtgccaccgcaatggtgttggttaattaaaatacactacatggtgggctgtgggtgcatggttttgctagtcgtgcccatggcgattaaggacctgttcgcgggatgccctggaagaacttatcgtacttaccacaagccagcgtgggcaacggctgggcttgcagtgtagcttttatctagccgacgtacccaggcgagggtgggcgtgatggagttgggtcggccggggtgtccggttgatcggcttccggattcaccgcggcacgaacggggggctgcccgttgcctgctggggacgggggcgaacgctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccatgctcgcggttatgggcggtcgaccagattcaccgtgattagtctcacccctagtttagcttaatgaactggtgtagttcaggtggttggttgggcctgttgcaacgtggcgtagcgttggacagtgactggttaatattgcttaattactacaactgtttttactgttttcaactactggttttaaatgcctgctttatgcaaatgaaccccgtagcctctgttggttatatcctgcatcatacctcctcttctggtatgacttgctgagtacagtgggtagtactcagtcttgctcttttcctccacaccagaattgaagttcttctcagttggagatgtcttgaagaggttggtttcatcgctgccgtgaagggttgcctgtggaatggaatcgcccgctgcaggagtcaagtcttcaggcttagctcgcttttacttttttcgctgcatttgtaatcttttatatttttgtaagacgtggatctgtatgtcaacaattgtcgttttttaccctggctggtcctggacaggggtttaatacacgttcagcttagaaattctggttcgtgaatttctgggcgtgacacctaggtgagaagctccttgccttccacctaccatcggtcgctgctttcgccttcttgctaacgagctggcgagctcactagccgccaccgttgatgtttgtggtaggagaaatcgggggaggagagagagggttgagaaggaaaaaggatgcatgtttcactgactcgtgggtccatcagtatttttattactatttttttctaatttgtgtgccacgtaggcaccatttcacggcttagtagtgtcttggaacctcgatttcagtggtattgcaatatgagagatacattatacatgattgcgtggccaagggacgggactataactcgatctataatgagagacgcaaaatgaacatattattcccatccctgatggcggccgctgtcgccagaaaaggccaatagtgctggctggagcatcgacggacgtgatgggacgtccgttcgtttgcgagcggaataagttcacttgtcgtccctcaactttacaccgagattgtttgacatcccttatttgcaatatcagaaatcttcactcctatactatgtaaaaccgtgcattttaggtcctatagcagtatatatacctggttttgctgatgtggtatactagtcagcaaaaaattaaaaaaaagtatgtggggccacatgtaagtgagagaaaatcatatgggtccacctctcttcttttttttccttttctcttctcttctcgggcggcggcagatgtgggagaggcggccggcggcgaagcaggggcggcggcggcagtgggcggagcaggcgccgtggcgggcgagctcgcgggaagaagctgggcggcggcaccagcgccggaagaagctctcgttggcatcgtgcccgcttcgcctaccgccgccccgtagcagtggctcgctctcgaggcgaagcagcggcgatcttgccttgagacagagcaacggtgcgccggctgggcggctcggacgtgtgcggcggcctggccggcctcgtggtggagcgacggcgcggcctcgagcgaagcggtggtagccctggaggtagagcgacagcccggcgctagcccgctcgtcgcggcatgcacgatacttgtccacatataccatcagttgcaacttgcacgaatgcacgcaagaaaaccaatctaaccatctaagacgatcctaataaaatcagcaagctaattggttgttaatttgggccccagttgctgaggtacatgaccgtcgtcagctcctcgtcttgctgcttggctttcctccgtcgcggtcgcggcaggctgcagcgtgcgcgcgccgccgctcccgggcgcggcctacagcatgcatgcagtgctgctgggtcttctagctagctgctgtccccggacgtggagcgccgcatccgcgaagagcccggagttggacggcgacggggtgccagcagcagcagcacccggccgcgtctcccctcccctctctggccggcggtagggatccttgcggagccgggcgcggcggaaggcgatggcgacggggttatcgtcgtgggcgaggaagcagccagctgacgccggctgaggagccactcggtgtcgaagcggcggcggatgaaggcgagggaataaaagaaaagaaaaaattgttgtgtgttctacatacttttttaatttttttgggtatctatactgctatgggatttaaaatgcatgattttgtatagtttagaggtgaatttctgatattgaggataaaggatatcaaataaactcgatgcaaagttaacggacaacaggtgaacttatttctttgcgagcgcctaggctatcacccggctgggctgctatcgcctggctgggcttgctaataggccatgctcaggctgtactaacaggtggtttacccaacttttacgactggcctttctaatttttgttttgtcagttttttctgtaactttttatttgttgtcattatctttttgcgtgtttgtcatggctccaaaatttttcatcttcaatctttaaaaatcatgcccgtccgttgcaagaaaaaaaataaaaatatggtaatcattagatgattaggatttaattttcatgatgtcagtcctttagaaaaataaagaatgcaagcagtgggttatgttaaagtcagatcaccaattgtatgtaaataaaattgcatgcgaatagtaacctgtgcatccttttcagttttcaaccacttaattttctttatcagaatctgtatcaccaatacatttatctatggcgttctgacactactacgaaacactatattagtagtgctctcataggtaccgattcatttaaaaccggcacctatgactatgagtgcttttccataccaatgagcatgtttaactcgatcaaattaagaaccaccacctatatcacttataggtgttggtttataataaaaattgacacaaatagtgataggtattagttcttaaaaaatcggcagtcggttatttttttcaacaacacctatgtaacaagccgacctgataagcaacattgacgaaaatatcacgaatgagttgtgcctgcttggtacttatcttcaaactactccaccctatcctcttctccctctagccacttttctcttctccccttatcctcatcccctctccacctggctagtagcgagggcgacccagcgatggttagggcgcagcctccacgacggcagggcgcgggtggcctccacggatgtgtgtggcctcccttatgtcacgggcatcctagcccactacgaggtacggttggtggtctccacagcggcgagcggcgggcaacctcccttctgtcacgagcatcctccatggtggtgggcagcctccacagcagcgctgagtatgacctcccaatggcggctcattggtcacccagatccgcgcttcgtccccatcagtgtcgttctcttatttctagatccgtgtgttcttggatgttgatctatgcatgttttgatgcctctgtgttgttggatggatgggtggtggtacgtggatgttgataaatgtgttcttggatgtgggatgctcaggatgctctagggtgatggggagctgcttgatgagctagatttttttgattcatggacactcacaggtgttggttactaaacaggcatatatgacatcttctcattagttcccccttttgctggttgggaaaccagcacctatttagggttcccaaccggcacatatagggttttctgtgctagtatgatcaagtcctggaaactataaatgtattcagtacagctattacaccccacatgctcatagcaaggaatagaaaggcataacaaaggagcaacatctctagtgacttaaaactccatcgtggaacatgaaggccggggatcatagcacctaatccagtccgcgactacacttgctgcacttgcaattagcggaacatagctgcagattcgtaccaatggcttgctggctgagggggttggatggatcgaactggtaccagcggtttgctggagtaggaaaaatgatacggagtaaatctcagtagcagaaaatggcatggtggtgctgaagcatcggacaacagacaaaaatttagtacttgaggatgaacccaatcatggcgcatgggtccaagtgtccaacagttggtgccgatgcgtgcggtgcaggttggccttagtggcacctcatcgaaagaggcaatggccgttgccaccactgaggagaggagaaacttgaagacgtgtggcaagccccaattggaatagaataggaatggaaggaagtcgcagatgtgtagagttatctacgcaataagatgggcagccaaactcctgcttggctcactatgttgagatttgcgaacaatacagaaataggcaaaaacatcgatggtgctggtggtggaaaacaaaacaaaacacggatgcacacagacattgcacgtgaatcggtacgcccaatgcacacatgggacatcgcgctcttgcatggctatcagacgatgtagcaaaatagagaaatgcgggtgagcagaattggaaggacacgatgcaggtaggcgggcaggtgcacaaagcgcgaggcggacgtgaacgtgcacacgggggtaatgccaagtggacgatgtacgaaactataggcagaaatagttcgaacttttataatagtagagatatatcacgctaataatctaaattcttaaagggagtaccaccaccaccaccaccaccaccaccaacttttttctttaaaaaagaaagaacaatgtagaaccagaaggcctacatatcaaccatcccactacccacatgtctagcctgaacataaatcttatgcccatgcaagtgcaaacctctagtaggacatgcgacacagttacaggcaaagagatagaggtagtggaagtggaaaggctttcaattgacagaagatagaaaccctaaatcggatttgtgtaggctggcgatggctgatgcagcagggaggtcgactgatgacatgtgagataggcaaggctcttctatgaggacgccaattatgagggcactggatttgcatcctatgtgggccgagtgtaggaggagacgtggatgagggagatgatgagaggatgcctttctctctccacacctctgagagttagtggcgttgcttactcgcccaaagagacgacaagatgttttggttatatgggagttagaaagactaggactaggagttaagttgtgtgagagattatagttgggttgcatgggtgattgaagtgcggctgtgtgggagtcaggttatttcggtcaatatgtagtcacttcgactagcaaggtaggacgattgggttggtcaaacttagtttggtctttcagattgtaggcccaaactaatggccagagacgactgagatcaacttcggtcttttggggtccatcttagtttgttggggtctgattttgatctaccatttgtatgcacatccctacttgtattgttccttagcggatgagtgtgtgtccttggggcaggaagcataagactatagaatttttgacgttatactattcaccgtctcgataaatcattatttggatggtgttcatataggttgttcaatgtacatgtgtttttttccttaaacaaattgcataagacaatgtgagatttcatattaatatagtagaaaaaaaacaagataatagctctggaatgctataactagaaaacagaagaaaaacagccacgtcaaacacctacgatataaacacccacccatgaaaacaaataggagcatcacatccaaatacactcaactttatccacatcaatatacaggtttgggtactcaacaactaacacaaggtagacttgcatgggtattaatataatataactagttggcaccccgcgtctttgccgcaggttttgtagttttatcgtcaaacaaaatcatagttttaaatgcttaggtacaactctatgtatatataaaatatatgataatgtggatttatatatgtcttatgttattacaatacaattcagattttatttttccaagcgtcattgtgtattattataatatatgaatattattttcatccgcaatatgggtttcgttataattggacaatttgcatttctctactccacttaagttttttctaaaaatagattcaggtaacgatacctaataattatatgctatcttatcatgcataataaaacaaaacacatatattaaacaataatcatataataaacaataatttgagttgtattcagaaaacatagtgttattgtcgaaacatgaattcggcaataataaaagggggtagcgcacgagacctaaaagtggatggatgcagagacaaaggatttagacaggttcaggccctctcgatgagaggtaataccctactcctgtttggggatttgaatccgccgagtgtgtattgatctgacgatcaggttgtctcatgcccctagaggggctccctgccctccttatataggttgggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccatagtagcccctgagaccttcacagtgtaaaatataatcttctctcgaactagattactccaaagcggagtgcttcaatcatattcgccatggtctcccgggtacttttaccaaatttgaagactgtggagggctgaaaaataaagtcaggtgcatcgaatagatgcacctaataggtgtagcccccgactatgtggttaattgaaccaaccaaacatatagtcaaggaataaataatctaaccaaccgagtggttttgataattgtaatcaaccaagtgacttgatatcaacatatagcatatgcggtgtgaatccccgaataatatgatccaagtgatataccgactgcttggcaaaatataatgcgtacaacctaaagttgacaacatttttgaaagttcacatagcaaaacaactataaagaagcttgaatgctgtgaataaagaaatttccaaagtattgggcatacgccatgcgcacactgctttaacacatgtgcttaagtccctaaaagacacatggtttcaccacacccggaaatatatggcatatgtggtgtaaaatccgagtaaataaactcataaaggatttaccaaccgcctggaaaatgaccataatatataatcagcctaagccataatattggtcaataaaaatacacacttacgtggcaaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatataacatgctcccgagtaataaatcttccgggtaatatagaccaagcgtaactcatatgaatagcttctgatctgagtgattatcccttatgggatactccaaaatggatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtgtttgaactagtaagcccctgagcatatagcttgtccttctgtcgtagtcacaattgtccattgatggtagctgacgcagttggcatagagacaagacgaccaacatagagataatattgcccaccagaggtggcaaaaatattggtagtagtgaagatagtgattccaatcaaaagtgataaagttgcatagccgtggaggcgaagaaaccagttggcaacagtcaggtcagccagcaatgaatatgaaggcgcccagcaataaagttgtgtagccatggcagtgaaataatcagtcggtgacagacgatgcagctggtgaagaagatgaagatgcccattagtggcgacataataagccatccatgaaggcgaggataccggtcggtggtgacaaaagcaagccgacggtgaagatgtagacacgcatcaaaggtgatgacgaaatccaccaatcatgaagataaagaaaatagtcggcgacgacaaacgcaaccgacagtaatgatgataagcagcaatcatagatgatcaaatataatgacgaagttgcccatcaatagcagtagagtgggctatgttgaagaggcttgacaggatgttgatgaagataacaatgtcggtgatccagtcaatagcaaccgtgaaagtgaaataataagtcggcgaagacatagtcatccattagcaacagagttgatgtcagggccgatgaagcagaggtgctggtgaggatgtcagtgacaataatccatcaaattggtgttatagctgttgcagatgcttcacttggaggaaagtagatgatgttgtccatcttgtcgaaactgaggtgattggttgataactctgctctaaagcaaagacgaagataatgactcctggaattgactcgttggctgattaattgattgcttcagcttgtcgaattttaagagtcttgtatttgtgtagcccccgactctttggttagttgggaaacaactgaacatagagtcgagaactgtagcttcttgtcgtcgaatagtcattgcttgattgaagatatgtgttgaagatgtccaagtagaaatcatgaatgttggagagccacttgttgtagtaaaataacacgacattgcatgccgagatgttgaggttcacaaagacgtcgtggttggtgaagtagcaaaacttgcgaagtagcagcaatagagtttgccggtgccgaagataataaatatgaagtcgctctaccatgatgacaaagttgcatcgccgtgatgaagtgaacacgagtcggcggcaacagaagcaaactggtagtgaagacgcgcagttgtgaagataaaagcaccagtcgacggcggcataacacgagtcggcggcagaaaacgatgatgtccatcagtagtggtagctgtataaaccagacgtagaggcgagggcactagtcaacagcagacgagatgaccggcggtgaagaagataaggctaatcaacactggtagaatcatgtagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggtggccggtcggtgaagacgtagacgcccaccaacggcagcataataggccagccgtgcaggcggaaacaccagtcggaggcggcgaaggcaagccggtcggtgaagacgtagacgcccaacaacggcggcataataggccagccgtgcaggcgaaaacaccagtcggcggcggacgaggcggccggtcggtgaagacgtagacgcccaacaacggcggcataataggccagccgtgctggcggaaacaccagtcggcggcggcgaaggcaagccggtcggtgaagacgtggacgcccaacaacagcggcataaaggccagccgtgcaggcggaaacaccagtcggcggcggcgaaggcaagccggtcggtgaagacgtagacgcccaacaacggcggcataaaaggccagccgtgtaggcggaaacaccagtcggcggcagcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcagcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcggaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgacgatgtagacatccaacaacggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaacagcggcggcataataggccagctgtgtaggcggaggcaccactcggcggcgacggaggcaggccggcggtgaagtcgtagacgcccaacagcggcggcataataggccagccgtgtaggcggaggcaccactcagcggcgacggaggtaggccggcggtgaagtcgtagacgcccaacagcggcggcataataggccagccgtgtaggcagaggcaccactcggcggcgacggaggcaggccggcggtgaagtcgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgcgatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcagagacaaaggatttagacaggttcaggccctctcgatgagaggtaataccctactcctgtttggggatttgaatccgccgagtgtgtattgatctgacgatcaggttgtctcatgcccctagaggggctccctgccctccttatataggttgggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccatagttatgcacaaaatatgtaacagtgatatgtgtgacaataagtagagcaaagggaggtgaatagataactaataaatgattaaattggatgaataagtagcttcttgatccaattattattatctttatactaatatcatctaatggcttaaaattatcgatgatgtggcttgttgcatgtcttgctttattataggagaaaatgccccttagtgggtaccaattatatagaaaaagataggattaggaataatttttttcttaaaaataaagatgcgctagctaggttgtctcgccgtccatttgttgtagttccaggttcattgaatatgactgttcaataatagctcatttatggccagaaaaaaacacacatcagtaacctaagaa

SEQ ID NO: 48168 - DNA, 1035 bp, Oryza sativa
acaacagcggtcataaaggccagccgtgcaggcggaaacaccagtcggcggcggcaaaggcaagccggtcggtgaagacgtagacgcccaacaacagcggcataaaggccagccgtgcaggcgaaaacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataaaggccagccgtgcaggcggaaacaccagtcggtggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacagcggcataaaggccagccgtgcaggcgaaaacaccagtcggcggcggacgaggcggccggtcggtgaagacgtagacgcccaacaacggcggcataataggccagccgtgctggcggaaacaccagtcggcggcggcgaaggcaagccggtcggtgaagacgtggacgcccaacaacagcggcataaaggccagccgtgcaggcggaaacaccagtcggcggcggcgaaggcaagccggtcggtgaagacgtagacgcccaacaacagcggcataaaaggccagccgtgtaggcggaaacaccagtcggcggcagcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaatcatgaagtactgta

SEQ ID NO: 48169 - DNA, 767 bp, Oryza sativa
aataggacccatcccatatgatattgtaaaacaatgcaatatttaatagaaatgcgggacatttgtaaattgggtacaatatgatcaattgcaatgtatgacttgccttgctctcgcactgatggaaccacagcaacttcttcgagaaaccacgaatcgacgaaacgggcgaaatctacgcgaccaacaaagcacacaagcaaaacatgctataagtctactgaaacaggaaacaaaaccatttttaatggattctatacatttttatgaatttactgagacttaaatggacttaatcggagctcggatgaattacttatgatttttagaagattatctgtgtttttactaataaagaaaaagccttaatgtatttattgcgcaatattgccctagggctgacgtcagcaaggggtggggcggcgccgacatgcggaccccactggtcagcagctcaagggggagggaggggtactggcaggcggggcccaccgggcggcggctcatggggaaaggaggaaggcggcctggctcggctcggcttcaagccggccggccggttagggcgagggcggtggcggcaagcggccaccgacggcggtggccggcgagaagacggcggcggccggcgacgcgggcgacggtgcatcgcggcgacgcgtatgcggggagcggcggcgcgcgcgggaggaagagagagggagttctcaccggggttcggccggcgcgggaagagacgacggcaacggcgacggtgagcgaccgaa

SEQ ID NO: 48170 - DNA, 799 bp, Oryza sativa
aggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggacaccagtcggcggcgacggaggcaggccggcggtgaagtcgtagacgcccaacagcggcggcataataggccagccgtgtaggcggaggcaccactcggcggcgacggaggcaggccggtggtgaagtcgtagacgcccaacagcggcggcataataggccagccgtgtaggcggaggcaccactcggcggcgacggaggcaggccggcggtgaagacgtagacgcccatgaacggtggtgtgaccgaccaaccgtataggcgatgacaccagtcggcggcgacggaggcaggccggcggtgaagtcgttgttgcgatcagcaatggcggt

SEQ ID NO: 48171 - DNA, 1852 bp, Oryza sativa
caccctggtcatgaatgctgatgatagggttgctctctcccatttccgcacatgccctgaccacacgatataatttctgtgccatttcagcatctccacgctgtactgcattgaaatcgagctctgcatcattttgtccactaaccatgctggaggcagcaccaccacccataccaattctgtatgctgggccaccaatcttcacaactagcatgccaatttctggatcccccttagatatatgtgcatggtcaatttgcccgattgccccactaaacattattggcttcagccactcgcgccgttccccattaagcaacctcgtcccaaaatttctagtaaatccctgaattagaggttcaccaaacttgttcccatagtcagaagcgccatcgctagcatcaataagaatttgcaaaggggaggccaaattcgacagatatgaaaaggatggatcctcccagggtgcatatgcaccttcaattcggagattaccaacacaatagccagcagtagaagcaacaacaaaagaaccctttccagtggcatgtgtgtcccttatgcgaccacctgcacctgtttcagctcctggataaggtgccacagcacatggaaaattatgggtttctgctgtgaataaaatatcaagctcacgcatcataacagataatggtgaagtggagcctggaactgttgggcgtagctgatttgctggatattcctttattgcacttgagttgtcattaaatccgatgactgagttattatcggggttagctttcaggggactcttcactaactgaaacaaggttctcggcatggtctctccatctatcacaagctttccattaaaaaaccaatgcctgctgtgctcactgttggattgtgcaatgtcgaaaagttcaacagtggttgggttccgtttgatgtcatctctgaagaggtgggtatagtacttgatatcttgttcatcaaaagcaagtcccatcttcacatttatttcttccagagcttctcttcccctttcaatgactggaacaatacggacaggttcaggaactacatctgaatgaaatgatgtgagcttcttaggataaacacactctgtcattctatcatgaaccaaagcagtaaagtcgttaagctggctttcatcaagtggaccatagccaggatccaagcataaaaggtatctccttgatctctccaagcgagttacttccatcaatgagagagatttacatattgagacggcattggttgagaacgctgttgaaaaagtcatccggggaccaacctcaacaatgacactataagggttcctagcgacttcctcctccagaaagctttgtgcttgtaacttatcaggttcataggtttctgctaagagccactgcagtgttgcaagcttctctgaagctaatgcattatccaattgaatgttgaagcattgttcggtctttatacccacaatattagaagaaacctttgcttgcacttgcctgagcagctcaattgtctcactgtcttgaagatatggtatacgatataattgaataactccagcttctgatgcattatcagatttgtgaaccaatgaactgtcaagtcccctggaaaccaaagcaccaggagttggcagcaatcggacattaggaactgaagctcttcgaacacctggccaacaaaggtgtctatggaagcactgctgagatcttctcagtccagaactccttgcagcaatgaaaccatttctttttccctacatagagagtagacacataagaaacacaacaatgttatggggaaaaaaaatccatccagtgttgtgcaaaggtcgcttaccagatta

SEQ ID NO: 48172 - DNA, 4948 bp, Oryza sativa
tagcttgctttgctttgctaggattattcgattactaattgcaagcagcaaattaagactgcattaattgtaggtggatgattatggtcctcatatcatataggagtatatcaatgggtgcagtgagaaagcggcgcgccgcagaggcacttgttgtgctggaagcagtaggcatcgaagctgggcatgttgccgccggtgggcaccacgccgcagagcctgttgtagctgacgttgagcagctgcatgtccgtcatgttggccatctgcgccgggatgctgccgtagatggagttgtggctcacgtccaggaaattcagctcttccggcagctgcagctgcgacatgttgaagctcagcgcgttgcgcgacaggtacgcgctgacgagctccttcttccccgacccgaacagcatcgacgcgtcgccggtgagctggttgcgcgacaggtcgatctgcacgaagttgacggcgccgaactccgccgggatcctccccgtcaggttgttgtgggacatcgtcaggaacgcttgctgcccggccttgctcagcagcagccgcgggatgctcccggtgaggcggttgcggctgaggtcgatggagttcagcttcgggggcttggcgaggctcgccgggatggcgccggtgagcgagttgaaggagagatcgaggattccgaggtcggtgaacttgtcgccgatgaaggacgggatggggccggagacggcggtgtgggagatggtgagcaccctgaggccggagatgttggcgagcgcggcggggatggggcccgtgatgcctgggaccttgaagaaggtgatgtaccggaggcgggtgaggccggcgatggcgtcgccggggatggtgccggtgatgttgtcgtcgcgtgtgatggcgaggttgatgacgcggtcgtcggaggggaggtagtcgtcgccgcagtcgacgccgtaccagtcgcagcaggggaattcgggcgtccagtactcgaaggaggcgttgttgaaggccgccttcacggccagcagagcggcgctgtcgtcggcgtggcagctcggccccgacgccgccgcactagtgcagctcaacgccgccaccgccagcaggagcaggacgacggcgcgcgccatttccatccaatataatcttaatctttcctttccttgctgagttaatttatatcctgagttggttgttggtacgtgtagtaagtatatatagtcagatggatcgagtatgcagttttggcgccaaccgctttgacttgaactcgttagtggaagactcacaactcacaagtgtgtgcgtgcttcctctcttctatctgcttgtttacttcgacgacgtcccccaggaatctcaagatgggccggattggcgcttcttcggcccaaaccgagtctactgccgccggagagaacttcaaggcccacgacctttcccgcttcagccgtctgggtctgggctggaggagcgcacttcaccctcgagtggcccagctttgcagcctggccagccactcagtgcttcagttgccgccgccatgtctgaggccgactccgccggcgacatccatccttgggaagaggcctcggcagccaagacaccgctctcgcccagctccctacacaccgccatgggcgcaacgcgtcgtgatgaaaagactcggcgtcgtcgacaacgagaacaaggttgaagagcaggacctcttgcggtacctggagctgtttaaatcacccctcgcgccgtctcatgtgcaggcacttgcggcgctgtgcagcgtggcgatccctgtctgcggggcggcctgattgctctgttttctggtggtggaagcccatgagtctctatgtcttgtagtcttttagtttggaatgttaggggcaaaaggtccctagtagctgatgttgttagaacttctagtgcgtccattttttgttgtcaagagtctaaattggctgttttggaccagcggttgcagaaccagtcttgtggtcctgtgttagactgtgcggatttcattcctgctgatggaactagagggggcctgttcacggcttggaggagtgatctcttctctgtttcttgcctgcataaaggaaggtggtcgctctctctctcagattttgtaatttggaaggcttaccaatgtctacgggccgcagtccgacggcgacaaaatcctttttctagaggagctgctggtggttggtgactttaacttgttggcctcggagggtgacaagaacaatggcaatgtgaatcgcagactgattaacaagtttagacaaactattgacgttctggagctccgtgaagtttatcagttcaggcgccggtatacttggagcagtgaacaagagcagccaaccttaaccaaaattgataaagtgttgattaatggggaatgggaggaaattttccaggatgcccatttgcaagctctcagttcgtccgcttccgaccactgccctctgcttttggcttgcgataacatgatgcaccgtccgagaaagtataagtttgagtctttctggaccaagctagatgggtttgaggaagtggtccggcaagcttgggcggctgcgccgtcgggctccaactctgtttcctccctccatctcaagttgaaatctactgccacatctcttcgttcgtggggggctaggcgaatcaacgaacttcggcagcagctcgcagtggctcatgaaattattcttcagctggacaaggcccaggacgaccggcttctctcggcagaggagcgatcgctgcgtgctaccttgaagggacgatgccttgctctcgcctccctggagcacattaggctccgtcagcgagccaggttgttattcctcaagcatagcggcacaacggcacaattttttcgccttaagatcaatgcacgtcgaagaaagaaagcaattcctaccctctgtcatgatggtgtctatgctaccactgaagaagataagctacaggctgcatacaactatttcctcaatattttggggacgcgtggagagcgaattcccagcacctacatctcgtcaacacagcttccatcatcctcctgcccaagaaagaggacccgaatcaactaactgacttttgcccaattagtttgattcacagtttcgccaagatcctgaccaaaattctagcacttcgtctcgccccgagaatggatgaattgatcgggcctgcacagtcagcctttattaggcgcagaagaatacaagagaacttcctctacgttcatggtgtagttaaaaagttgcatcggtccaaaacgcctgccatgctgttgaagattgacatcgcaaaagcttttgatacggtatcttgggaattccttttggagctgcttcgacatttgggcttcggcgctcgatggcgtgactgtgtttctgctttgcttttcacttcgtcaaccaccgtcaccatcaatggtagagacactcaaaggatcaagctagctcggggactcaggcaaggggatccactctcgccgttgcttttcgtcattgtgatggaggcatttgcggctctctgctccacggcagcgagccgtggcgtgctttccccacttgctacgggttccttgccacttcgcgcctcaatctatgcggatgatgccatcatcttcttccatccttctcggcgggacgcgctgatgatccacttcatactcaagttgatgggtgacgccaccggcttggtttccaacctagccaagagctcgttgaccctgatccattgcactgatgttcaaattgaagaggtcacagaggtgttgacatgcccaatcaagcaattgccgattgtttacttggggctgccgctttctgtgcgtaaaccgacgaaagtgcaaatccaactgatgatggataggcttgccaaaaatttggctggctggaagcccaagcttttatctccagatgcccgtctagccctgatcaagcatgtgttaatggcgctcccactctacttcatgtccgtcttggaactaccagcctgggcgatcaacgaaattgagaagaaatgctggggtttcatttggaagggtgatgaagatgctgcgggctcttgcagcttggtggcttgggagaagctttgcctctctatcgagcaggggggactagggatcagaaacctacgcctaatgggaattgcgcttcgcactcggtggatttggctgtgccgcgctgagccagagtgttcttggacgcgcattgcacctctagctgacagaaagtcactgcactgctttgccgctagtagcaaagtactgctggggaacggagcctctacctcgttttggtgcgatagcttgttgccagacggaggatcagtgcagtacagattcccaattcttttctccttcgtcaagctgagtgacatcacagtggctgccgctctctgcaacaactcctagattgcagatattaggggcggcctgtctgtccaagcgatggaggaataccttgcgctcgggtacgtgatcgccggtgacggagcgtggggctcctcaccgagagaccgcgcgggccccccttgccggttcggccgggggcgctaggtgaggttctaagcactcgatctgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcccccgttcttaagtgggcaaggtccttttatatctcaaggggatcccacctgcaccacttctacctactcttcttttgggtggggactcaccctatcttcccaaaaaagaaaaaactggcttgcgc

SEQ ID NO: 48173 - DNA, 24563 bp, Oryza sativa
  unsure (1)..(24563): unsure at all n locations
gccgcctgttgccacctaacccgcgatctgaccggtatgtgaccggtcacacactgtgacctgtcacggaccgaaccagtgtgctgcgctgcattaaatgcggcgtggggcgctcgtccaacccgcaataaacccggttaggtgagcgccgctgtgctcacctaacccacacacgtggcgccaaacccacagggggtcggggcgccccagccctcggggcccaaacgggagccgcccgacccctcggggagacagagggaggggcggccacatcaccctcgggcccgacccccccgagggggtcaggccacgtgggtgactgcagctgccccaaacctctagtcaagatacccccggtcccatgtcaccgacagtagcccccggcgttatgccagggcgatcgccctcctcgaggaaagcgctcgggcgtgacgccacttcttaggcctggtgacaggtggggccggtctctacaggcgggcaggaatccagtggtcgcaaatcgcgcgcatcggcaagggaaaaaccgaccgataataatgagcggctttcttcaagaccgctacattacttgagtagcgcgcgaattgggacgagccggttcgtttcgcctggagatgtgatgatggtgcatcggtcggcgagcgtagttaacgtgcgcacgatatatgccatctcgactgccacggccgcacatccgcctcgtgcgccgcaaacgggcgagcgggattagtggaggagtgggcgcgagaaacgagggggcgagatagtgggcgcgggaagcgaggagccgggcatagcgttggtaagggtataaagacgccgaggaagagattcgtttccttcctctcgccattattccccttgccttcgccgcttgcgttctaacttctcgtttcctgtgccctaccttcgccgcactcactcgctctcaagcccctcctccgccggtgtcatggcacggggctccgcaccgctcgacggtagcgtgctgccgccttctcgcatcgtgagcgagaggcaggccgggctgccgcgccgattcatgccggaatctgccaccggccgggaggtggtcgcgctgggtgagggacgcccggcaccacactacccggggcggtccgtattcttcctttccttcgcaatggcagggctggtcccgccattctcttctttcttcatggatgttctggagctttataatctccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtttgcgatcccaggggctcacgggggccatggtgtacggcgattaccttcgtcgccggatcgcgccgctccagcggtgcgcccggggcgcctgggagttttcactcacccgtttttcgtcttctggtttttcttctgcctcagcgagatcccgtcgcgcccttcccgccattccaagtccggccggtctgaggccgaggagacggcgaccgcggaggcccggaggcggggagctgaccggcgagaagccgcagaccgcctccgggaagccgaagaagctgcccaggaggccgtccgggctcgccaggctgaggaagccgcttgggaggaggccagactccgccgggccgaggagtccgtccgggagacggaggcggcgcgcgtacgcagggcggcctgccaagtccccgacccgactccgcccgaggcaacgacgacttccgaggccgcccacgacgaggccgcgggcgcgccactcgggcccgacccctcgggcgatgcttggggcgagccagcctcggggaacgcccccgagtccggcacgtccatcggcggaccgagccgcgcggcgcccacaccgaggcggctctcccctctaccttccgctgccccactgagcgcagaacccctcttgcaggccttggccgctgcgaacaccacggtgttggacgggttaagagcccagatggaggtcctgcaggcagagcgggcggaggtcgatgcggcgtgggcgcgcgtcgaagaggggcggcgctcggtggaagccatggtggaggcgggccgcaaggcacaccgccggcacgcctcagagctcgaggcccgtcgtagggacctggcggagatcgccagggaagtggaggacgagcgggagactgccctcatcgccaccgccgtgttcaacgcggtgcgggacgacctctgcctcctatacgggagccaggcggcggagctagagaagaagctcgacgcgtcccggcagcgcgaagaggcccttgaggctcgcgccacggtgctggaggagcgcgcccgcgccctggacacgaaggagagggaactggcgggtcgcgaggccgccgtcgccatccgggaggcaacgctggcggcgcacgaggccgcctgcgccgaagaggagtccgcactccgcctccgcgaggacgagctcactgagcaggagcgagctctcgaggaggccgaggctgcggcgcagcggcgggaggagctggcgcgcctcaatctggaaggcgcccgcgccgagagggccgcactggatcagcgggccgctgaattcgaggcgcgagcgaaggagctggacgcgagagcgtgcagcggtggggcggccgcgggcgacggcgacctagccgcccgcctcgcagccgccgaacacaccatcaccgagctgcagggcgcgctggactcgtccgccggggaggtcgaagccctccgcttggcgggcgaggtagggcctggcatgcttcgggacgccgtctcccgtctagaccgtgccgggcggcaggtgggcctctggggcgggcggaccatgaaatacgccgccaaccaggggggcctcgcccagcgcctctcagagatggccgggaccctccagcggctccccgaggagctcgaggaggcgatcaagtcatcctcgagggacctcgcccggggggcggtggagctcgcactggcaagctaccaggccaggaaccctgacttctccccgtgggcagcgctggaagagttccctcccggaaccgaggatggcgcacgtgcgagggtccgggacgccgccgaccacatcgtccacagcttcgagggtacagcccctcgactcgcgttcgcgctcgactccgacgaggagggcggtgacgacggcgcggacgacagcgacgacgaggccgacggcccgggggcgtcggagtgagcccccaggcccccgccaatcttaataacttttccttcttcttccgaggccttcgggcccccttcttgtatagactgatttaatctgtaatcaagtaaagaggaaatttctgcgtcagttaagtttgttgtgtgtatgagacgaggatggtccgtgccgcggtccttctgtgtcttggcttgaacgagggctcgtgcccaggtcccaacctcaagtggcgcgggtcggggctagtgcctggggagatccgcgtgtcgagactggccaggccgggagcgtggtgaccgagggttatggatgacccgattgtgggcctttgccgattccccccccccccggagttcaccacgccccggggcacggctcggttctgggccccgtttggcgattttagccggcccgggccaccgagggcagggtcgggcacgagcgtgctaattcaagccaagattcttcaaaaggaaacgatagcatagacacaatcctcaggaaatcgaaaatgcttttactgaaatacggaagagaaaaaagataaggatatgcatgtggtagcccccggccaaccctgcacgcccgggggggcgcggggttggcccgagcccgagacctgacaaccgacccccactaggggtagaagcgacgaaggtgttcgatgttccacggattaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtgacgctgatggtagcgccgcaggctctgctggtagcgcgcggctcgaagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccaaagcaccgctggcaactcctcgatccacgagtcgccgtgcttcttgaggatgttgaaggttttggttttgaggcccttgaggatttccgcgttggcgcgctccacttggccattgcttctggggtgggcgggggaggtgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacaccttgttcccgaggaatgcacttcaggaggactccgttagccgcgcgccgatagaaggtcccttccaccagcacgtagcgcttagagatgcgctggacgcgttcactcccttcgcggtgctcgggtagagtcttatctgcgaggtacgcctggatttcagtgatccaagcaatcaatctaggggaactgggagcgctcccctcgggtcccgaggcctggactccgacgggcctcgggggccgttcaggcgcgtccgtctcccctagggggtcgggtcgcgccgacgactgggcaagcctttcttcaaaggcgcccggtggggtctgggctcgcgaggaagcgagccttgagagttcgtcggcgtccgcgttatcccgtctgggcacgtgccgaagctctatcccgtcgaaatggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgcttggcgaggtcaacgtgacccccgcaccggcgccctaaagagatagggagccgtcgaactacatcacccagtaggcggtgtgaggcagctgcgaggggcccgagctggcctcggggacggagatgggctcaggggctggggtccactccgccacaaagtcggcgagggcctggctcttgatcgcgtggcgtggttcaaagcgcaaatcgaattcagagagttcgattgcccatttcaccacccgtccagtaccctctcggttatgcaagatttggccgagggggtaagacgtgaccaccgtgacccgatgcgcctggaaataatggcgcaacttcctcgaagccatcagaatagcgtaaagcatcttctgggcctgagggtatcgggtcttggtgtcccggagggcctcactaacgaagtagacgggccgctgcacctttcggcggggccgatcctcttcgccaggggccgcatctccagggcgttcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggcctcgggccgccattcggctcgggggcctctcctgcctgctctctcccgggtcgagtcgacgcagggtggggatgcacggagtgagggttgtcctcgttgcgctccacgaccaacgccgcgctgaccccatgcggggttgccgccaggtagagtagcaacggctcatctggctccggggcgaccaggactgggggagaactgaggtacgccttcaactgagtgagggcccgctcagcctcctccgtccaggtaaacggcccggagcgtttgaggagcttaaataggggcagtgccttctctcccagcctcgatatgaaccgacttagggcggccatgcagccggtgacgcattgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacccgcattctttaacccgaaaggcattgtcgtataacaataagttcctatgggggtaatgaaagcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgctttgggaacgacgaccgggttcgccagccactcgggatggataacctctcggatgaatccggcctccagaagtcgcgccacctcctcgcggatgaagtcttgacgttccggggcctgccgccgcactttctgccggaccggccttgcgctcggccgcacggcgagacggtgctcaatcacctccctggggaccccgggcatgtccgccggtctccaggcgaagacgtcggcgtttgcccgcaggaaggagacaagcgcgtcttcctatttgccgtccagaagaccactgattcgtgtggtcttggacgggccgtcgcccagggcaacctccttgaccgggacctcgtcgcacgtgatcatccgctgcctcggggcggctgggacggaggtgctgagcctctcgttgccaccctcgggcttggacgcggcggcgaggtggtcccgcgctgctccatacaagcaagcgcgactttgaggttgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccgaagcaccatccccggggccttgatggcgtcaaaggctgcgggggaaaggatgttgagagctgcacccccgtctatgaggacacgccccaacttcacgttgcaaacggtgggggaaaccaccatcgcgatctgtcctccccgggcaacgcacggcgggtggtcggtctggtcgaaggtgagggcaacctccgaccaccgcgtctgccgcgtcgcctcatgggtaggggccgcggccagaagctctcgcttcatggccttgaggctccgacgagaagcgtgagcgcacgctcccccatcgacggtggcgatggtggcccccaggctcctggaaccctagatcatcgtcgccatcgtcgatgtcctcggcgggggccttctgcttggcctcacttcgccggttgccggagggagccgccggggccttgccctcacggcgttcctgcctcctctcctcctcccacttcctcgtccgcttagccaaacttttgaccgcgcggcagtccgcgaggtcgtggagggaggtgttgtgcacggcgcaccacttgccggtcgggcgctccctgctgggagcgccggcctccttctttttgtcgctcgcaggcctcccctttcgggtggcccgcgaagcgccctcgacggcgaggacgtgaccctcgtcgtcggaatgggccgacctctttttcctcctcctgtcccgccgccctaaccgagcggcggatccgggggcggccgaagctgccacaccggaaccggtggagttccaggtccaggcctcctccttgcgagccacacggtccgcgagctgaaaaagctctgcggtggtctggggctccttggaggcgatcttttcgagcatgcggttgtgccgcacgccccccctgaacgcgtagattaccgcgtgtgcggggatgcatggtatggtgttgcggacttgacagaaccgctgaatgtacgagcgaagagactcatcgtcccttcgctgtaccgcatgcaagtccgcttcttcacctgggcgcgcatatgtgccttggaagttcatggtgaactgctggcacaaatcctcccaagagtggaccgacgcgggcggcaagttcattagccaaccccgcgcctgtcccttcagggccatggggaagaaattcgccacgaccctgtcgtcacccccggtggcctcgatcccggtcgtgtagacctggagaaactcggcggggttgacgcttccgtcatatttttcggtgatggtgggccggaaccttgggggccaacggacgttccgaatgctcgccacaaaggctcgacagccgacaccaccaagcgggggcacggggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcgttgacgagggaatggcgcccctcgacgacacggagccggcggtagcagcgccagaggccttggcggcggaggaccgcccaccggcgcctaggcgctgctgcgccgtcatgaccaagtcggccacgtcatccagccaacgtcgggctggagtctctggatcggggacgacgggcgggtgacgcaagagcgcgcccgcagcttggagcgtgccctggggcgtgctgccatcgccgtagacgaggaggcgacgctccccgtctcgccgtccttcttcatcgctcgtgggcggcgaagtcgcggatctttcgaccccctcgagcgcctcctcccgcctaagacttcggcgagaggggggcggtggagtacgagctcgacggcgcgggttctgctccccgtcgtcaccgctagcgctcggagagaggttgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcgggcccccctttgccggttcggccgggggcgctaggtgaggttctaagcactcgatctatggaatgtttcgtgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcccccgttcttaagtgggcaaggtcctccttttatatctcaaggggatcccacctgcaccacttctacctactcttcttttgggtggggactcaccctatcttcccaaaaaagaaaaaactagcttgcgccttcgcctggaagctaaatcacagcttgtctttgagtgaggcccagcgtcatcactcgcctgacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcatagaggctctcatcattccgacgggacggggcgaggcgtgcgaaaggccgcctgttgccacctaacccgcgatctgaccggtctatgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcctgacccctcggggagacaaagggaggggcggccacatcaccctcgggcccgacccccccgagggggtcaggccacgtgggtgactgcagctgccccaaacctctagtcaagatacccccggtcccatgtcaccgacagccgggatttctctcgactccagaagtacggactctatgatatggaaggcggcacctaatggtgacttctcggtgcggtctgcctactctattctttcggccggtagaacatcctgcccgctcggcaagattatctggaaatcccacgcaccagcaagatgcaagttcttcatgttccttgcggtccgcaatgcctatttaacagctgataacctgcagcgccgaggctggaagcttgcaccaatttgtcacctttgttctaaggatggagagtcctgccaacacatcttccaagcctgcaccttctcgcagcaagtttgggtgcaggttcaggctcgtttgaccctctactgctcgccgccgtcctcggactttgccggctggtggctcgctgcccggcaaactgttgcgaagatcgatcgcaagacgtttgacgccggggtcatcctcgttacatggttgatttggaaagagcgcaacgcacgggttttcgagggaacggcctcgtcggtcacgcagttgtgtgcgaccatgtgtgatgaatgggaaacttggaaatcagcagggctagttacctcgttgaatgttgctgcagtgccagctttagaaagattacagattttgtaatttgctttttgttgtaaaggcggtgctctgacgtactgcatttgtacagtttttccccttttccttaatatacatcggtcagcattcttcgccgtcccggcgaaaaaaaagattgaagattaattgtcccagaaacaattgaacacagctttattaatcattccttccaaatgcatcaatctgtttttgacttattaaaatcattatacaaatatatatatatatatatatatatatatttatttatttattttgcttgcattgctgatgtataatttcaccacatagctagtaattaagtaatgggagcttaattgcagggagtagggagcggcggtccgcagaggcacttgttgtggaagaaggagtactgatcgaacctcgcggcgccggcgggcagctcgccgcagaggcggttgtagctgacgttgaagtcctgcaggctgctcagcccggccacctgcgccggcacgccgccgtacagcatgttgtggctgaggtccagcgagctcaccccttcctgcagccgcagcccggtcatgtcgaagctcagcgcgttgcgcgacaggtccatcacctcgaacgccacgccgccgtactcggccgggatgccgccggtgaggttgttccgcgacagcctcaggtaggcgccgccctgctgcgtggtgttgagcttgctgaagagcgccggcggcagggggccggtgaggcggttgcggctgatgtcgatgccgctgaggaaggggagggcggcgagcgacggcgggatggcgccggtgagggagttgaaggagagatcgaggagggtgaggctcttgagcccgccgaggaaggaggggacggggccggagacggcggtccaggagatgatgaggagggagaggcggttgagcttggcgatcgccggcgggatggggccggagatctgggggaggtggtgccacgtgagggtgcggaggtgggtgaggccggcgacggcgtcggggatggtgccggtgaggttggcgtcctggaagacggagaggccgacgacgcggtcggtggtgtcgtcgcaggtgacgtcgtaccattcgcagcagaggttgtcgggcgtccaggaggcgaagtggtaggggtcgccgagggccttcttgatggccagcagtgcggccttgtcgccggcgttgcactccttcttcttcgtggtggcagcggcggcgccggccgcggcgagcacaagaacgacgaccatggcgcgcatcttgttcttgtaggatatcgtattaattaggtagtagcctccactccaatttagttgggcatttcagtgagtgagctagatgatgagatgtgttatatagagagaaagggggagagggagattaatttgatggttggtattaatcaactgttgttgttgacttgttgtatgaaattatttggaaaattaatcgcaaggaagaagaatcaagttgaaaaaaaaatccaacgcatgcaatagcgagtcaacaaaaaacattgaccaccgtacccatgcaagcgtgcatgcggatgagaagggtacagctctgctcatttaatgcacatgcatgtgagtgtgaggcgccgcagacgcagtttcttgaagccgccagggagccagccaagccaaagtaggagtaggagataaaatacaaatactgtagcaagcacgggaaagccagggagaatgaaatggtcaaagttggcagtgccaaattgccaaacttgtccaaatggagagtcaacccaggcctaccacgcctgtgcagggacagagcaccttattgatctaggacaaataatattcttctgcttgcttattgatcttcttgtcccacaaatatccagttttctattcttatcttgtgcatctactcgctccatccacaaaattaagctttatcatcttcgtttctcttctatgcttaagtagagaccatgcctccaattgtcagttgcaaatgtcccgtattagagcttggctatgccaaaagtttagccgagcgtcgaagcatagaaaacagtcttaatgaaaggcatgatcatcctttgacatctgaactaatctgtcagatattagctagcttcaaaaaatataatcttttaagatagtcagagtataagacttctataaatgctcatatttctagacaaagggagtatctatggtggagatgatgcgtatggtacaaatgacagaatgatcattttcccattatctaaaatttatactatcccgtttcatattacaagacactttgattttttttccccttagtttgttaactttacataagcacacgcatgtttagtgcgattcaggcattggggggggcctagttggggcgtgcgcgccccccacgcgcgtttcgggactaaagataggaggtatagttaactaatcaattaattagttttagataattatagcttaagataatgacagtagtagttaggattttctttttttcacaagattttttaactaacaaattgaaaagaaatctatttctgaagtcaaattttcaaaattttaaatccagatttgaaaattttaactcgaaatttgaatttttttttaagtcaaattttaaaaacttttaacttttcatctcacatttgaaaaactttcaactcgagattcgaaaattttcaagtccagatttgaaaattttgaaaactttcaactcgagatttgaaaactttgagctcagatttaaaaactttcaagtccagatttgaaaattttgaaaactttcaactcgagatttgaaaactttgagctcagatttaaaaactttcaagtccagatttgaaaatttttagctcgagatttgaaaactttcaagtccaaatttgaaaatttttaagttaagatttaaaaattactagtaaactaatcagtagtaaaaataggagactaatcattactccctccgtcccacaatataaggggttttgagtttttgcttgcaacatttgaccactcgtattattcaaattttttttgcaaatataaaaaatgaaaagttgtgcttaaaatactgtggataataaagtaagtcacaaataaaataaataataatttttaaaaaaattgaataagacgagtggtcaaacgttgcaagaaaaaacttaaaatctcttatattctaggacggagggagtagtaaactaattacgattttttctcccgtgtggcagaaaaaagaaaaaaaaaaggaaaaaagaagagacggcggtgcgccaaaagaaaaagaaaaaagagagagaggcgtgcgcgcgtgcgtgcatgggccgtgtgggccggagtatgcgccggcaacgcgcgcgcggggattagcttttccgggcatcgggtaccctaggccattgtccgaagcctggcatcccatggccttgtgggctgcttttttctaccatggattgacgactatcaaggcccaacccgtaatgggctggcccaggttatggcccaatcctagctcatataattagaaatagatttgctagaaaactttcagataagatctcagtactatgtaaccaaaccattgttgaattcaagttttattaataagttatatcgtaattacattgtagttagtacaatgtaattacacttcaattatactacagatacatctgaaagtttttgaaaaaaaaaaacttgcgacagttttttaagatactcccgttagaaaacttcgtatttgctggtacaatcagttttattgtgtgttgtaaattaagttgaatgaaacacatttatagtagcaatatccactccaatgttcatctttcaagtacatctggaactataatataaaagttggctgattgattgatcatattgcaagacgacatgaacattgttctcttcacttacactcgttctccgtacattaccagttttccagtcgtagctagcacagtacaatactcttaattactagtaggatttaacaaggagttcagataattaattttaagtagcgattagatgtagtttagttgaaagtttttatataaatgtttttgtagtattatttatcgacgacggcaggcggtggcgaggggagcgccgcagaggcatttgttgtgttggtagcagtaggcgtcgaacctgggcatggcgggcaccgcgccgcacatcttgttgtagctgacgttgaacgtctgcaggttggtgaggttggccacctgcgccgggatccccccgcggatggcgttgtggctcacgtccacgtagtacgtctcctccgcgaactccacgccggacatgttgaagacgaagccgtttcgcgacaggtccacgtaccttgcccgccggaacaccgccgacgcgtcgccggtcagcgcgttccgcgacaggtccaccagcgccaggttcgccgccgccagcaggtccgccgggacgctcccggacaggttgttgtgcgacagccggaggtacacctcgtcgtcgtcgtcctgcagctgcaggttggagaagaggcccggcgggatggggccggagaggcggttgcggctgaggttgagncggagagattggtgaggtcgtgcaggtagggcgtgatgaggccggtaagggagttgaaggagagatcgagcatggtgagggaggtgaggttggcgaggaaggaggggacggggccggagacggcggtccaggagatggtgaggtgggtgaggtcggtgagggcggcgagggagtcggggatggggccggagaggctggggaggtggtggaggaggagggtgcggaggtgggtgaggttggcgatggcgtcggggatggcgccggtgaggttggtgtcctggaagacggagagggagacgacgcggccagagtcctggtcgcagtccacgtcgtaccagtcgcagcaggaggtgttgcgcgtccacgacgccaaattgtaggggttcccgagggcgtcgtcgatggccagaagcgccgcctcgtcgtcctcatggcattgcaccttctgctgctgctcatcgtcgtccttggccatggaggcagcagacaggaggaggacggacagcagcagcagcagcaggagcttcacatccatggtcatcatcatcatcatatatattggtcgtttaattttaccagcttgagctagctgcttaatcaattgccgactgatcgagtatgtatgtatgtatgtatgtttgtgcaattggagtgaggtcgcaagagatattgagatgcatatggtgcatgcaatgccgtgtatatatagcctcgcctgggccctgctctctctctcgactgaaaagagatcttctttttcaggtgttaaaaggttattaagttgggagcacctgcactactgagacagagataaagaagctaattaagatagataattttggattaaaatattgggaaaaagcgcaggcaagtgcgcgacaaagatacatggaggcaggccaggccatgcaacgccaatgcagtagcgacattcacttactaattgctcagatatttcacccagtagtagcatttgcattgcggacctaacctcatgtgatctgaatctgactgacatggatatgcatttactagtatttcgccggcctttccatcgatggatgcttacttgcgtggacagatagttgcagacggccaattgcaacaccagtattcacgcatgcttcacggattaacagcccttctagtgagggaggaggcactgaattctcatcactcagcacaggagtcaggaatcgtaatggccaaccaactggattgttattgcctgcagcacattaattgttccaacaggggcaaatgctctccatctttctttcttctattagacacaaaaggccttatgttttgtctacagtgtaaattaaatcctagcgatacctaaaattatgtagcccatcttatcctatcaaaacaaaacaacaatcctatggacaaaaaaacatcatggtttctggtcgaccaccggaagctacggtatcaccttccaggaccactgctctctctgcctccctccaatcgccatgatcaacgataatgcttcatttcagatggtttcagaccgtatcgctgctgaatgctccttcaaatgcaaaggggaggcttcaccaccaaattatatatgctctcctttcatgacgcatagcactgaaacagaggcacgcacatccatggtttccttgtcttgtaactttgttatctactaacgagccagctttgtttaaatataccacctttcctgaagttgcgtccatgtggagatgcagaatcaccttgatttcggtagcactgaaaaacacaatgttaaaatgtttagacgactttatgcgcatggtttttttaaaaacaaaagcagctgctagaaaaaaaataatagcacaagcagttccagctcatttctcaaagggttaggcaatccaagtaaaccatagatgtccaatatccaagttgctaagcacagctaatttgataatgctgcttttgtacgagagaattcacctgcaatgcattatcggataataatccagagtatgcatctaacaaccaatcacgttttcattcaaagaagtaaatagcaaaccaaacagcaaaattgttttgagttgacataccctgtagcatacaactgagtcatctgggtacatgacaaacagcttggtgccaaggcgagctcgacatgaatcacatatgctctcgtcagttagctgcacatgccttgacctctcctctaatctggtcaaccgtgcatcaaggttcgttgcgcgtgataaattatgaactacctatcaataggcatagagcgaaagagaaaatggtaagtcaaacttcacataaaagataagaccaacctgggagcaagtttgagttcaagagaaatattaacagtgcagaggcagaatagttcctcaaacagtcacatttcaatagaagacattggctgaaaaacaggaaatgattatgtttacctgcccttgagcatgatggtgcacccgggctctcagcattcgcaaaattgtatctgatgctagctgaagaggcatatcagcagataatctctggcaaaaataattatagctcaggcttcagaattcttgttctaataaaagtagcacaaaataggatgatcataccaatagcagcgataatataaacataaaagaacacggtgggatgcccctacaccagttttctattatccatgtattctttatttctttcaaagaccaatacacagagattaacaaacaggacatctcatttaccttttgttatatatcaactcctaaagagaaggatcacagcagacctctatagaccaggatgattaaggaatatcaggaacccaaaaaggtaataaatactaaatacaacattcaggcaatgaccatttgatggttcggaatcctgttctgaaggaacaagtgcacactcattttttctgggacaacacaaattgcttttctagactcactccccatgatcataaattaccaagggctagaaacactagcccccatgttaactagcatgcacatcacaaataacaaattaatatcatcaaatagattctgatcatacttctgtaagaaagtggtacctccaacacttgtattggatccaatgattccccatggttatggagaagtcgaacggctgctgtaaacatgggtcctttcccatttttggggtccagatacaaatccaacagcctgagttcacaggaagatgtagagaatatgaactaaggaccaaggtcatgatgcatgaaattatgctagtaatactaataagtcaacatagaaaagctaaaatcaaatcaaaacatagagaatgtaccaagaatactaacaagccaccatgtaataaatactgaagtgaggtaataacatactgaatataggcatcatctcgaccaatctctgcacagtactgctcagcagcttcactatcctccagtttccttcatcataaatgaagaagaaccaacaagaaagttagggaacagaacttgtaggggtgtacaagtccagttaaacaaaacattactgctgaaatttacaagtaacaacaaaccaataaaaaataaatgcagcacaggatcttacagcgctaatatctgaagtacaatgttctcttggcccatcttcctatacaaaatagcctgccagaaggaaagagatttttatgtcaaatatgtcagatataagcgatgaggactatcaagcaagcataaatttcaatgggtaggacacaaaatgagctggcatggaacgcgagaaggaagaaataaattgtataatcaccttttccagccatagctcagattctgaaatcacatatagcacttcttctgggtcatacaaatctgacgattgcaaaaaaaattgcaacctttccctcaatagataaatgaactgcatatcagaatcaaattctttattgtttctctcttcattgttggatcccaaacggactgcgtccatggcagatctggagagggacaatgcatatgacgtgtgatagtgaggctcatcacattcctgttcctcaatcaaccattgcaaatatctgcaaaacttagcatattcagatttcataaaagctgaggaatttattcagcaagagtacaaaaggcatagaacacatagagctttcaaagaaacatgcaaatggtaactatatttgattaagaactacctaatataatacgcatatgatacagtagcttcaagtcataatatgttatttcattgagcctcattatgtttccttcgtatatatttagaatacgcttaggtcctgtttgatttataccccaattcaaccatgccaaataattggcaacaccaagaaatttgtcacccatttggtttgcaacctaaagaactgccattgccaaattatttggcatcactcttatgcccatacaaattagaacccactcattcttgccaaaatttttggcaatagacaaatcttgtcattgcccaaaaaaattggtaacactaggaatggaattgatccaaacaggccccccttggttacaactattattgtcagcatttactcgaataatctggctggaaagacaagatcatcaatcaatcgtatcaatgttcaggtcactctacagtggtgatggatcccaagataccaagtaattagtaagaagcctgacaaactgctattagttcattgtttatgatcatgcaattgtataatgaacaaacttgcacaacgtatacccataattcactctgttactatttaacatttttttaacaaggatcattggaggatcatcatggaatcttgagttctaacttgtaatgattttgtcgattcattatatgtacctttggtgaatgccaaccttctctggatcaatggcagcaacaaccttttctgtagaataacaatcatccagaataaatgttaacgcatgttagttacacccaaaaaagtttcctagcagccctaagtagcaaacacaattttctggatgcaatataggctgatatagtgaaaatattgttagttctaaaataggagaaagagagcccatcgatccatgattacatatgcctactaccatccacactatgttatatacacattcataagtcaaaaggagaaaaaaaactggaaattgtgttgatctgccatggataagccataaaaggcacactggtatagtggtttatctaaaacaaagcaattaccaggagaaagctgtttttccctcatttcagatgttaaaattgcagttgcaagctcttgatcaatgtctgccacctaaacgcaaatagtcagtagaagtacacaaagtggaacagatcattgatcatgaagtccttagtgtgaagtaaatacccatccaagatgctccagaacaaggtcctgatcagatgatgcttgaagtatcttggaggcttcaacggcagcaatttcctcaccagacattttaccaacagaagtttcaagagagtcagtttcaggtaggattgcatgatccttccacaaaccagtgctgtaattccttgctaagatacgccagataccaagggatttggagcacattcctttactgccatataagaatgcaagcgtccgcagatgtccagagtcatccaaaagtgattctagttcctcctgcaccaccatagtatttttattgtatcttttttttaatttgaacacataagaatatcactgaactatatgtagttatgtactgttctcaaatgaagagttaatgtcgatttaagtatcgtaggtgtgtaacagtcttaaacgcttcaaggttgcagatgtttaaaggatttacataccacaacacagctattctgagatgatgcaagcttctccatgtcatcaacaagattgagagctctataaagatacatcagaagagtatcaaccccttccatctctgaagaagataaatccttctctcgggatgcacacaggtacctagtttcatatagcattcagacatcagctggatggagcagcttatttgcaattcgtaatgaataaaaaatgtcgtgaatgagcaaacctgataatatttctgattgctacttccagcagatcagctctgcttggtggatttgaaaggaaatcatcatccacaactgtgtccacacctgcctttttgagaaacaatgcctgttgaagtgttactagcccatcatcaataacttcttcaagaggctttgggggagcatgcaagccccaataacgctttcttggcacctaaaatttacaaagttcacaatcagataaaaaactgctgaatacaaaaggcagccagtcatagtggaagatgagcagtttgtcttgagaacttaatcagtatgttaggtgatgaaaactacagattccatttgacaattacaaaaatatgttgacaaattaatctagcagatcaaaacttaacagatgtgcctaccaatataagctttacgctcaaatttgaaggaaccagctcatgttgatactcaagaggaacgggttcatatatcaagaaattaataaagtcttatccattgaaaaccacattaaagagataaaagaagttgcagcattcaacatgaacttttcacatacagaagaaaaggttaagagagtatcatgagaaaggttgtgcagttagtcagctcctcgagcacattacaggataaaacataaaacaaggaatgtgttaaaacagttgtcttatttatacccagtggccagtggattttacaaggcgtattttgatttcaaagagtctacagtgttaaaccttgagcatggattttttttgtcataaaatatattctaaatagaaccaaaattgtgtgaaaacattttgaactggtatttgtaacttgtctagtttttggtcaaaatctacaacgtttgactttttaaatcaaaatatgccttatagaaatcaacgaggagatacagcattacaattaacatgtggtaatgaggcataccagatctgaccaacgattagggtcccgcatgatgaatggaaatatttctgctggttgcatagtttccgagagcaagaaatgatttacagcatcctcgaaacgcaagtcgaaaaacaacaagaatccaagttgtgcatgcacaaaggaaatcatgtcatttgagatttccccatcggcctcgaactcttgtaacaaagaaatagcttctgcataactctttcttcgtagtagtgccttgatctgttccaccgctgatactttacggtagcaaaatacctggccaagccaataaatgtgtccataagtacagtgtgtgatacaaaatcgacatgataaaatggcgctgcacatttatgagagaatccattgtcagggtttcacttgagcatacaaaatcattgtcttgtcattggaaattgtaattattgagtattactaacaaacacagaacgcagctcagtagctaagcaatccggtagagcagattggaaattttgagtcaagttgcaccgatggatgagttgacatacctacgttaccttataagccgtagcaatcacaactacgtcgctgccaattccggcatcctcgctcgctacaattagtccacctgtaccaggccttgcaaaaggaatagcctgcaaatgtgcgccgttctttcttctgtagacatctaccttggagtccccggcaacaacaacataggggtacacctccgctatacaatccggcgtggtgttaaagacgaagctgcttccaacgggatgccccgatcggtccacgacgaccccgacattgtcgacgagcagcatgacctcgtcgcccccggacaggggcttcaccctgggtggcctggaggactcagggagcgtgaatatatcgccaccttgggcgttcgtggtggagaagagcgagtagcccgaggcagtgccgacgaagacggagtccccgacccaagcgagcgccttgacgccatcgacgagggcgatgtcacgcgtccgcacctgcaactcgtcggcgtcgtgtagggtgaggtcaacgaggagcaacttcttccc

SEQ ID NO: 48174 - DNA, 2161 bp, Oryza sativa
agctggggaagactagagtgatcgatctcttcgagtcgaaggaagaagacgaccaaacaactactagtctcttctctcttgtaacagtgttaactccgattagattagaccaacaagtctaacaacttagttagttggtgactttgttgttggcgagagatatacaactctttatcccgaaattcattcaaatcttcacaattttcactctaaacttctccatttagcatactatctccgtctcaaaataaataaatctattatccgtagtaataaaaaaaatacctgtgcgttgcaacgggtaaaaacattttttatcatgtacattaagctcccttgattttggaccgaatgcttccttgtttttggaccgaacgttcattccttccttccttttcagctgctaccttcactgctcggcatatctctcttcggctcagcccacaagtgaagctgtaggctcagctcaaacagtctcgtgtctggcctacctcttttcagctcaacccacaagtattgttgtaggccctgctcgaacagtctcatgtccgtaccatgacgaagtcgatcctctccatcaaatgcggtcgaatctttctcaatctccaaaattgttgagatattttgatccactcgatcctcttttttgattttttttatcaaaatcgaagtgatcctctttttcgattttttatcaaaatcgaagcaatccataaaactcaggataaaaaatgacgaactgaaaagaaaattctgaactgaaaagaaaattcaaaagaaagtagtggagaatcgatttttgcaattaattggatgaggcaaatcgacgtggcggcggcgctaggcatacatagctgggcaagagtgatcgacacaaatcaaaggaagaagaagaccttctcttctctctctgtaacagtgttaactcccatcaaaggaagagttcaccagcaagtctttgctgttggtgatagacgccactacaactccttaacccgaaatccattcaaatctccaccatttacactctaaacttctccatttagcatattcccttcgtctcttaataaacaaatctaatactatatgagtaatatttgattattttagtacactttggtctaaaatattcgatattcgtgataagattttcaaatttcaaccataaaaaatctctaaatattcagtttaaaggtatacttggcacgggtatttattatcagaaaaactgtaaaagtttaatcagattctgttccaaacattaaatatttttttaccaggatagtccatttacatttcctatcatcaatatagttacctacctatagaaaacttcaccaattaaaccatgtctaattttgagcttattcatcccgctagagatgaagaacaagaaccaataaaccaccgctaagcattatcatcaaaatagacatacccaaggaatgataaaatagaaaagatccataccataccggtatgcttgctactagtagtactttatacaagaagatggagtacattacatacatatagttataggtgccattgattgtacgctaggaaacataatctccattcatatatgctacaaaattattagtaacaaagagatgagatgaccgtaacataacaaatatgccagcattgctgcagctcaaggcgttgtcattcccattggggcagccatattccagtctctacccatcatccagccgctgctcttcatctcctctccagcttctttacagattcggtccagcatggcaaggaactccctcacactgccaaaaactctcgccatgtgcccttcgtcgccgctgctcaattcaccatggaagtactcagtcacctccttcacacaagacaggcagatgctctcttgcgcctggagcttcaggatctcctcctctgcctgcctcaggaacatgctcattgtgttgtggaaccgcctcgcgctgtccgctgaggtcaccatgctgtttagcctcaacacgtcgtggatctttccaagccctacgccgagctctgaaacatctctgctgagcttcatcatatcgaggaatgaagctttcttggtatggctcagctcagccgcaagttttgacacaagcctgaagaccatgttttgtgtattccacatcatactgctgagtagtat

SEQ ID NO: 48175 - DNA, 2099 bp, Oryza sativa
gttcacagattcaaatcatttgtgtaaatattgatatgcataatacccaattgcatatgaaagttttgttttgcttctttcaacaaagggtgcaaaacaatttgtacaaaatattcaaccaagggctcaactatacctcaagagtagcatatgacattctgagctgattgacctccaaatagaagttggcaacatagagcatagcatccattctcttgaacgcaaatggaatatccagcactgcctttagaaaagcttccacagggcaaagtttggtggatagatcatctttgaaatatttcagtttaagctcttcctcattggtgaggaccatttgcatgagcattcgcaaggcttcaactcccaaaccatgtgcattacctatatccagcaaacacaaattaaaccatgtcaactcccaaacggcaggaattaacagtgcaaaccgtacccatattgtattaaggcatagcatgaaaagtgaacaaataatgttatcaggctcaataactgattagctatgatgtttgtaacaacttgaatgcagatctacgttgctgaatcaaaatacagaagcccaccacagggaaacacatagtcaccaaaaaaagtctataccaatatggcaatattggaaaaatgtggccagtactatattgataccagaggatgcaaaatactgaaaacaagtgtttttccccctttacacaaagaggaggcaactacaaagaagagatcagacgatcacaagggaacaaggaaatttcatgtgcacctatgtcaaaagggcgggttgtgaaataaactatttcagtcagctaatcaggccatgtgggacaatcacagggcaagaaacaatcactgaaccaaattgtgcaatataactggtgaaaaggcaaccaaagttgaaaggacagaggcaccatgcatcatctattcatcgttgatggtgggcataataatgcatcgcaaatatggccaatggtaacagccacccattccaaaggcccccacaataggtgaacactagtttcattcagaaagatgacaactttagacagcataattcaagagcacaacattgcgcgccaaatccaattgctaggaagaagcagccacacataccttccaagatggcttcgcgcacttgctccttggaaatacccaatgctcccaccagcattccaatgccatggcacctcggagcgcccagtaagcacacctccctcggcatcgccgccgccatggagttgttcagatataggtggatcatctcatccttcatgctgcaaattaacaggaaaagcaacaggaagccatcaaatcgaaataattcttttaaaaaaaaagttagcaagttgagatcaaaattgagtggttgcattgggggtgcatcttactgcaaagacccgggctttagcttatccgagtgcaaaggccgcgacttgcgcatgctcttctcggacggcgagtgttcctcctcctcttccgaaggaggtgcttgaggcggcatggggacgaaggggttccaggcgtgcgctgccattggctccggaggctgcggcctccgcttggggggcgatggattgggggctcggccacgcggctgcgggatggagggcgggcggagatggacagggctggagccgagcgtgggggaggaggccgacggcgaggaaggggatagcgaggaggaggaggcctcggcggcggcgggtggcgcggtgctggggtcggaggcggagctccgggatgcgaactcgccggaaggtgggccgacgcgtgggagcggcgggagagggcggagctctggcgatcccggacggagatgggaggtggtcgggggcggctgttgcggcggggcggcgagggtgccgaggtagaggaactcggtgctggggttggaggaggaggtgggcattggcggcggcttgaggcggcgtccctcctcatcgccgtctccgtcgtcatcgtggtggtggttggtggctccggaacgggatgagggcgagcgagcgtttgggtgggagtgggaatggtggcggtggcgtaggcggcggaagaggtggagggagaggagggcggagaggaggaggagg

SEQ ID NO: 48176 - DNA, 1486 bp, Oryza sativa
tcggtatcagaggcggtggcggtggcggtatgcgattgtggcgccgaggaggccggggcgcagggggcggaggtggaggggtgggcgtggtgacagtgggggtggggagaggtggaggaggaggagagtcgggagagtggagctgctgcaaggtggtttgggttggggaggaggagcggtggtgggtgttgttgttggggacggagacggcgctgcagtagggtgcaagaagaagaagcagcagcatgagattgagcaaggagaagaagaggggtggggaagacgacggcattgccattgccatcgccatggaggtaggtttgccgttgcaagtgcaaaaacaaaggatgggttttggggaggtttctctactccctcctctcctcacagagactgtgcacaagtgcagtgatgatcctggccctggccagtgtaggggggccagctaagacggtggcaggaacggcagcggcagcatctttgcttggttattggattcttggtgagtgctcctcctcctcccttcctcttgctctgcctgcgcctccgtgtcttgttgtcttgggaatacaattaaagaggtcttctttctcactggtgatggattattaccagtgggaaatgcattttattagccactagtagtagtagcacctccactcttgaaaactggtgtccttttcctgtcagtgttgtctctctttagtttaaataaaatggacaaatgaaaccgaaaatgcaacctgctgtttcttcggctacagctttatttctgaatgagcactactacggctgtgtggatctaaacttcactacttttctatcacatcaacatgtcatacacataacttttcagtcacatcatatctaatttcaaccaaaacccaaactttggatccaactaaacacagcctacatctatttttttttacaaaactcttacaaataataatatcaaccgtttaacttaaatatataaaaattatagataacctgaatgtatttacagcgtgacatgtaaatggcccaagaataatttatattaaaactaatctactaatataatagatttgctgtaagattgttttcgacatgttagcttctccacagtagcataaaaggcggagcgaaccaacaactagggcctgtttggtacagctccaactcctaaatataactctaggagttaagtctggagtggaattgtggagctgtcaaaacccagctccacagctctaatacgttttgtgagagagctctactcctagttttggtagagctgaaattgtttgactgagctccaggagggtggagctggagctggagctgtgccaaacaagcccctactctcattatcttgtggcctggtgcattggcaagccatccttgatcgtatccgtagtggttaggaaagctggtgttgccactcgacatggaagaggaggtcaagcttgtatcgttgcatacctggggctgggactatcat

SEQ ID NO: 48177 - DNA, 9084 bp, Oryza sativa
agggaaatttggtttggactagaaatataatataagctctctatcatagagaaaaaaatattcctttcaaataaggcactgtttagtttcaggggtaaaatgttttggcgtgttacatcgtatatacgaacatacatttgaacatttgaagtattaaacgcagtctaataacaaaacaaattacagattctgcctgtaaactgcgagacgaatttattattaagtctaattaatctgttattagcaaatgcttgctgtagcaccacattgttaaatcatggcgcatttaggcttaaaagattcgtcttgcaatttacatgtggtctatgaaattagtttttttctatatttaatacttcatgcatatgtccaaatattcgatgtgacagggtgaaaaatttttgttagggactaaacagggcctgtataggagtactccctccgtcccataaaaatccaacctagtattggatgtgacatatcctaatactacgaatttggacatacaatcctagattcgtttttttgatagagggagtactcccttcatcctctaatataatggattttgatattttgtttgcactgcttgaccacttatcttatttgaaaaagttgtgtaaatataaaaaacgaaaagttgtgtttaaagtacttttgataataaagtaagtcacaaataaaataaataataattctattttttttaataagatgaatgattaaacaattcaagtgaaatgttaaaatttgttatattagaggacggatggactactccctccgtcaaaaaagacaaaccacgagtttccgtgtccaactttgactgtccgtcttatatgaaatttttttataattcgtattttcattgttgttagatgataaaacatgattaatattttatgtgtgacttatctttttaatttttttcataatttttttaaataagatgaacggtcaaacgttaagcacggaaaccagggtttgtcttttttccttttttttttttttttttcggagggagtagttacgaaggggcacagggaaatcatcaaagatggggaaattgtactcgtagctctgtaagggctggatcacgagctgcataggaatgtggtggtactagcgcaaaagcagggatggtagtggggtgcaacgtgcacggctgcacgcaccaaaaaaatgtgtacgcacatcacctcaccagcgtactgtatggagtacagtaacagcacgcaagcacacgcacacggagacacgagtcgcagagataggcttttggcgggaagcgggcctctgccattccctcccgccatcttctacatcctgctctcctgtggccttctccttcctccatcgccatggttggactggatcactggaaattggatgctaaagctttgtttgcttccaacgacatgcatccaaaagaaagggcgcctgcttcccggcctcttgttctgcttgcttgcctgccactgtgccactgccgaccaatctcctctcttcttttcttgtgatatattcctatataaagtgttactttttgttctatttgtcaatgaactatatattgtgtgattattactgctctccattactaatattcaaacaagaggagaaaattaatgttcaacaaactcgtcacaaattaagtttgttatgtttgtccgcccctctgcctgtcgggatgggatgcatatggatggagtatgaacaaacctgatctgaagtagtatagttggcaaagtcggtgagatttgagacaagggtcaacaaagtacttgaggtcgttgcatgcgttgatgagtcgtattaacgatcacttcttctctttatttattgatgaagcctgctatcttttgcaggaagccggtcggttatccgccgccgaggatgaagagctgttgaggaggctgcgactgctgcggccattccgccgccactggaaaaaagatggacgacgacgaccatgaccaccacggcaacggcaacacccccttctccttggccttggcgcgctcctgcggtgaagttcatctcatcgggccggcttgcagtttagcccagcccagcaaggcccattggcccactgggagtgggaggaacaggaaaccgacctcctcatcctcgaagacgaagacctctctctctcgctcgcctggcgccgccttcctccaccccactctctcctcctccgccgccgcatcctcaccaacccccaacagccctccctccctcctcgccaaaggtaaaaaaaaaacttagccggatctctcatctggagacttgctcatccttatctatcttttggggatttcttcatctcattctcatgcatggtgtaggccaaagtttattgcgatggatctgatgtttgcttacatcctttcctagtcaatttcctactctgcctaggagtatattagagcgagggagtctttttacaaaccaactctgaatctgaacaaaaaaaaacaatacagagacctgtctgtgccgataatatgaaaatctttgctttctacacaattactgcctttggtttttgggtaccactataaatccagtataaaaggagctctgagatatttatgattttagtgtactaacatcatcagtagctgaaacaggtgatgatgagtttctacgctctaatactaaggcccttcactctgaatatgatagcttattttttattttagggagatcaaatactctccctaaacagtaaacacccgaaattactagtctagccaaactccaaccatcaaacctagtttaaatctctaatctttctttggtctaaaattattaatctctcaaaatttactgctgtgaggtaagtcttttccttttccatgtccaaatcaatctaggctatgttctggtatggttcaatcccctccccactgctaagtaagctaatgttatgctctcgaacttgccattgccagctgcacttgtagcagatgggttctgtccaggattgatattctagcactgactagctcgagtgttttctagtataatcggaacttgtattacaaattcccacttttagttatactgtgatttaaagacaaacactagtttaggtggtgtttggatccagggacttaactttagtctctgtatttagacactaatttaaagtattaaatatagactacttacaaaactaattacataaataaatgctaatttgcgagacaaattttttaagcctaattaattcataattagagaatgtttactgtagcatcacataggctaattatggattaattaggctcaatagattcgtctcgtgaattagtccaagattatggatgggttttattaatagtctacgtttaatatttataattagtgtccaaacatccgatgtgatagggacttaaaagttttagtcgcatctaaacagggtcttagtcttgaggctacatcagcaaaccatatctatcttcagtttaaattcatatatcccatatagctctgtgccttggctaaaggtcaactggcatcagtgtggcaccacttcttcctgtttctgtaacattctcttcttcagtttctgcaacaaccggtgcaaactaaagatggcgggattcggcagcctggcacccaagaccaagaactttgtggtggctggaggactgtctgctttcgtcctcggcgtgtattactacaccatgagagcggtgggaggcacagatgagctgcaggtcgccattgataagtttgaagacatgaagaaaaatgatgctgggaactcatccaccgcgggatcctaagaacagggtttagaattggctccatgtccgcctctatactgaactgatgacacttggttttgatcctaagaacatggtttagaattggctccatgtccgcctctagccctctatactgaaccgatgacacttggttttgtacaataatggctcgatactaggttttgcttatgctttgatgataggctggaataatttttgactgaatgatggctgcagagttggattgcagttttaattttctgaaagttcatataacagtatgatgacctgtgtaacttgaaggtttctatttgtgtgtgggtatgcaaaagacaacaaaagtgtagcaatgttatgggactattatcacgttagattccccctcttgtatgatgtatcaatcacctttttattgagtagcccaacgacatatagcagttcacatgttcacatttatttcttaaaggatgaaataatatatttgtaaccggacacaaaagaatgggttgtttggttcatgtgctatgagaggacaagcgtatactaatatcctcttctggaaggaggaagaagaagatgacaaggtccttctcctccaagaagctgtagtattattcaggtttaaggtactgatctaatgaagacaatctatcatcaaattgagctttgatctggtattgccaatgccatattattattccgaggactttgtagtttgacctacaatatgctttacaataatccaatgtactactccatttaaaaaaaaaacctaatatagtattcagattcatggtactctagtactatatttgttttcctttcgaatgaagggagtattattatttgcccttatcaaattaccaaaatgcctctaaacttatcctaaggccttctttggttaatcccatcgggattaaggtgcggaattaatcctactcaatcccttctaatccctgtctcacgcggaataatagaacagtctagagtgagtaaccaaaggtgcttggacatgaataaaaggatagtaaaaaaaaactatcaactatgaaaataacacacgtgatcttttctgcttattcaacgtattattgacgtggattatttgctctatacttctaaaattacgggctcaaacaatgttcttatagtacattgcatatacaaacttaggccatgtttagttcccacgaaaaacttttcaccatatcacatcaaatgtttagacatatgtatggagtattaaatatagacaaaaaaaattaattacacagattgcgtgtaaaatgcgagatgaatctttaaagcctaattgggccatgatttgacaaatatggtgctacagtaaacatttgctaatgatggattaattaggcttaataaatttgtctcgtagtttacatgcggaatatgtaatttattttgttattagactacgtttaatagttcaaatgtgtatccatatatctgatgtgacacgctaaaaattttcacccccttgaagtacacagggccttatactatattcccctacatttctccctcacacacgggagtagttgattcgaccctttttttcttgtgatgcgtattcgttgctgaccatatatatcatgtaagtcaggctcttctagtgtggctacgagctgagtccgacttgagtttattcttgggctattcctcgactctaggttgggtgagagacttgtttgtcacgagatgagatggaagtagcactaatctttggctaagaacaagtttgagttggacttatcacgcaatcacactagatgagcacgatctagcttgggaatgagcaattttcaaagcgacagtgttggtttttgcaatataaataggtttcgaggtagaatatcaaaacaaggatgattaaagttgaggcagtttatgcaattttgtgataaaaaggaaatgggacggattaaaaaaacgtagtggcagtgtcgtaaaaaaaataggattagaggggagcgtgggaaaaaagaaaacgggtaatatactgtctaacttcaacaggtgaccgtctcagattgagatctccccttggcctccctgccccgttaataattacagtattctattctctctctagcaaacaagtaggagtaattttcctctttctttattctactagtctagggaaaaaaaaaaagtagtcgatcgatcgatcgagaggtttaatctgtcctccctctcgccggtcgccgccctcgtccccgccgccgccgccgccgttagattgaagcagagctacaggcaggaggggcttctcctcgcgcgccgccatggtgcttggcaacgtcgccatcctcgtcggctccggtgagtcactttccgccgtctgctccctcctgaggtccacccgcagccctagctagcttctcgtcgcccagcccagccggttgactttcgacttggagattgatagatagataggagtagatgccacttgcaaccatggcgcagtcatagatagattaccaaaccaatccctcccacttctagggaataccactaccaaatcccaacttatttgctcatcttgtacggagtattttgctttaccagattccaatacatagattgatctagccttttagggccggggccggggtttgtttagttcaactaagctttcgcttcaaaccagaggggaacttattacctgggtatcccactgctacatgaaacaccactgtcaaatcccccccaacttagtggcttccccagtacataggctgatcctgcctttctttttatcttaagtataattacgccttcactaaataactatactagttttactcggtaccaatgtttatgttgtttgcttgcctgcaggaattcttggatcagttcttgtaggtggtgatgccaaactccctagtgccggggaggtactttctggtgctgccaaggtattgtattattgcccctccatgccctaactatcaacccagaatactactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacaggagatacaatctctaggatcaaggcctgttacagttgtcaccaatgctgctagatcaggtaagttcctgctgactagttactatgttttagttacagacttatgcatgggtcacagatcatacaaacataaatttcacatgacactagactttgtgtatgccccgatgtcgacatctcttgctaagaattaatgcgattttagagtgttagatatttctattacctttcgatttttttttcagacttggtctgttgtttttatatctacatgttcgacagagctacaattgcgttgtctgttcatatacagagtataccattttgcgattcagttcacatgttcttttctttttctttccttattattatttgtcatggtcttggctatgcactactgattatcattatattattcgctgcattataaaggttcttggacacgtgatagtttttataattgctaataaactttcatcatgctcttttgcctttaaacatacacaattacatatgtttgcccctctaggttacacacattctttctcaaatgtccttgaacgacattcatgtaaatccttcttctgtaggacctggtacatttactataacagcggtggttgttgctggggctgttggctacgcctacattaagtggaaggtaatgtttgattctttcacctcaatggaagtacagaatgaggaggacataatctttgattattctagttgctatcttgatgtttattgttctgtccgtcattctagatcatggacgcaagtgcatattattacaatcctatctgcttgccatttcttgtttcactgttctagctagtttctaaagttacatagatttgcagggctggaaactttctgatttgatgtttgtcacgaagcgtggcttatctgatgcttgcaatgtagttggcagccaattggacaaggtttcagatgatgtcactgtaagtttttaacttctttcagcaacgctgaactcaaatgtgttacttgtgattccatgttttcattgttccaaccaaaacatcttactggcctttgattttcactattcagtctgcaaggaaacatctcgctggaaggattgatcgtgtggatatcagtttagatgaaacacaagaaattattgaagggacaagggatgaggttggaactgtttttccttttattttttgtgtttacttttatagtttttgatgcattttcggcgacctaatggcatttcatgactgacttgtaggtcacagtcatccatggggatctgagtgctttccaagaggatttacaatcagttaaccttgtagttcggagtctggtatgtgcctcgtaccggaacagattctaccttatttactgaatatccagatttctaccttatttactgaatattactcgtgtacattttttgtatcttgtatcatgcaggaatcaaagcttgtgagtctggaatacacccaggtgagtagaaagctcatgtttttttttttaggaaaagtagaagctcatgttaccactacatattaccaacaaactcatcgacatgctcctaatgctatcttcttaaaatccttttaggatcatacggctaatggaatatctgacttggttgagttcacccagaaagccactattcgccaggcaagtttgaatggtctagtgattccttaatgccatgcttcttctatgctttatttaacaaaaccagttgcacctcaactataagcatattcttttcctatatgcttattctgaagagatgtttttattttcaggtcccagcagcatccgttcctccagctattggatcttcagagcgagttgttaggagggtaaaggcttgcacttttcccagctttgtcatggtcggaacatgccccagtttgttgacttgggttcatgtgtttctggttgcaggtttcttcgttgcctcaatctactgctcttccagctctgccgacaaccgcacctgcagctgaaccatcacctagggcagaggtgccacaggtgtggtttcagtttgatgttgcactttgttgcatgcaatttcagtttcctcttgcgctttccatgattgaaacgagctattgctggacttttgcaggaggaacagtggggttttgtgagcaaagcatcatctagtaggg

SEQ ID NO: 48178 - DNA, 860 bp, Oryza sativa
aaaaaaatatgaaagaaaacaaacttacaaaacagcagccgcctgatatgatttgatgagaaagagaaggaagaaaaagaaagccgaagatatgggccgtgtttatatgggcccaagccctaagaggagagtctaggcgacgggacgggaggcttcctcctcctcctcctactcgagactcgacgccgccacctccacctcccgtctcgtctccagaagcttctggaacacccttccggcttcaattcccccctgctcgggtcgggtagctcccttccatcatccatggccgacgccaccgccgccctctcaggtacagtaccatcttccaactcaactgttgacctagtactagtactgaggtctgaggtctgaggtcgcttcgaattcattggctgcagctcggagcaaggtgcaagctttcctcgaagcggctcgtgccggtgatctcgactccctcaagagtaggtgcccccatgccttcctctctctctcctttgctttccttgcgtttcttctcatctcctctcctcatgcgccattgcagagctcgctgcggcgctcgacgaggagggcaagggcgtcgccgccgtcgctgctgccgtcaaggacgccaacaagcgcaccgccctgcacttcgccgcccgcgagggccgcacccacgtctgtcacttcctcatctccgacctcgccctccccgtcgaccccaaggacgacgatggtactactaactatcactatctcttactctcatctgatttcttcacaatctctcatccatcagtttacatccactccaccaggtgaaactccactcatccatgctacgcgccaagcccatctccaaactgtaacctatc

SEQ ID NO: 48179 - DNA, 3078 bp, Oryza sativa
taacaaaacatacccattacaaagagaaattgtcaagtcaatcttgccttcaggttcgacaagtgagtggtgaattcaatttcaccagtaaatgttggtgctcctggattcccaacccacagaaatctgtgctttaataggctactacagaatactaatgtactccactttatttactgcagcattgacatgcataagtcatcgctccctccaagaggagaaatccagagttcagacagagcctccaagaagcttgaaaatgtttaacttccagcaatatctaaatgttccagtgccagcttgatcgtagggaacgcatgcaccatcgcgcaaagccccaaactcacacgaagaaccaaagcttgacaacaaaaacagcagcagcaaagacaaaaagacacaaaatcagcgataaaaagggacgagacggaaagatttacctaccaggatcaccacaccattccattccatgccctgccatgccaagagttttaattgcggataggggaacctgagctgctgctactacggctgtagctagaggcacttcttcctcttaaaggcctaccaccattgaaaagaaaccatatgatgcttcaatgttctatttttacgatgccacacatttaagctgcttgagaagggaaaggcacataaggattactaccttctaggactgcgacttctgagcacccttcttggtccctgcacaagagaaaaatgtttgtcttggtacaagaagaataaatacacagacaaaaaaacatttctttctcttcttccaaaaaagataatgacatttatagttatgagtttacccttcttggaggagtaggtgaatcagaatacgatgaggatgaccgtccacggcgcacaggaggaccccgacccctggttccattatttgatgtaagctttcatctggtagaagatgcaaggccactaatctaaaacggggtaaaagggcgatcaatcctaacattacctgcgtggagaaatcgatctggaaggggagcgaattggtcggtgaatgggagatctactgcgatggcgaagtgactgtggtcttctgggaggactccacatcctccttggaggagtcctgcagaaataattaatggtcaatggaataacaaaatcccaaaattagtttactaggcaagaaaaggggggggggggaagcctccaggggagaacaaacacctctttcagagttattagaagctagagaaagcaaaatcttggcccagaagcatagaataaactaatcagattttcagctcaacactctgattatccactctaaaatgttcaaaaaaagctaagtagagcaaccatccaagaaacccagcatggtttagcttcttcgtaacagaacagtagaagctagaccactacagactgaaatgaataaagagcaaatagctgtgcaacttaaaaaagatatacacaaaactcatatgccccccaccttctcctaaattcataattcagataacatatgaaatactaaagaaaaaaacatcaactagacaagcttaaaatacttacagccttctacgaggcaatggggagcgcctgcggattggactgccccgatctcttcttggtgataggctgttgttattatgaaatatttcagcacttccaaacaaaatgctgataacaaagagagcgcacagacgcattactcactgccttggtgatcttagtcttcgagggggcggagagggtgagcgccttctgattggggatcctggtctcctgctaggagttccaccatgcctgattggagaaggagctgttcgacggcgaattggaggagaatcaggcctacacctaggtgattcaactcttcgacttggaggagatcgccttcttggagatggagctggctttctttgaggagatgctgctgaaaggaaacaagtgaggtttcaaagttcaaacactatgttttaccacccagtaaaaatacaaagactggttatggttcaaaatcaaagtggcaaacaaaattgaaggcaaggtgactagcaaaaataacaaaaaattgatgctggtccagagaaagagtagcttgaagaaggttacataagaaggagcaaaatcttacgtttcctgggctgctgtttggtggccttttcagcactaggaccaactttattatgatcaaccacatccctttttggtgaagggtgaagagcttttggagaagcagcagctctttgctgctgtggtggaagcgcgaatctgactttaacaacatttccatcaatttggccctgtgaagatttgtaagtattttaagttttaatgctatgttcatactaaaattccaaatgaatgttgcaggaaagaattcatgtactcttccattatctaaaaaaaaagaggaaagaattcatacaccatccaagtaaagaagagccttctcagcatcagctctattcttgaactcaacatatccatacccacggggaagattgacctgaatcaaagtaaatgatgagtatataaagatgagacaagagtgatgaaagttttcccccctgccttgtgcattactgaacccatttacttaccaccctatccatggagagctccacattgacgacttcaccataattttctgcaaaacagcagaagtatgagctaaagaagcagcaatgttgttgagtgcaattcagctctattacatcaggaaccgttcctattatgtgaaaagtgaaaattagaagactaatagccccaggatcccagggctctcagccatggtcttggaacatcagttggttatgattttatctactttaaaatgttgagtaaaatgaactccagcgtagacgcgagcgttgatcttgccaaggaaaaatgtgtaaagattcaggtttttgagccaaaaactgagaagatgataacctgcatacaacagcaacaacatactcggtgtacaaagcctgagaaataacagtggagggagaaggatttaggaaggaaggaaggaaaactgaccaaaaatctccttgagatgatcctcattgacgttcctggagagatggtcaacatggaggacgg

SEQ ID NO: 48180 - DNA, 3493 bp, Oryza sativa
acgactttctttatgagtatggagggagtacatgtttaaactcaatctaaagtagaataaattaaacatgtggtattattcttatttctttttagccccatccctggggaaacgtagaaggcgtgccccatcgcttttgtttgggtttgagttggacttgtcttatccatttttgcctttccacccaattttatttttctcattgaggtgtcaaatgtgtttggttggctggtttcaacttgtacgggtcccaattgatctccatctcgttatcatcgtcttatacagtggtattatactagtagtagtagcagcagttgaaaaggtgggtgaatcaattcgatcaatcttaccactactacagaaaaaagatcgaggcatctctccttttcttaaagttttctcttaggcactttgaaaaatgcatttgtcatctgtcagtaaaaaagtcaagacaagctcacctgtgccgtctatttgtcgctttttcatatttactttttgtatgtatgtattgtacacgttttttttccagtcctaaaaggagttgaaacttaatattgaacctgatttcttcaactgtatattgtcccctcttttccagaatttagaccacgtaaaatgtcttctttgaatagatgtcattatcatcatctcatgataatcattatggcattccaaaataaataatgcactcctatgaataaaatggagtgatattctctccgttttctaatatatggtgttgttaacttttggacatacgatttgatctttgtcttattaaaaatctagtataaatgtgaaagtcatttttaaaatatctttagtgacaaaacaaatcataataaatatatgatacttacatagagtactttataagacaaatgatcaaacatataactaaaagtaaacggcatcatatattgaaaaatagaaagagtagtaattatctgcacaatcgaataaccggaggacaatgccattttaggcaatctgttaatcccagcacaaatgtctaatgtgacttatttttcagagacatggatttcgtatgtatttttggacaaaagactcaaattagacatgtaattttaccctataccatatacttttactccaaagtataccctgtattcagatttaagtacacagctcgacctgacatatatttatctgagtttggatctcaagcagggtgcaaatacacaagttctttttgcaacagttcacatacagtacacaagcttgcactccatctaatctatagctaagaaattaccactagataattacatcagaacaagcttaaccataatgatactggcatgcaagtgcagggtgtctgtattgttcttgtcaattaatttgttctatctttcacctctctgctccggtgtgagcccttccttgccacagctaggacagctcttgagcccaaacccttggcaatcgaagcacctgaacacataataatcacacaacataaatactacatggttggttaatactacttcatttgctagttgatataaagacataagaaatgtaagagtaaacatatagcagaagcatgagtcatgaatggtgtataaataaacctacttccatctctcgaatatgttgccattcttcttgttccttccagtgccctgcatcagttgatcatttcagtcatcgaatcaaggcattcatacctagctcacttgtttgctttaatttgcagagatcatatatacttaccttgcaacctgggcattctacagctccctttcctctgcacgtcttgcaaccggcagagacctgcagtgcacaatacagctcattcagattcagagaacatgtagtgccagctgcttcccaaaaattgaagaaaagttaggagcaaatgtaattagaagctagtactgatcttcagtaagaccttcactttggctccaggtttggatgccatggttggtgccatcctcatcctcctcttgatcttgggtgaagtgaatgctgctgctgcaccagttgctgtgaaggtgatcagagaaagctccatgatgctatattgctatctatgctcctgaagctgaattcagagtggcaagaagaagatggagcccaaatagttaagcctaggaagaaagacagaacagggaaagaagaaagaaagaaagaaagcgacttgccgtttgaaggatttggagccacaaaacatccatagatgcaccagtattattaattctgtaccagattttgatgcatggtccatgtgttgtgaggcgttgtggccatatagtctggatagggatgcggctgcttggcccggatgggatcatcagccatctacagattcaggttccttgtatgcatgtgagtgtgctgctaagagccaagtggcactgatgagtgatggctcctagctctgaattgggcatctccatatatataactgcactgatgtactctacctgtcattgctggctctgcctctgcatgatgtatgtaaattcatgttgatgagtttttgattcagaaattcagttagccagcactgataattagctcaagaagtataacaaattcagcacttgtttcctttgagacttgagggctagcttcagcacctgcaggattgataatttatcagttgatattattaagtgtttacctcattagcttttaaaaggaggaaactggtttcatgtagttaaaaatcctacagattaatgtatttcaaggacaccaaaatctgctcctagaatatctgacaagaactccaatgtcagctagatcataacatgttagtaaaagcatccatatacaagcatcaattttttttctcggtgatcatattaagagttctgaacaatcgggttaacaagtagttcagtagcacacaaccaagcccgtcacatggaaaacatgttgcgacctcagctaagcaaacttataagtttaaaatcgcttataattgttaaaaattgcctatgactgttagattgtaaaatactatattttacacatgccacaaaaaggcgtaggttaactagctcactcaagtcttacttaacacggtatggctaattattctttacgtggtacacaacaaacccgtcaacattaaggttctcatgatgacttcgtcaataccaatatatgcccatttagtttttcagagaatgtatgtgcgcaagcgtctaaatttgtaatgtgtttatataaaaagtaacttctttttcacacaagagcaaattctaattaaaaaaaactagactgttacaggagctgtgtttagttccacgctaaaattgaaagtttgaagaaattggaacgatgtgacggaaaagttaaaagtttgaagaaaaaagttgaaatctaaacaagaccagagattgaaatgaaacctagaacaggataaggatacgagagttgaaccgaaaaataaaaaagaaaaatcagactcacctcacaagcttgatctgagccgtcggtatacaagatc

SEQ ID NO: 48181 - DNA, 5981 bp, Oryza sativa
agagagagagagagagagagagagattgcaagggaagggaagggaggaagcggaagaagctttttttacccttcccacgagcattcaggggagagggtacgtgcaggagccaaggtccaacaaagcgatacctccttctcctcctcctcctcatcctcgtcatcagattcgccgcacgcgcacggtgaactcctccttccttcctgcatttcgattccctcttctttatcgcattatttcctgccctccattcttctatttcatgccctttctttctttctttctttctttctaataatcgatggcaagatcgatcaacctgttcgtggttttgggtaccactgccgatttcccccacaattccggggtaaaagaaccattttttggggggttattttttgggttaaagattccctttttgtatcacactgggggccataactgtgtgcaagtgctcacctgattttaactggtgaggtttgatcacctataagaccattttaatcgtttggatttagggcgtaatcggacaatgttgccttgttcagagataaaatttgtatcttttgtggttgagcgttgatttaccgaggggactgagttgtataacttttccatcctttttctgccctcgttatgttttgatcagattgattatgtaacggtggtctattgccctatcaacaatctcatttaaacgagcaaataaaagttcaatcaattatggcaatcagttacatatctgctgctgggagaagtaagggttgtaaccctttgtgggaaatggctgactattcataactattatgattatcaaattgttcattcgtctttctgttctccctgcctcactcactggtggcctggtggagtgaatgagtgagggtttactgccaatggtacatttcctttttccatgtaataatcccacattatcacccatttgaacagaaaaatacatataggaactctgctccagctagtcctccgcagaggataagtaaagggagaatttctcataacatatagctgatgcaaggattttgttcaaagtcaccttgtcaaaccatttttcacaatctagagaatatattgtttggttatttaaacatggctttcttgataaatatttgatgaaatgtcgcattgaattttgatccgtctaggcaaatgagtattcaagattgatctctctttaaaggctagcttatatatacatatatattctgcctgatgatcttttatttattttccctgatgactgattgatgtcggattatatctacagaagcagcgattgcataaaatgtgcatgcagctgcttccatgtgaaattctaagagaaatatgatcaccctctgcaataatcttactgcaacctatcttctgctgatgagtttgaagatgctttgccgtagttgttcgccagttgcaatatttgaataataataacagcaagaaataaccatcttattatcagttcttttcttccatttacatacttctattgtgattgacagatgcaggaagaattcgattggccaaccttagtgttatcaacatcaccagaaacagaaaatgttacctccagctctgtgagaagcacaaccaagaatgacgtggttattcagcaaggttccatctcttcatactggccatgtatgcatccggcagtttccaaataaatatattctagttgaggctgttttttgtacaccttgttttattctgtgaaaatctctgtctcattctgcaggggatgtcatgaaacttgaaaacgacacccattttctgtctcattcttcaggagatgggatgaaatgcacaaaggctgaccattttctatctcatgcaaacaggggttcattgaacttggtatggtacaaaactatctgttctactatcgttgatgggaacatttgaagggacatattgctgaaacataaatactgggatgggaatgggtcacagggtaaatatatggatacctatttgatccacactagttcaactaaatacacaacataaactagaaaaaaaaaagcaattttagttgatcagcttgcttgaattagagtggctcaatgggcacccatatattgacccactcccatccctaataaagaagttttgtaggtaaagaaataacaccctaatatactgtactaatcactcaatcagttcagcaattgatatagaatttcaagttgtttgcattatttcaaaattttagttcagttgaagttaacaataaaagcaaggaccaaactgtagccaagttggttggttggtcatgcaggtgtgcataccacccacctaggttaaatcttactccctctgtttttttatagatgatgccgttgacttttgacatgatgtttgaccgtttgtcctattcaaaaattttatataaatgtcagttattttgttgtgacatgttttctcattaaaaaactttaagaatgacttgtactttagcatatttacactatttttttggaataagacgagtcaatggcgtcatctattaaaaaatggaggtagtagatcaaaggcagggaggcaaagcagcaattatattcctttaattaattaggagtagctgctggatttttagccacacttcagagtttcacttgatttgaaacatgcccctttattcatcactattttttgaccaaaggctagaattgctctgcttctcattagaatcaatgtatatttacagtgagtgatgcaagttgtgaaaaatctttcctttgttagtagctgtaatcaatatattatagtaaataaaaccatcatccaggttcaatgtggtaattcaattgtgtttcaatgttaatatgcaatttatggataacatgcactgcattgaaacgtaaagctttgttcatcaggtgaccccttttttctttttgttttgttttgaaacaactcccttctcaggattatcaagaacaaccttcaaagtccaattttgctactgaccttggatcacatgcatattctaaggaagccaggacacttggaagagtatatcatgggcagcagccttacttttccccttcaagctgttcttgggaaaaatcttctgcattaaaagtagtgccaaatagtccagatgcatcagggcatatagtcggggaaatgagaaccaaaaccaacatcctcagtgcaaggtcaaattacctttcatatcctactgatgttcctcatataaggtatcgagatgaagttaaagttgatcttagccaagatgataattccaaacagtacagaagacctgatcaatttactgccttctcaaacttcaatggtcaatcttctgaacaccttgaggtacatctgttgattgtgttaatcataatagagttgttacttctatatacatctctctatctggcatcagtagaaaataattaagatcatttgaattcgggagtatttgaccgtgacaatttttttgttgaaacagacagccaaaggggcaaactacatggatgagatcactccaatttcacgtcaatggtgctttgataatagaggcccatcactaccaagagggctggtctatggtgatgagataccatcgctatcttctaagaagtgtaatggcaatgttgcatcatcatattcaagaatatgggattatagtgctgaaaccacatcagtcagacaatgctatggcgataaaatcccatcattgtctcaccattggcactaccgagataagatccccttgcattctggtcagtggtgccatgatgctgaggcacgcccattgtcgaactaccagcaaggtgcttcttatgggaatggtcgtttaagagataatatttccaggggtggtaggaatgagcaagtcaacattatctcaagcagacgtactatgacaaaacctagggtggctaacaaggttgtaagcagcaccgatcactacaagattaataaggataacctatggagaaattctgaggatataagggatcaagttcgtggcccccgggcaaataaattaaataattcttcaacatcatctatcaagaataatgccatccctcctttggtctgtagagatcaaattaatagaccagagttcacagttcagtatgagcatgcaaagttctttatgataaagtcatatagcgaagatgatgttcataaaggtatcaaatacaatgtttgggcaagcactccaaatggtaacaataagctggatgctgcttttcatgaagctcagattttaatgaaggagcagggcaaaaggtgccctatattcctattcttttcggtcagtaaggatgaaattctcttcttctaagtatcatccttattaagaaaaagtccacctaaaataaccctgagatatattatttggcgtcctagtacctgttgtgtttgatgcttaaatatgatagttaagtgagacatgccggtgctttttttagtgcatgtttgtttgtgtttagtttattgtcttctatttaggaaattgagatgattggctgttgtatcttcactcttcacttgcggacattttatgattttagttttcatcgtgaatgagtattcttaagaaaactatagtgattgatagccatggatccagcttctacagacaacctgctccagattttctttttgacttggttaattatttcaacaatacattgaatttcctttgagcttgtttgattaggagggattagattctgatatctttgtattgttaagatttcagtagaattacttgctcagtcataatccccaccgtctgaaagagctgattttacctgaaatattggtcacaatgtcctgccattagattgagtaatgggcttctctagaagatttgatccactggataccattcaccaaatatgcctgaagcattttttgtcttctttaagtccgttttatcatgtgacaaccaaaagctcttgaagcagctccatatctcgtctgttgtatggctatttttatcatatggttactacatgtgcctgaagcaattccttattatctgttttatgttttatcatctgtccaattttcaagatagttaattttattatgatccctttttttccaggttaataccagtgggcagtttgtaggattagctgagatgttaggtcctgttgatttcaagaagaccatggacttttggcagcaggataaatggaatggatttttccctgtaatgtggcacattataaaggacattccaaatcggttcttcaaacatataactcttgaaaataatgaaggcaaagtagttacttttagcagggacactcaggaggtaccatgcttgtagctttgttctgagacttttttttttgaaagggttcttatagttagaaatggaatactctcttttataatttgtttagtcgtagtctcttttatattggtacaatcaagaacatagaaactaaaaagtattccatatctttgaaaatgaaatggacacttaactattttaaattaggtgtctatatcaggttgccaggttttatttccagtcctctgaagaaaggtttccctttcagattatgaatattctacatgatgtcaaatgctgttattccatgctttgattttttttatccatttgtattgttgattcgtttttatccagcaaccttttgtccttctatgtagattgggctgccccagggtctggaaatgttgaagattttcaaggcatatcaccagggaacatcaattctggatgatttttatttttacgaagaaaaggaaaacatgcgccatgcccagaagggaagaaatttggaaacaaccaatcaagatttgttctctgatgacttcagatcaatatcagtggtatgtgctttctatttagatctttgttttgaatggctacttgataataattttaagacaagatgatacttttgttatgtaaatatatttacgaacaccatgggcattttgtgaacactgattgtggt

SEQ ID NO: 48182 - DNA, 3140 bp, Oryza sativa
atattgtgccggtttctgccacacatggtccgttgttgggctcattgctgcaaaaccaaaccattgtagcatgtattgtgaaatatcttctgatgtagatggcaactggagctaaagatcttgagagtttatgggtcaggaactcgggatagtttagatctctagtgtcctttggtcacttttttcttctgtggcgtgtctgttttaatggaatgtaggttgtgatgtactgtttgtttaatggaatgacacgcagctctcctgtacgttcgagaaaaaaagttagtcttctgatcctgcttatttccatttgtaggagaatttggaggccagcatgcagagcttgagtttctatgaaacttgggagtaatttagattgttctagtgtgcatccaaaatcagtaagttgacgagtcagtgaagcagctcaaggcttgaccctcctttgcaaaattgggttgatccaacgacgggataatacacagatgaatccaaacaattttaatgattatatatatatatagtattttgtgtagaaccacgtatgattgtgggtaaccttagaacaagatttgaacacactgaatgtttgtaatagttacttatctggtggctacagtgactttccatagactagatgaatttgacgaaactggcaagaacaaagcacaagtctgtaggcaataatgccatattatctgcgtgaacaatcatgttgatgaatgtgcatctcttctgatgtgtatgtgatgtcggtttccttcctgttgacatgagcgttaatgttaactaatgtactctgatcaccacgttgttcgttggtgttgatgacacagctacaagtttccatccacagagatactaccatgagattgtaccatagcccataggctttctgtgatcatcaattgaggagcaaaaacataatctagagacagtaaagaaaggtttgttgcagatttcctaggaagcattttgaattgcttgccatgaaccacaaatccacaattaaacgcaaattagcaaatgaatgctctctcaatgaggtaccatggctgtgaagagcgaaacactaaaccaggtcgacgagaaggcttcagttttgactcaaatttagaaggaaatataacccaggcagacgcctgaatgcaatacgctgaatcatcatatatgcctctgaagatagattttgttcatacaggcgtccaggatggcccagcaaaatgttggcagggaccaatctcaatctgaggacatgacaaattataattgatatatacagcttcagaagcgttgtattggacagatcactctccacatcacggctacactaatttgatcggcgtccttggactcgacggaacgccgccaaacctgtcgaccataagcttgaaacaaggggtgaaaaccatgtacagcgcagcaagtgcgaacggtgcagcgatcagccacccgagcatctgtgatccgcattggcagtagaactcatgtcagtgtttcctcaaaggcaaagcaatggccatatcatcagctagatggataatagatgaagtttgtttactaaccgcatgcacaatgctgagcatcacatcctttgaggcctggccagtgataaccttcttgaatgcatctgaagtcaaagggaagtgtccactgcctgtgataacttctccgaaacgcaagaaagggacaatcaagctgaacaaaacataatcagtaatgaattagcaaagccaaacacatggaaaccaagtgaggaatctggcaaaatgacaaggtcaccagcagtggtaaatcaattcaaaggttgtcatgggtcataaatctacactgttgcactaggtaccgttagtcatttacagagaaaatatacatataaatgaaagtgcaaaggcaaagacctgaagtaaagcagttcatggatacatcagaaattgtaacatatccaaatattcatacagaaggcatcagatgcaagcaatgagcaacagcaaatgcatttacaaaagccataaatagctaataagaacacaaaaatggatttgggagtgtatgcacatgaggattataatatgtaaagatgcaaactgtaagcaagataataccagagtaccaaacaggggaactcaggctacacaaactcaaaagaaatcagatagcctggcctatcatagattcgtatcatagagcaaagcttgacatagaagatcaagcatctacagacgtctaagactattttatgatgcaaaagaccaccatactgttatgaacaaagtttggcgtatatacaaaagaacatgcaaagagatagcacaacaggaatgtggcttctcaataatttaatacaagtttaccttagctcaaggggagtaacaacgaaatttagaaccatgacagtaacagcattgcagctacttcccaacattgctattgcaactccacaaagaataacagtggtccctgcaatcatgaaagctcaagatgcatcatgttgttttgaggaatatatgacatgcttgccactttaccagtagctcagcaggcacgatgcttacaagttacaacttcatgccacacagtgaaaagtgttgacagtttcacttgcaggattatacacagacatgattgagcatcatcaccacagaaatattgtgaaactttttaactcggtagctactccacatcatatttacaagtgctcgagaatataaaacggatcctccaaacttctaagataacaaccagaattaatctttctagaaccagaacactattaccattgcatcgcaacaacactgaacttcgaatttcacaacagattaaatacacgtactctacatgtatctgtaatttaccaaaaaggattgtgtgctatttcttcaagaccatggagcaggaagtcattgtttcaagaataaaaaaaagttagtgccccagcttatcaaaagccacaatgaaactacacagcttaaatgcgcaaatttgtatctaatcataacctccttggctgtctaaggccacttaactcagttaatttggatatcttcttttgttcagttaaactatgagaaaaatctggtacaatgaagacatgctgaggcttgagaggctccttaccacatatcggaaagatcccaagg

SEQ ID NO: 48183 - DNA, 1124 bp, Oryza sativa
cttctttcacctcactcccctctacgcccatctcaacctaaacctccagggcattcgccaatgggtagggagaaggtgtcggtcggcgaggaaaagctcgacggcggaggccgccggctgacgtggctcccaacggccgggagcgctcacgtcatgaacgggttgcgcctcgatcgagccgaggatccctcacaccaaccccgcgttcttcctgctcttgggcggcacaaagccggcggctagacctcgatctgacgaatcagcaatggcgctagagcgagacagggtggcgcggcacgacggttggcgggggctcggtcaccgcgacgacaaacccgaggtgggggatcgttggcaatcgcgatgatgatggttgtgaggaaattcggcggcggtggttgaaagggaggagaggaagatcacgagcaatgcagaacgtggagcggactgtgggcgtgtgatgcgtatacagagatacaggagtggtaggtcgagacgagaaaattgatattataccatcttcgaaaaatgtggcttcgctaaaatacaactctcaaacgagtacaatttgctgctggaatgctattcattttctccattttacatgaattgaaaatgttttggcacatagacagacctttttgcccctggcgggcagcggtaggcacgctatctgcccgttgtctgttgttcttggttggttggtgagaggaggggaagaagccggcgcgacgacgagggaggcagcagcgtgggtgcgagggcggtggtgaggcggctggacaggatccggaagcggggcacactgtcgtcgtcggccggctgtgctgctgcgatggagtggaggagggggcggcgcagccatgtcggcgaggaggctcgtgggcgcgcgcgttctggcagatgaacaaggagaggctggctgttcggggaggatcgaggtggcgcgctggagcatcatctgcttcctcacagccgcgtgccgatcgatcgaggtgagtgaaggcgaggaagagcagctgcccgccgacggagaagagcagccgtgctgtccattctgattattcacacgaacgaagcctaccaaccctgaccaccttattgtctgaaacaagcccttgctc

SEQ ID NO: 48184 - DNA, 2488 bp, Oryza sativa
ggaacatcatagtaactgagagataatatcattttcatgatatcaacatctgggtcctttgcaagcacgagaaggagccaaggagaatggtggcggtggctcaccggtgatgggaacaaagcaacgaaagaggggatgaaatctagagggggtattttggtcagctcatcaagaaaaacaaggtaaaattcatgtaatttgattaaaaaaaagagaggaagaaatggcattccagcaagttgtactggtttgaaaatggtgttttagcgaagccatattttaggatggcattctagtgaaacccaatcctgaagatagcacaatgtcaattccgtagatgcgatctagaccgttgcgtgagaaccgaaagaatgagtgatgactgaaatcatttgttgaactatggggtagatttgacgaattcaccatcgctggatggagagcgacgcggcagatagaaaaggcttggagaatcatatgctacatccagttttttttttcttgtgcaaacaagaaaaaaaatagtactccatccgtcttacaatataataacttttaattatatatcttgataaaaaaatatgcctagatttacatctaaaagttactataaccagcccgccattatgattaaaagataaacagcaagataagttgctataaccagccattatgctcaaaaggtactaaacagcaagaatgattgtctttctgtcatgactcataatgtggtcgagtcgagactcgagagcacgtacatgcacacacatttgatggcgttaagctgccgagtgtaagttacttgagcatttgtaccatgttacagggactttgttttctccagctcaacacaccaaatttactcaaataaatcaaattaaaacgcacacaaagaatgccagtaaactagattaggctagctttcttcgtccacgataatggtcgatcccgtgccgatcccaagctccatgagagaaaccgtgtcttcctcgaagaattgcggcatagggcaaccctgtcaaaatgcaaatcgatcagatcccagccgttccagcatgcaagtattttaccctacctagctttctgcctcttcttttcttttttttttcctttctcgacaacattttaatacatgagcaatgatcatacacagcacaaataatccatacctcttcctcaagatacagtctcagtttaacgtccttcagtttaaagaagctctcgcacaaagattttaactttccaacctataacatgcaaatcataggcaatttagccgtcgtagcaaaacaggagagcatgttatatcactatcagcaagttgccactaatatctcgcatgtgaaagctaaacataaccaacctgtgtttgagaggaaaggaaaggagaagattgaaaagatacaccaaacgaggtgagtcattaacacatgattaattgagtattaattatttcaaacttgaaaaattgattaatatgattttttaaagcaacttttctataaataatttttgtaaagcacacaccgtttagcagctcggaaagtgtgcatacgaaaaaagagaatcgtttttctctatctgctggtctcaaagactcaaccacgaaaaaaggacagctaataagtagtaataggacccaagaagtacttacagtagttgcaggaggcagcttctttgtcaatggttgcttctcacccatagatggccctacgcatttcaaggtgatacctgtgtgcaacggaggaaaagaaaaaatcacttcctcgcatgcctaccatacaactctcttgccttaattatacttcaactttcttgcttctaagccccgacccccttttttgaggacccgaagtccttgaactcggcttctcatcctcaataccatgaaaggctttcagctcagcaaatctgcattgacaaatcgttattgcctaagcataatccaattaataattggtgcgtcactatcatcaggtatctgtcccagcctagtcccagggaagttaaatttagcaaatgaagccaagcaacacaaatttggaagcgcgtgtaaacatcaagatagacatataatcctaattgttgaataacaggtataactgagatcatataggctggaattgactaggtagagcttttctagttagtaaggtcacagctcatgtggtgaaatcatttaagtaacaacatgtgtcctttgcagcaaaataatggcatatgtagtgaaaaatcctttggttatatcatggtcatgtggtgtcaaaaagtaaagaagggaaattggacaaccttacctagggtgcagccgtttgatctcttcaggatcatatgattcagcttttcccataacaaggcgaacatatctatgtttttgcatcaaaagtatcagatatcgtaattgtggtattccttcgagaaaagcaagacaatatagataagtgcaagaacactttctagaaaaccagaagaaaaattcaccgttggc

SEQ ID NO: 48185 - DNA, 3885 bp, Oryza sativa
catcataacattcttgtaaatctaagaatcgcagtgtatcaaaatcttgcagttctaactgttcaaacctcatagaaaaggaattgaacatcaatactaaatttcagaataataaacacaaaccattagaaagaaacttgcttactgttaaactcggaaagaggttaagtgaatccacagaaaggacctcatctatctggttagatcctgaggcatttgaaagtgatcattagcaagtcattttgaacttacttgaattaaaggcagttcttaaacagaaaatattatggaaaacatttcatggcgcatgatcaattttcccaaatagataacggaagccagatattacagaaaatatcttagattcgatattttgttatggaatagataagggaagccagatcacaaaaaatacctaagagaagaactcgtagtttttcaaaaggcaaaacagctgcatcgccaagagatcctagtggaggaggattggatggatatgttacatgttttagcatgttcttattcaaatggagctgttccaagctgccccaaaaaagaaggaaaaacatcaatatctacagttctgaaatgcagaagtaacattaacttaagacaaaagcttcagttatacatttgtaccttcttaagtaagatagtttcacaatttcatcccatgaatcaatgtgattgtcttctaaatttaagagtcgcagtgtatcgaaaccttgaacaatatttccaactggagtctagataagcggacacatgatagtttatagttagttcttcaaagctgtttcttaatgtacacaaagttgaagaaggaaaaccttgcactgcaagatttggaaggactacctattcaaatttccaaatggatcattttccagttagccaggggaaaacttttatgaggagtttctgttttactttggatgaataacagtaaatgaagcagtaggcataaaatgcatggcaaaaaaatgtacaagaagaaacgctaaccatcattgcttttatcctgttcgtcattagatggagttcactgagacatgaaaatgagactttaatcttttcaacctgttcacataaataaacatcaacttatactgtgattggcatcaataaatagaagcttcattgtgtcagccaaggggcataccagttcccatgttacaccacagtagttgagaaccaaaacacggatattcttgacagatgaactgtcagtaaagtcattctccatggtattgtttgtcaaatcaagaatttccagtgatgccagagcttcacacagagagaatatatcctgtgaaagaacaaaactgttcagccaaatgccaaaagaaacataacattagcatcaattgtgagaaaacataacaaaacaattgaaagttcaggatatcaagcaaatcgtgacctgtactgtcaagtgagtaaaagatgctaaatgtgctttcaacagaggtgaaaaagataagatggttggtgatgattacatagcttaccaacgcacatgaaaagtattaataatccaatacagggatataccacaagttttacttctaggtcaaaataacataaatttgaataaactccaagcttatgagtaatgaagttcaacagcacaatgtggcaccattgtaatgaagagcatacagccttttgctgtgcatgtttcaatttatgaagttttgtatgttatatccatactaattaaaaattgtgctaaccataatgttagtctcttgaggtacatacttgccactgagagagaattttccagttaaatcaagctgtctgagatctgaaacgagcaaaactattgtcagtactcatcagaattcaggataaacataggccaagtatgcatgacagtcctgccagcaaatttctaatgaatgtttactagtaaaatcatccctccaatgctcagtgcctactaatggcctaagagaattcatgccattttcaaatagattatgtaatggtgatacaactgaattaggtcctaagggactagtcttaacccagaacctagatgctagaggtgagccaatacataatgtcatctttataggaaatatgagaatattgtagttgaaaatgacccagctgtggggtgaacacatatttagtttgctaaaggaaactttaataagaaaatgcagctaaaaggtatttcaactcagttattgtagatgccgacgttgttacagtcggtcagtacatcgagtctcaaatttacactcaaagaataaaaagtgacacaaatacgaagtactttaggttaccacccttttaattttgcatacgttaagaaactataaactctattccattatctcatttccaatgccaaaatatgcagtgaactaaatgctttagctgcagagcctccagtgaaccaaacaaaatatatacattgtgttccctctaaggaaggtaacgtttccaatatataagatcaggaagcttgacatgtatcgctgggttgcaaaacaatcaaataaaagagatgatttaaggattaaaggatagtaagtacttggaaccaaattctttagttcatctcctggcccaattgagcttactcccatgtaggatacagatgcactggtcagatcattgaggtttttcagcttttcctcaactttgttcttgccaaccaattccactgacacgcgcttctgacttgatgagaagacatacatttcatctggacacaacaaaatgtttatatcgggtatcattataaatgtaaaaaggtgtatgcatattgcttttacaagcaacggaaaatcttctgcccttgaaacagggaaaagaaaacagagtagctggaaaatcttacgccaacccaccaatagcacatgattttgaaattttaacacgaggtgtcccatacatgctctcaagcaatgagcaactgtcaaattcaagaactagtacatatacacatgccaacatggatgcttgagcctaagttgtataatgcaacaaaaaaaatgtgtagccgatttctcgaatgctatttacaacgcatagaaggtagaaagtatgtactaggatgaattttagcaaaaaattaataagtggaatgggaaaaaaaaaagaaaaagaagctagctggtggaatgaagagcagcaagatttggatttggaagccgaggaatcgagggatgcggaccttgttcctccttggtgaattcctcgacacggtagcggttgcgtatggcgtcggggagcgtgatcccggcgctgagcgcggtggggcgcgcgaaggaggcggagcgttccccggcggcaacgaagtagcggcggccggcgagcgacccgtcatggcggccgccggcgccggcgtcccagtcgacgcccagccagtctccggggtggccgtcgacagggccgaggtaacgcacggtgccgacgcgggcggggtcgccggcggcgtgcacgcgctgtcccaagcggaaggcgacggcggccatggatgtcgtctcctactactactactacgaagtgaagtgaattgggagttgccgttcatttctttggcccatttagccccatcgcttcactattttgggctgtgggctggccttatccggccaaatttggaagttgcaactgggagagatgatttttttatcaccatcaatcaaaaaagaaaaaaaaatactctactactgtactagatgaaaacaaaacctttatatgtcaagctttcaccagctttacaatctttaactaataataatacaccattggtagcaataagtaaaaaagatctaccacaaccaaaccactttacattatcatacaaaatttcacaatatactgtatcatgcaagtttgtactagtattttctccgtcctaaa

SEQ ID NO: 48186 - DNA, 7059 bp, Oryza sativa
aagggaagaaattgactgggtttagtcacctgtcaatgaaaagctcccagtcctttttgactcttaaaaattccttttcagccggcaaaccgaacccactttgttgtgagttgggagttcctgacttgggtttatggcctgataaaacggatgcgaccgcaccaagaaaagaagcaacctttttgttcgctttgcttccttggttagtttccaaggttgccttcttcttgtgatcctccttccacctgtctcttcctccccttcgctaaaaaacctcgcctttttagaattctagttagtttttcgtcctccaaatccgtcgagacccaacaacccaagaggacgccatgagcatcgagtagtaagttcccgactctccgccgccgcggccgtcgtctccaatttcccctctttgtgaaactgcgattaatggtgtttgcgttttctgatgcagcgattacctgttcaagctgctcctcatcggcgactcctccgtcggcaagtcctgcctcctcctccgatttgctgtaagaaagcctccatcttaatttcgctcggaaacttctcttctttatttcaatagagtagcacagttcggtgtttaattaacttctcgtcctgacaagttccggttcgtttgattcatgcaggacgattcgtacatcgacacttacatcagtaccatcggtgttgatttcgtcagtacaaatcttcctcttctcttgctattgatgaaccattgaattctgcagttgctatcatctaactgaatcaaatttcgttaatttgttagtgaatatgtcaccttttcagaaaatccgaaccattgaactcgatgggaagacagtgaagctacagattgtaagttcattcctcatcgagacaattctcttatgcgagttcagaccaatccattttttagataattgcacgattaattcatgcctgggatgcatgacttttgatgataatgcctagttctagaaactttggaactcaatctactatggattagggatgcttggcttgtatcctcccttagcattatcctgtcaaaacttgagtcataagttggttttcagttccttttcgccggaccggtgttttcagttcttactccctttgtttatactctctggatattctaaaacgtggtgctagttccaataatccaaaattgtaatcttagaggaatacaatgatagaaccatggtgatgggtgtaaaatttaagaattttgccatctgtgcagaatattcttgaatgaaacaacttgtccatgctttctgagttgttgacctgccattttcctcctattattgttgaagggagaatggacaggaaatggagcaattaccatgcaggcatgcattgacaattacccctaaactaatttgaggaactggactgttcagcaactttgtttttggagggaactggtacagttgataggagaggttttcaagatctagctaattaagaccacatagcttagagttatagtcagggagagcttatagttgggaccctaaagaaaagcttagagttgggacaatgtacttgccaagcagctgatttactgcatcagttcacatcagatttagattacacatgcttgccaagtagacatatatacataaacaattggaaattatggtcttaatgtttaattgtttggtgagtattgatgtatcaggacacacattgctttatgaaatatacctttatttgttcagccctcaaattattataatgatgttgtttctttttcagtgggacacagcaggtcaggaaaggttcaggacaataacaagcagttattaccggggagctcatggaatcattgtaagtcctattgagtttttgcagtttataagatctttaaaatcttaaactgatttttttagctgtactgtttttcttccgcgatgtagtactgaatgatttacgattgactgaataggtttacagtttacattggttgttattgaattgaatttcttccttctttctttttgcattatatgttgtgttctacttttcaagatctagacttccacgcatggagttaatacatcttacaatactttttcagattgtttatgatgtgacagacatggaaagcttcaataatgtgaagcagtggttgagtgagattgataggtatgccagtgacagtgtatgcaagcttctagttgggaacaagtgtgatttggttgacagtaaggttgttgatacagaagaagccaaggtaatttatagttttaaagaaatcataggaaatttctgcagtcatgctacacttagaatgtcatattcactgattgttgctgtcatcaacttatcagagatgtctgttgttagcatacatagatcaatgtagtatccattgagcttattgaagggatattgtcatattgtatccctggttgtgaaaatatttccagaaaccactatgtagcatgtaccttcttttgtagacctatatctttgtatgttcttggtatatatcttcctgaatgcattttcagtctctgctcttcaggactaaagactgaacatggtatcaactgactgaaatgttaatgtttaattgcaggcttttgcagagtcattagggatttcttttcttgagacaagtgcaaaggaatccatcaatgtggaggaagctttcttaaccatgtcgtcagacatcaagaaaaggtaggagtaatccatttgttgcacccttggagccttggaggcccatatttttccctagcttaattttgaacttctttctcaaattttgtcatgaacctttccatcctttgaaaggaaattccagttttgcactcgaccatgaaatttgatttcctaggctatgaccattctgaatattgcttctttatagctgatgaaagtttatgacaattatttgagggtgcaaatgaataaatttaatattagaaagttgaaatgttgatttaaaaaaattctaagaaatgctggtgaagaaagtttttaaagaaatggaaccatttaggaacttgggaaacgtgcccacgataatccataattcataagctgaaaataataggaccctcttcatgttgaataataaatgccgatgatgcagtttatgtaccttttgtactcctagttcctttccgtgcctttcaacaacaaacgaggggtctatgtctacctgactgactagtgaatttccttgccgtgcaacctctgcaggatggcaacccaacctgccgtggagaggaaaccaactgtccatattcacatgagaggccagcccattcaacagcagaacagcagcagtagctgctgctcatcatgaactcaacaagacgccgttcctgtcatggcactagccaaatgttggaggattcatttcgtcacaaggctggaaaaaaaagcattggattggatgatactttagcattagacaacatcatcatgcgtgcacaaagtgttcgttacttgccacagtttgtgatatcatcggtttgttaaaacagtttataagcctaaatttaatatatatgatgcatgatgttggaactgaacatcatgatgcttgatgcaagcttgtcactcttgtcatttgctggtgtttggaggcttgtcagtttctgcttattagcaggatgttgactgatgcaaccctgaaaaaatggacaagagtaatgcaggaggaaccaatgatcttgacatgatactactgtatatgtagtaattaactgctttaggtaatatatgactgtcaggtatagcaaggtaaatatttatctgacaaaatgaatcaacgaagctttaataaacttaaaaagaaagaacaatcacaagcaccacacaaggtacacgaaatgacatctgaaactgaaggattcgttataagttgagcagcattgcttcttttcactattggcatcaccggcagcgacattgatcgtcttcccttctttgacacctccagcggcacctgccccgccttcatctgatgccacgggcttcttgctaatggccctgtgggtgtcgcggagaatcagctggaatgcctcctccacatttgtggcctcaagagctgaagtctcaatgtaggacagcccttctgcctcagcaaatttgtgcgcatcgtctgtcgcgacggcccggaggtgcttcagatcagtcttgttgccgacgagcatgattctgatgtttgcatcagcgtggtcgcggagctccttgagccaccggctgatgttgtcaaaggttgtgggcttgctcacgtcgtagaccaggactgctcctagagctccacggtagtaagcgctggtgatagctctgtatcgctcttgacctgcggtgtcccagatctgcgccttgattatcttgccctccacctacatcaagtcaaagatttcatgcaaatggatcagtttcaatttttccaacgctaatgcatttgtttacattcaatagagagaactagtgttcagtaactatccaaaaaagataaaattgggaggagaggccataatttggaacttggaaagaatctgaactggctgatgagttgaaggccaaactccaaataagcatgacgcatatggcactggaagtttattactttatcatggtaagttcattagagggtgctatcccaaagtgtacaatttagtacaatctgactagaactgcagactattatatcttcaaagtatcatagagcatggtgtcacaattctctgtgttggtccattttcaatttcttggtcggtatataacaagtgtgtgctgattgtcattagcatttagcagcttaagcctcgcagctagacactgtcaagcctagcaggtacaacaagaaagaaagaaagaaactttaagaggttattaatattactgtggaaagtattacttttgttaaaaggaaattaaactattactgtggacagaggtactagtagctgtcaggcagttgctaagccaggtacagaattgagtgtgacagtgagatgaacgagtagtaaaggtggtggcgcagttgggattatggcctatcaggatatcacaatcaagccattggatcccataaggcacacacgcagctggcacctcgtcatcgcccacatgtatgtggatgagcgctccgctcacacactgttgttattttttaagcaggagctgcagcaacttgttactcctatctccatattattatgtatgtatgtattgagttcctcctctggtttttttttttaaaaaaaaagaagaagaagaagaagaaagaaactgttttctgtgtgttaaacgaaattagtggagtaaaatgatgcaagtagtggagtggcgaggtagatgtggaattgatgaaattggtgatagtagatcatggttgagcagaagcatgtgtggtagatctaggtagcaaagctcacgttttttttagcaggagaaaaaagcagaatgccacagagaggggattgcagattggatccctgatctggatttgtcaaaataaaaaagaattgctggttgaagagaaagatcggatctaaggtagaggaggggttgcttgcagaaaatggtagatcgcgcgaggagaaagaggaattgaattgattgagaaaggaattacgaagcagctagggtagctagagctagtggtaagtacagtaagcaggaaggaaggagatgaaagatggacatacatggagggtgcgggtggcgaactcgacgccgatggtggacttggactgaggcagaactcgttgcgggtgaaacgggagaggaggttggacttgccgacgccggagtcgccgatgagaaccaccttgaacaggtagtcgtactcctcctccgcacgccgcgtccccgccatctatccaattcccttcctcccttctcttctgctactgctacttctttctactgcctcttcttcacttcctcctcaacaacaacaactcaactctcaataaagccagctcactctagtctagtgggagactcactcctagatgacttcccagccgaatcaaccacctgtctccaccgttccttccccttcgcgattcgtgctccttgcttgccttcacggcaattcttacatatcacatctaccctatagttcaacaagttgttttactcattcatcgtgtgacacatccaacgatccaaaaccaacagatgaagttgatccgacggctccgatcgattagaaatcgcgcacctccctctgttccctatcagcatcgtgcaaaacgctaccccacccggctcgtagggcgctgatcgcgcaactcctaatctcctctcgcatgcgatcgatcctccgccctcccgtacgcattacggccgactcccgacgcctccgcttcggccaatcgacgccgtcatcctctctcgcctcgcgcgccgtcatccttgccgataggattataaccgggcatcggcgtctgtctcgctgccgtcaccccgcgccgacgggtgtggcactgtggcgtcctgaccgtattcacagttcctcaccacctggatggccgagaaggaggggatcatgatcgaccaggtcggctgcactggttgaattacctccagcctgacgtgtgacgtcaagcactgcaacttcagcgccaaggagcagctgcagaacctctttggtattcaatcctgccgatcccctacctccgtgtcctgggtttcttgagacagttaaattctagcaggggctctagcaatttgcaacttgatatcgtagtaatatatgattgttttttgtttattttacaattatttaaagaaacctgatggattttcttctgtatatataggtgagatgagaattttaaccaagctgattggatatatatcttttcactgcttatgagtggaaaagatagcattacagttcaataatttgcaatgcaaaaattataaatatagcttctcaggataactagaatgtcatattgtgataacaatgctgaaatttctttcaacggagtaagtagtgtgcctattgattgtctgcttttccctgactttcctgaaaaatactgatacgaacttatggct

SEQ ID NO: 48187 - DNA, 15028 bp, Oryza sativa
gattatatagaaattttggatatttttaagataaatttgcaatataacattgctatggtcatctgatatcattcttatgaaatgttttattttagttatttgtccagctgagcctaaaaaacatgattgagaagcatccgcggaatcaatcgtattatgcaggataaacataatattttctcctgcaatgtagaagaacctccccaaagggctctatgtatttgctctactcattggactaattggagatctttttgatttttcttcagagcacaatcaaacaacatgatgtaagcgccataaagttgacagacttttggccacagcgagaaagggcaccgacaaaaccattgggttgatggtcgaaggtggccagtgccttcgtaggtgagagaaatatggatttgccgatttgcaaaaaagatagtagtgttgctccttctaatggtgaccaggtcatgtgaacaggacaaaataaaagggaaaatgtgtttgatgggaggtgaataggaattgctaattatttatgatttataagaaaaatggtaaacttcttattgtaaataatgaattctattgtaaacgagatataaatcaaacattggatggtgatggatggtgtggacttttatgtctactcactgattatcaaagttgtacattaggaattacatggtttcagaagatggaacagttataatatcattatttttctaaaaaactaaacctatctcattttatgcttgatagccaaaacatataattctcttgattgtttgatttgcattaataaatactaccgtaacgttagtacgagcatattactagtatactatagttgataaaatacagtgataataaatttagcatgcatcatcatatgaagctgacacttgtaaataaatatgacagcttcaaaagtatcctcatgtgaaatttgattctaagacaaacaaacttaggccctgtttaagaccctgtttagatgggattaaaaccttttaatctctattgcatcggatgtttggtcactaattataaatattaaacgtagactattaataaaacccattctataaccctggactaattcgcgagacgaatctattgagcctaattaatccattattaggctatgtgatgctacattaaacacacgctaattatagattaattaggcttaaaaaatttgtcacatgaattaactctcatttatgtaattagttttataagtaatctatatttaatactccaaattcatccgatatgacagggactaaagtttactccctggatctaaacaccacctaaatcccacctcaaaatttttcaccctatcatatcgaacgtttaaacatctgtatgaagtattaaataaatgctaaaaatataactaattgcacaaattgcgactaatttgcgagacgaatcttttaagcctaattacttcatgatttgacaatatggtgctacagtaaacattggctaatgatgaattgattaggcttaataaattcgtctcgcagtttacaaatgtattccgtaatttgttttattattagactacatttaatactttaaatgtgtgtccgtatatccgatataacacgccaaaactttacgctactggatctaaacacccccttagcataagattttgacatatcataattcgtagtgtttctatttagttattatgataatcttatattagatctgtttattttggaacgaatacaatacttgccttagagatacgtcgctccaaaattgtgatgtcagaataaaatgctatgtacgtaaatctatgtcttttagctattctcttcttccacaccaagtcacgactcacgactcagatgttacatacgattgatgtatggatttcactaattcactgccttctataaggtgtgggagaaaatattgcactcctttatataatattttctctgccttaaaatattacaatcaagatgccatttgatctatcctacttccatccagattcgttagattgcaacattttggagcaggggtcaacaaaccaagctatcagaaaccgttacccaaaccgccgagatagttaatttgacatgagagacatttatggttgagagatgtgattcaatcggaatcaaaatgttgagggagatataatagacttattcgtatacatagacattcgtgcaaggagatcatggcctttcttttcagcctgctggctgcttaatctaccgggctttctttcattcattccgtattataaactattttgagtttgtcctaaattgatatttttataaccgagtttaatgtatatttaattaaactaatttgatactctaaatattgctacgtttccttataaacttatcaaactttaaaattaattgacctaggataaacttatagtaatccctccctcacaaaaataagttcattctttttactaattttttaagactgcatgtaaattttcactacccggctttttaagaaagcctgaaacataacagagtcttgcatgaaaacaaactgaaaaggaaaacgaaaacacatcagtaacgctgcccatctccacgcaaggagaaccaaagagtaaacagcaaaaaacctctcctcccagtacaccagtcaacaacagcactatccaatccccaagtcatctggcaaaacatctctaggcccaagttgtgccatctattccattagcttagctttttaacaacgttgttcagcggagcacaatctccttccagcgttgcatcgtacacgacctgcaaaacagatttaggtaatttatcttcaactaaagctcccaacaaagacttgcaatcagaccaacttcacccccccccaccctcaaaaaaaaacttttgcttaactattctaacaccatcccaaaaatcctaatgtgattattcattttctttatctactctcgatatatttatcttctatttttataaactccgatacaattactgttcaacaacgaacttattctagaataaacaggaggggctaaaaatgatcctgttgtgagatggagcggtactgtgcaacggaaggattaataaaccggatggaattggatatacacacgcgtgtggatatattctggcatggtaggcctctcgcgtaaatttatgattgcaacatctaattaacacatgggtagaacatgcatgtatatgcattaataacaagttggaagcagctatccgatcgctagctggtttcttgattggcacatactatatgatgatgggttgatatatgatcgatgataggtgaaaataacttgcaactgatccatcgatcgggattctcccttataaaaaaacctattcatcgatcaatccatcgagaatcgagatgatgatgaccgggtggattatataccgtcaacacaaatataaaatcgttcgtacgaaggagcgcacactaattcctattaacgtatatgctcagactctagctcctttaaagattggctacatcattaattagtggtaggcgagtgacaatcggtgatttggtttagtggatacatcatatatgcatcgatcatttttagacatgcaaggcatattaattatatatataaatattaatacatcatattttaaatatagtaacttttgattatgaattaattaatcacataattatttattagatttatagctaaaattatttgtatgtcgaaacggagaggagtactatattatcatgatggatcgtcaacatgcacctctcactctcgggctattgtctgttcatccaccatatacgtacgcgtatccatatatttatatggtcgatcaatcacgcatattttacacacgccgcctactgatcgatcgatctctctgtctctttcacagggacgatacaaacacgttagcgacccaataaacaaaggaaaacacagtgcatatatataatttgcatcgatcgggattcgggaccaaacatcatcatatccatgagatgagtggccagagcgcggaaacaggggacgagccgaggccaggcaacctcaaatattagtctctctatctcagatattagtatcattttttctcatgtcataatataaagtatatactccttctggttatatattaattgacgttttggataaagttgagattaaacttttataactttgaccatcaataactttaaaaatatttagtttaaagaaactagaaaaacatatatagatttttctttcaaaacactataataaaaataaatatgcatttatttattatatatattataatagaaaaataaggtcaaatgtatatcttgtagagcgtgtcattgtctaaagtgtcaattaaaatgaaaccggagggagtagctattatctctttattctttaaatttgatttattttaaatcctctaccattaaaccccaatcatattacttgtatgtacgcatgtgatctaattaaggaggtaattaaattctttgttggtcttcatgttagaagtggttgagctttatattttgggatgtaggtagtagtgtattagatccctccatatctttaggtctaaatactgactccgccattttgagtaagtggcttgtttgtccatcatcacacattgatcggagagtggattttaaactcttgagggaacgccccctcattgtttacatgttactgaaatagttataaaaaaattaagaagatatattaatatatgatatatcactccacaacatatacaagttaaaattttaacttgtgttcgctaaaaaaagttaaaatttaacttgtacatgtcacaaacgaaaaaaaattgactataaatatacgttaattagttctaatttattttctttttttattgtgatatgtagaagttgaatttgaacttgtatgctgtatgtttgtggagtgacatattacatattaatacatcttttaattttttaaaaaaattaataactattcgattaacatgcaaataacgagaggatatcccctttagagtttagaatagtttctccattgatcgacatatgtcaaaaaaatataacaaaacccaatctacaaagatgctcctcctacccggccgatagaggttgtgtttgtatattaattagtttataggtgtgagtgtacaaattagtatggacatacatgcagggagtggatcggagagatatatagatagcaaaacatgaaaatcgattagatggtggtatcgatgtatatatagagacatgtgttgtatggtgaagtaggtagtgggctccacaattacgcgcgcactgcagggcagctatactatatatgcatgcaggatgcagctgaggccgggcttgagctcaccgtcgacactaacaaaacaaaagaaagcaatcaagaagctatataggtatgggcagcgccggcgtggaggatgcagcggcggtggcggcgttcctggagcggtgcgcgccgtcgggagacgcggcctacggcgagctcaaggcggtgctggggcgcctccacgagccgaccactcgccgcgccgcccgcgccttcctgacggcgctccggcctttctgctccagcggcgactcgctggcgcgctacggattccgcatccacgacctctccctcctccactgcgcccacgaccaccaattctcaggtactccgatgcatccatccatcaattggagtaattagctagctagtcagtcttttgctcgatcgatcgatccatcatctgcatgcatgactgcatcgatcgatcgttcatgcacctccatcggtattaatttttagttactccaatcctaagtagtagtagtagtagtagtagtagtaattagtaaagtaattaaattgactgcctgcgcctaggcctgaggagctagctactatatccatggatcgatcagagtcaactgaactaatataacgtccggcctgttcgtcatcggtccatctcctcctctcatttcatctacttcttcttcttcttcttaaaaaaaaaaccaaaacaataagctagcaaacggtccttgtcgatcacttgtacatcatctcaaaagtctgaataatgcagagcgcgcgacggcgacatccgaccaatcacagacatatgcaacttgttgacaaattaacattctacaaggaattaaggcatcgttcgatcatcacaaataataccaaagctagctatagtgtactcactttctagctagccatacatatatatactactgtagtgtacatctatagatcgacatgacaatgcaattagtccctgccatggaatttcaattgcgtgccgtccagtcatctccaacgtactccgatccatccttcgatcagcgaatatttactaccatacctgtcggcccacaaggatccaatcgatccatggaatcatcgatcgatcatgcatatatgtattccacatattatatatggaattgacacatgtctttttctctctcttgtctgccccttatggccttatcaccccccccctccgatccacccatatcatttgtcggtccgtggattattccaaaaacatactagtaaaagattaagaggaaacgctagctatgactagcatcatatatattcatatgtaggagctaccgtacgttccacacatgcaagaaattaaggtcctgtttggtgaagcgtctcgtatccattgctactttcagaatctttagctcccaccatttatattttttttagataagtaccatttatattttgggacttagcagccagaaaaatgtgaagctcaagcatctttacattctctctgtagctaattatactcaccccagcttcccagattaatagagcataaggtaggtccatcaatgattgtgcctagttgatcatacattaattcaatcctcgaatatgtggtttggttttgacttaaaaagttgcagcaacacttaaggatagacaagtagggcatgctacatagttggctttgtagagagatgggggtgactatggtacaattttatcgatatttcaacaatttgaactcgatgttttagacgtgactacatgttggacgttcaatttgtgaaaaaaaaaacatcaggcttgaatttaaacaccgacaaaatttcataaaaatgaatattaaaatggttaaacacaatccaatcacatttaaaacattttctctctaacacacgaaacatcgggtttcattgttgaaacattaatttataaaaaaaaactagaatattagggaaagacctaatatcaaataattaggaggggtgaggctttgaacccaggtcgtttagcccaccaccttatgaagctagccggaagactcctgggcatttctcaaaacattaatttatagatccacgtgattaaagatgaaaaggtaagaaacaccatcaaaatcctgttgcagatttttttatctaactcatgaaacatcaagtcaaaatagtcgaaacataaaaaattcacaaaaagtattgatttatatatggattcttacttcattccgagcagtggccaacgcctgccatgactaaggtggaaaataaggagaaggaattgacaagcactcatgaaatagggaggaaattaattaaaaaacgatgtgaaaaggatagagtgccgtgtcgatgtgagataaatggatttacgttgggaatgggtggcatggcgttagatttttattccaaaaccatgtaccggttagaaacattccccatgattatcccatatattttaaactttttaacgtagatgggttttatttctattttataattataatcatataggatatttgaacgagcaacacatacgaatttatcaaacacagagcaaagaaaaatgtgcagtaagtattttagctaaacaaacagttatatggtgcattcatgccacacatatatgtagcatactttttttttccaattagaaaaaaaaccgagaaaagtgtatttccccatgttatttagtaatatatctttcagcttcaatggagcaagtcttcgagaagatccaatatacctcgcactcatcagaataagtggtgcttaacgtggttagagagctgaggaaaaaaacaataaatcaacatagcaacaagttagcattcatgttcaaaaaggaagaaaaaaccaccaagttggcacctttgaagatttcacctaacccacaaaggccacagccatgagtttcttccaccttcccttttattttggagaactttacagccaaaagcaattgagaataatttgatagggaccaaagaagactactcatgatctactaatagaagtattgaatttaaaaatataaagtttttcaaaaaaaaccctaatagtaatacctttgagaaaataaaaaagaggaaaagaaataatgagaacaacctcatcttttcgcttatacttatacttataagccaaaatttgaatttttaactttaaatttagagttgttttaggctttttgattacaatttattttccaatctttacttttaaatcactataagaacacgtatataaaaattttaatcctaaattattttttatttgtaaatatattgtttagctttttttttcttaaatataagccaaacgatgatcctataaaagtgtaacagaatcgggagtatatactctactcctactcgtacgagaaaagagaagagaagagaaattacggtagtacccctgtctccttcgtcactggccacggcggtatataactccctccgacctccccgccaatttttccgcctgttttagttttcctcctttccacatctcatccatcgattcatccgatccgactccgacctaaccaatccaatggccgccgccgccgaggtggagtccttcctggcgacgtgcgcggcctccggcgacgcggcgtacggcgcagccaaggccgtgctcgagcgcctccaggaccccgcctcccgccccgacgcccgccgcctcctcggcgccgtccgccgccgcttcgccggccccgccgccggggaggaatgcttccgcaccttccacttccgcatccacgacgtcgtcctcgatccccacctccgaggtatatatccaccatctccactcccgcccttccccctcgcggattcaggggtttaggagaacccttcggatgtcttgtcatgtcacccgcccttgcttacttggttgctcgcagattcctccatctgcttctcaataatttttttacagtttggtaactaaatacctttcacgatttactactactctatttgctagtaatttggattcttgctaaaatcttttcttggctgcttggctaattgagtaattcggaactgctatttggtagttggtactactagtagttagttgctagtaatggttttgtcaccactcgcaactgaccagccaagcaagtatgctatcaccacatatagtgagcctctgcctcccatggtaaagaaaagggataacctagattggaatcaacaactgtgctgtgcacactgttctttataaatgacaattgtatactgttggttctggccaaattgcttaccacgtgtgatgctgctgtaagcatttcaaggatgcatgtgctaggacagatttgacccatatgttcagtttctgggaacaattcgtgtggctacttggataatttatgccttctgtttgcctcattaaaataaagacccaccaatccacaatgctctgcctgtacctttttccttttttctcttttcaatttttatttctgctgaaggttattcaccttttctaatttattccttggcagaactacctttgcccaacttatcatcatatggacaaaagcatggcatatgagcctggttcttaacttatctcataacaacaaagttaggacacaagtcaaccaaccatattattataactagtagtaatattggacagcgtagtagtctttaaatctgagcaatttcctagattgtctcattgtctggagtatggacctgacatgaatcctcttctatcgttttgtcattgttatatttatgtgtgttggctcaatggtaaaaccttcctatttttttataccaatacattacccctttttatcccctcttgtatggtatttattgtttggtttccataacttacaaatttatcaactgtttataggattccagcagaggaagaagctaacgatgatggaaatacctagcattttcattcctgaagactggtccttcactttctatgagggcctcaatcggcatccagattccattttcagggataagacagtagctgagctgggatgtggcaatggttggatatccattgcacttgcagaaaagtggtccccttcgaaggttggcatctctttcctgtgtacatttttaattcattgctactgtacagaggtgggagctacagcacttagacatttactaagtcacaagatatgagttttgctaatccaatgatggtctaccttgatttggtacgtctagaaacaactattgaaagtaaggcactgctctataccacagaactgtttcagtcttggtaaaatgttggcgtcctttgagaatgaatagtaaggaaaactaacatgtcatttgatattttaaactgcatgtaccactgtatctaattaattagcacttgctctatgttacctcacttgttcaacctttttttttttttgccacaatccaagctgagcattgcttgtttcttttgaaggtctatggactggatataaacccaagagctgtcaagattgcatggataaacctttacttgaatgcactagatgacgatggtctcccaatctacgacggggaggggaaaacattgctggatagagtagaattctatgaatctgatcttctctcttactgcagagacaataaaattgaacttgatcgcattgttggatgcataccacaggtacagtcatgctaatatattcttttttgaaaggaaattatagtaaaccagacggaaggaaaactcttactccccaaatcctcccttttcagattcttaacccaaatccagaagcaatgtcaaagatcgtaactgaaaattccagtgaggagttcttgtattcattgagtaactactgtgctcttcaggtaaactgaagaatattttcagtatattcacctcagtgaaaatgaataaatatgcatgaaatataatccattcaatttatctaataacaatggtgaattatctccaagctattggaatataggaccaaggcgtgaacttctacacttgatagatcttcatattctttaaccccagtaatccactgcttgttatcttagtgcacaccttattgcatccagggttttgttgaggaccaatttggccttgggttgattgctcgggctgttgaagaagggatatcagtcataaagcctatgggtattatgatatttaacatgggtggtcgaccaggacaaggtgtctgcgaacgactatttcgacgccgtggatttcggatcacaaaactgtggcaaacaaaaattatgcaggtagtgatgctgttatgaatcagatgctggtattatgcaggtgtctttcatgctgacattatgggctggtttggtcaagaaattgtactttatgtttcacaatatcttttactaggcctagacttttcatcgatgagtttatgcttttacatcacatgtccattttatttaccatcgttagtcatattactaactagttgggttaattgcaggctgctgacacagatatttcagctttagtggaaattgagaaaaatagccggcatcgctttgagtttttcatggatcttgttggggatcagcctgtctgtgcacgcacagcttgggcatacatgaaatctggtggtcgtatttcacatgctttgtcagtgtatagctgtcaacttcgccaacccaaccaggttccttgtgtattctttagatttctaaaagcaatgtaatgacaggaaaaatactaattcatataactttcaggtgaagaaaatatttgagtttcttaaagatgggttccatgaagtcagcagctccctggatttgtcttttgatgatgattctgttgctgacgaaaaaatacccttcctagcatacctagctagttttttgaaggagaataaatacaatccttgtgaaccaccagctggttgtctaaacttccggaatcttgttgctggatttatgaagagctaccaccatatcccattaactcctgatgtaagacttggtgtctgttatagttatagttacattcactcattagaaattaaaataattgatattttttatcgtcctccagaatgttgttgttttcccttcccgtgctgtggcaatagaaaatgctcttcgattattctcaccagcgcttgcgatcgttgatgaacatctgaccagacacttgccaaagcaatggttaacttctttagcaattgaggtaccttaatttctctcttttctgtgagtgagtcttgtgcacattgaccagaatttgtttggcgcatctgagctctactttagtagtctctgtcatcttctttttctttgttttactttcttttgttttaaaaatatctttttcataaggaaaagtggagaagaaagtatggacaagactcataagacactcattctattatagaatgcaataatgttgatgctgctacctccttttgaatttcagggaaaagccaaagatacagttactgtaattgaggcaccacgccaatctgatttgttgattgagttgatcaggaaactgaagcctcaggtggttgttactggcatggctcagtttgaggctatcacaagtgctgcttttgagaacttattaagtgtaacgaaggatgttggttctcggttattcatcgatatttcagagcatctggagttgtctagtttgccaagctctaatggtgtattaaaataccttgctggaaagaccctaccttcccatgcagctatactatgcggtttagtaaagaatcaggtgcctgtaactattgcagcagctaattttaattgagtgagcttaaatttctctactatattgttttcttttcaattgctttatcttattttggattaaatccttgcaggtttattctgatctggaggttgcttttgccatttctgaagatgcagctgtttatagggcattatcacaaactattgagctattggaagggcatacgtctcagatcagccagcactattatggttgtcttttccatgagctactggcatttcaaattgctgatcggcatccacaacaagaagtaaacatgacttgtctcttattcttaatctcacgcatccttatggtgatcttggatatgtaatggcagaaaccagctacttcttaatttatgaattggtcttcctttgttggataaaacacactatagtaaacagctaaattttttagaagagtttgatgtgttttttacttattttatcttatgtctaattataagcgaagttaataattttccagtggactatttttgtgaacttaaagtatcttttttggtttgtggtctttatttttttttcttgctctttttcagagactgcctgcagaagtgatacctcagaagatgataggattttcaagttcagctatgtctaccctaaaagaagctgaatttttcattcctgactccaaaaaatccagtgtcattcatatggatttagatcgcagcttcttgccagtgccttctgcagtgaatgcctccatttttgaaagttttgttaggcagaacattactgagtctgaaactgatgtccgttccagcattcagcagctggtgaaagatagctatggtttcccagcagatggttgttctgaaatattatatggcaacacctgtcttgcactcttcaacaagcttgccctttgctgcatccaagaccagggcaccttacttttccccttgggcgctaatggtcactatgtctcagcagcaaagtttgtgaatgcaaatacgctgactattccgacaaagttagaatcaggcttcaagattgaaccacgggttctagctgacacacttgagacagtatctaggccatgggtttatatttctggccccacaattaaccctactggtttcctgtacaggacagtgatattcaagagctcctttctgtttgtggtaaatatggagctagggtagtaatagatacctccttctctggtctggaattccaaactgatggctggagtcgatggaatttggaaagatgtctttctgctgtgaattgtccaaaaccctcgttctctgtagctcttctcggagaactgtcctttgagctgactgctgcagggcatgactttgggtttctgattttgaatgactcatccttggttgacacatttcacagtttcccaagcttgagtcgtccccacagtacgctgaagtacactttcaaaaaactactgggcctcaagaatcagaaggatgaacacttctccaatctcattatggagcagaaggacacactaaagagtcgtgctgaccacttgataaaggttaccttctcataacattctgaatgatacttccaattaagctttcattcacaattctgatccctttggaagtaagatcaacggcagggcttaaaatatgaaattagtaactttatgtttccatgatattatattcaaaaactagctagacctatcttgggacattgaaatgatctggctagaatttgctaggcatactttgcacaatgctgcaacttactagacatactagactctgagattttttttttttgactgaaagactctgagatttttgcagctacgtatggcggtttcttcatctctctgttttttttgctatgaacagacacttgagggctgtggctgggatgttgctggcagtcatggtggcatatcgatgctggcgaaaccgactgcctacatcggcaaaataatcaaggtggatggttttgatggcaagctagatggc

SEQ ID NO: 48188 - DNA, 5595 bp, Oryza sativa
tcgtcgtggaaactgaatcctgaagaaatgtagccactacatacatattattatccattgttagcctgtcctgttcggggctgattgaacatttttgtgcttagaaaaagaataatgagcacaggaaggctggtatgaatgtagtagcaaactggaattaagtctgaacgacgtattggcatggcatatttctccagaagatgatgcttcttttattttctgctatctttatgcttacgtttcatccatatttatccctactcgttaagatggcaccacaaatatgcggatgagattattgtatttcctttatggtagtattattatcacttttttctttaataatacgaaatatcctgatgtaagtttgctgccttctttttttagtaatcacaaaaataaaatgtctaaacaaaaattccatggcattgatttattgatttaaaaaaggaacaacttttccttagactagtaatatctagtaacaaacaaactttagaaaagcataaatacatgaccgtgttaccttttagatatatatttaattatttgtttcattaaaaattgttgtacaaatatgaaaaatgtaaatcataatcaaagtttttttataacaaaacgatatgcaagaaaataaataataataacatatttttaaataagacatggttaaatatatgttacatattaacattgtcgtgtattgaagaaaaagaaaacaataatacttaggttaaaatatgtgaaaaatcaaaggcattatatattttaaaaaacaaacaaaggagtgtaatcaagcctggtttagttccctaaattttttttcaaaaatatcacatcgaatctttggacacatgtatggagcattaaaaatagattaaaaaaactaattgcatagttaggggggaaatcacaagatgaatcttttgagcctgattagtccctgattaaccataaatgctacagtaacccacatatgctaatgacggattaattaggctcaaaatattcgtcttgcggtttccagctgagttatgaaatttgtttttttcattcgtgtccgaaaacttcttccgatatccgatcaaacattcaatgtaatacctaaaaattttctttttgcgaactacacatgccctcaatggccgaaccaactcctagattggttaggcggtagtctagtctgagctttttgtcgccaggcttggatgtggccgttagggggtgtttgggagagagagaccctaaggacttattttttttagagctcccaacccccccccccagttgtatcattggctaggtaggggttgtttggttgttgcttaagattgacatgactcgcttgccagaagtgtgacataacacacataacatagtccacacaagtatatcaatgtttggctagagaataagacctcatccttttccttttgcatatgcttagcggccaaaatttaaaattgtaatcttgaatttagagctgattttgaggttttttcgtcgaagtttatttttcagcctttgtttttaaattgctataagaacacatatataaatattttattcataaattattttttatttgtaaatatgtcgtttagtatgatatgtgagcccatggagcaccaattcgtggccttccaaaattaaaataagcaaccaaacattgcgacatggctaacgtataatgtgtgatcatgtagcaatatgtggcactcaacaagataggacggtaggattacttgttgggatggatcgtctcctttttttggtccttggggatgacgcgttctcagattacatacaactccaagttccaatcaatttcttaaagaaaagaaaaaggaggaagaagtgttcaaaccgaagcaaaacgggaaggaaaaccaaccaaatccaagaagctgcttctatggcgacggcggcggatggcgtggcggtagcgaggcaagcggagctccggcggatcgagggcaactcctgcttcaacaaggcccgcctcggcgccgccatcgactgctacaccgaggcaacctccctctttcccctccccctccccaatccctagctccccctttccctttccttttttcaatctttggcaaccgatatgattaactccacgatctccaggctatcgctctttgccccgacgtcgccgtctactggctcaaccggggcctctgccatttcaagcgcaagtatttctctcccttgtttcttcccctccctcactatctctttcttgggggaaaaaacttgattcttttttaatgtgatacagggaatgggctaaggtcgaagaggatagcaggagagctcttgcccttgatgacactctggtcaaggtaacatcatctcaatgtcccttgttcatacataaatcaagtgattgttaccaggtcttcaactttggtccagggtcactatttgctgggatgtgccatgcttgagaaggaacaatgtgctcttgctatcaaggaattcaacaaggtttgttattatacttctatggcccttgtaagtttgcttcagcttcttctgaatcatatcctgagctcttcaccatgttattgtttaggacaaatcttaacataaacaaagaattttggaattgagaaatagcttaaatgactttgtttcccttcattttactacattggaaaggatggctcatttatttgtgaaaggggtagaatttttttggctggggcaatcatggaagaaaagatgaaaaaaaaaagcctaaagtgacttgcatttacaaaaggcttgagaagactaatactacttacatttggaatcgaaggggatatttactaatgaatgctaatgttgtgtcttcacgcacctacatattgatattttgttgctacattcatgttgaaatgggatgttgatctcttgccatgctattgctaataccatgcttatgttatcatgtaaaacaggctttggatcttcttaagtcttcgaatttgggggacaaaatggcggaggacatttggcaggttcttgcgaaggcaaaataccaagattgggaaatacactccactaagagagtttggaagatgcaaagtttaaagtatgttatgcatgaaaaataattgcaataataatgttccataattgtgttgcagattaactgtagtgtgaatcttgggtattggtggccaatttactcctataacaacctggacactccctttattatctaaaatttatgatgctttaaactttctaacaccactgtgtcacatggacaattagggaagcatgtgaaaatgctttgcaggagcaccactttcttagtggcacacttgtgggagatggctcaaccaatgagtatacagaccaactgaaattgttatcagaagtcttcaccaaagctacaatcgacgatacaccaacagatgtaatattattatctatgttatctcatgttcaacatctttgtgctagcatattttttttctctgtgatcttaggctgttgctacctgaaaatctaggtgcctgactacctttgctgccaaataacctttgagatttttagagatccagtgatcacacccagtggtataacgtatgagaggtccataatccttgaacatctttgcaaggtacacctcccttgctaatttgctatctgtttttcagaaggtttttggctctgcatatctttagatgttgttgctaatatttcactagaaggaccatgtattagctggctacatctacaaataatgtctccaacagatgaaatacttgattgtataattaaaaagaataagtcaaaatcgaactagtttttttttttgaaaggaacacagcagggaggcccaaaaaaatcgaactagtggaatatttgaatcagcacaatgctgcaatatttaaatatgaaactgctgtagttcatatattgggtggattatgtgtcaatgatctaatttaagctatagtaggattcaatctaaacacaaactataatttaaattgaaattaaatgagaataatgtgctcagtcactgcaatcttccttttgggttttaggtgggcaatttcgacccggtgacacgagagcctctgaaagagcatcaattggttcctaacctggctataaaggaagcagtccaagcctacctcaagaatcacagttgggcctacaagttgaactgatgatgttgctctgtagttgcttagtgctaacaacaggtgttgataaaatgttgggttgtcaagggggaattctttgcttttctgatgtaatgtataagcaagttcattcgtgccctcatggaattgattgattcttgggcaacttctgacgaaccttggacaattgtacataaaacatcatagcagaaccttggacggtttcagacataccgtgccaaaatgacaattctcagtgacaaattattcttttgttcggtaattcactgttacagcaaccagcgaatttaacatgcgtgatactagtaaataccatttgcaactgatgaataatatgaattgaatacttcactagtacatgttttgtttctcccttgtcaatagcaaacatgtaggttgtatgttattttgggttcggattgcctctctgttacccgaaggattcaatggccagaatgggatatctgaagagtaggctgtctggtgagtgacatcaggaagatcagtgtcgcttgtacttttagagtaagactaataatacagccgacctgttggctataaagttctttgtagtcttctttcagcctgtctatataatagttactccatccgtttcacaatagcattttccacattcatattgatgttaatgaatctagacatatatatctatttagattcattaacatcaatataaatgtggaaaatgttagaataacttacattgtgaaatggaggaagtagctatttacaattaatacatggtccacttgtctctctcacagagtttattggttcttgtgtccaaaccggctgtaagtttacagcccgcttctcctctctctcctccacctcagcatttagccggcttatagcctactattatacttgctcttatggatgttaatcgcttgtacttggtggcacgcactttagttcgtctgtctcagcctaagagcaagtataataatgagctataagtgtactataagcttatgtggaggagagaggtagaaaaaaacaagggtgttggctctcatgcaagagctagcttaacacaatctccaagacaaatacattaaatgtataagtgagagatagagagcggagaagaaaattgtagccaaccttatagctaattattatatatattgactttaagatgaactaatagtaggaagtgagctatactattattatcttactctaatagctatctactgtcactcgggagtttattcgtgagatcctctgtattgatgctacttaatcaatgaagtgccatcgttatcttttttttttaaaaaaagtgtgcaaacatgtaggagccctattggttactcatatgtaaaaagaataaattaaagttaaaatttgaattttaaaactcaattttaaattttattttaagattttt

SEQ ID NO: 48189 - DNA, 959 bp, Oryza sativa
ttccttccgccgccgccgaagcagaagaggaagaagagagaagaaagaagcattggcgatggctgcggcggagggccccgttctcctcttcccctctacctcgtcgacgtccgcccgggtggaggcggtcgtcgtgttcaacatctgcgacagctacgtgcgccgccccgaccaggcggagcgcgtcatcggcaccctcctcggctccgtcctccccgacggcaccgtccatgtccgcaactcctacgtcgtcccccacaacgagtcccccgaccaggtaaactataaatatctctcttctccttccgcccggcatcatcagatctagggttttacttcttcttccattgattccctgaacttgcctttctaatgttaaggttgctctcgacatcgagtaccaccacaacatgtatgcgtcgcaccacaaggtcaaccccaaggaagtcattgttggatggtaaaccctcttcttttcttctcttctcctattctcccctcattggtgatgatgtaccactatgatattgcttctgtccctgctagtagttagtacaacattaagagttaactagtttgagtggattaacttgtccaatcatgctcaatacacacacacacagcacagcacatctaaatctcactggttctgttaggtttgatatcagctagaacaatcgcaatgatttccctgttactcatgattctctgtcctgtttttacctagtgctgtgcgacaattaacagtacccagcaatgcaaacttagagttgctgttataactgtaatttgttttctttcagagtaggaaagaaacatttcaaaaaatgaatgagcagtaatacagtacatctgtatgcaggttctcgactggcttcggtgtttctggggaagtacgcttatccatgatttttagtcaagagaagtacagagccccattcatctcactgttgacactg

SEQ ID NO: 48190 - DNA, 1291 bp, Oryza sativa
caatctcagcatagttatactgattggcacgatcatttacagcatgctcacttgcatgtgcagcaatcctaccattctcttcttgaccatgttcaggatgctgagtttttagatgaaggttcaatttgtaactgtgaatgtaggctttcccacaaccatcatatgggcagacatatggtcgctcagcaaagcttgtgggtgctggtgttgtaggcttagttgatgcaggtgttgtcgtcttcgttgctgctggtgttgtaggcttagttgttgctggtgtcgcaggcttactgctgctttgtggtttatctgatgatggcacatattgtgctgtgatcggagttccagtctgcatcatggccacattgagcgcattatgtaaatcagagggagtacataaaaattctacaaaccattgtaaattttgtgatgcaacacaataggtgatttgaaaaagattttctagttgcattttattataatatatcagtatggcattaacccgagactacattttgctgctgcaactgtattttattataatatatcagaacaacaatgagcatgcattctgaacaagtacactgggggagcaggcagtttcgtgttgtaatacttttctttgaaaaatagctatgagaatctttaccagtttcaatttaattatttctgatatggcttctataatgagatttcaagctagtcgttacatataaaaacaattgaaaaaacagcaaatggaagtcagtgcaccatagagcataccttttcatggcccttgacatgggattttaatttggagtcactcgtaaatcttttgccacatgctggaaatgggcatacatgatagttttccaacgcatgcgtttttagatgcgaacgcaggttaaaatccaatgagaaggcctgaaattcacaggatttctttgtaagaacatgaagatgcactgcaacatggtcaaaggattcactaattaaaaggcctgagaatttatgctacatttcttctcaaatcagccacttgtgggtgtgcatatgttgtctccaaattttgcaataatgtagacagcatgtcagtgtacaaacaaacaacagaccggaaggactagggtaaatttccataaagcagctcaagtgttcaactaatcagatcaggggaaagtattcaatcaggtagagttaacatgaaatcacatacaggtttgcacctttaacacaacatatgctaaggttagctttgattactatggaaaaaaaaagtaaaagaacaagtagtatgtggagaagtaaa

SEQ ID NO: 48191 - DNA, 957 bp, Oryza sativa
cgcacgcacaaggaaagaaagaaatcgattgaaacaagacaagcacaagtaatgtaatgctgcaatgtggtaaagaaaatttgggggaaaattaaaggaagagaagagaagattacccctgacccacttgtagagggcgcatttgccggaggaggtggcgagatcctgcgggatcctgcaatgcaaaaccaaccacatgatatgatgagtagaagaacatcaatcatcgagaagaaaggcgtagcgtggataccataccagtgcttgacccagcgggcggcgggccgcgggggacggcgaggcttgtgctgctgcgacggcgggtagtagtagtagccccctgcccctgcccctgccggcgccgcgtactccatcgagatgacgagtgaatgccgccgatccgatccgccgccggcgaacccttctcctcctttctctctctaggcggcctagggtttttcttttcttttcttttctttttttgttcagcggtgggcgtgccggaaaagagagagagaggggaggtaaatgctcttgatttttgtttgggccgaaacaacaacattccttttcttctagccccttcttccttctctgtgatgataatggtgttgtatttctttttcttttcttttttacgattacaatgcatacatatatgcgcgcgcatactatactatatactatatatagataacaccacactcacattctcacgaatatgcttcctaatacattctctaagagcctgtttaggtcaatttgctgtggtatttttttttttgcaaaagattgatattgaagttttgctagttggtgtttagatgcatggtaaagtgttggcattttactagtaaagagagaaagagagagcacggctctaaacgtactttttggcaaaatttgctactatagacttctaaatgataaatgccaaattgctaacttttgctacag

SEQ ID NO: 48192 - DNA, 5022 bp, Oryza sativa
aaaaaaaaactttatagtactataattaccatatttgtatgtatcttggtttgacccatagcatagagggccccattgactctcctaccacaccttttcttttgggtgcctagggaagttgcctagttgcacatgtaattttatactccctccatctctaaatgtttgacgccgtgactttttttaaatatctttgaccattcatctcatccaaaaacttttatgaaatatgtaaaactatatgtatatataaaagtatatttaacaatctgacatttattacaaaattaattaatagacacttaaatttttgaataagacgaacggtcaaacatgtttaaaaaagtcaacggcgtcaaacatttagggatggagggagtagcttatagtttccatcatgaattatcattttattgtcaataatgttcgaataattccatttcaattttcttatatcattttcagttttcactttaacctttttgataggtttccaagaaaatcactattctactctgctcccctacatatatattcatatgcacgcaaacaagagttttaatcaaacagaattatgaaagtttctaattcggctaaattcattgacatggtcacatggcaactcaaaactccgtccctgaccatggcaactcaaaactccgtccctcgaaacatcgtaaacagatactcataaaggaagttgtttaggacaatgtttgactcaaaccttaggaatataaatcataaataatcctcaagttgttgagttttaaaatataaaaattatatgaatagatttgtcttgaaaaacactttcataaaaatatacatatatcacttttcaataaacatttttatagaaacaagaagttaaagttgtgttttggaaaccgtgtcgctgtcctaaatgacttcctttatgagtatggagggaggactacaacataatttagcacttcaaacacacaactgaaagaagaatcaaaagatcagaacagacttaaaactaagtctagcttgtttgtttgcttatttatttattcattcattattaatcacatctcggacggcctggtaccgattattacttcaaaaattcaaataataaatacaacaacccacaatagcttgaatacagacaatgagtataaacacagacaagaccaagcagtctataagaagaaattaacacttggaatagaatacaatggtgaaccgtgtcttgttctcccaaaaccctctaatccgctcgagattggcccgcacgagagaagaggatgataccaacaatcaggccatacagagcaagagcttctgcaaagataaggatgaggatcatgcccacgaacaactttggctgctgcgcattggccctgcagaggaggtaaaccagaaccaaatgtcaatttcctgcaaacaagagtgctttacttacaatagtaacagatagaaagaaactctatctgctattttgctcttgatcccagtttgatttgaatagatctcaatagtctgtactcaggactacaacatagatatgctgatgtaaaaaggggcaatgtgaatcctccttgactttataacagttaaatggtagcgatggtatatatgaatcaaagcagtatgggtgttgcaccgtaaatcatagaagataggagttgtaactcttgtaatcattatccacaaaattcaaggggcagtaaagtttctaaaagaagctaactttcacttgtaggcaaataggcaatcgaaaagggttatcaggatcctacgacacacaacccatgttccggagtgcccccaagacagatgcctagcacatatactcctgtggagaatatccagcctaatatttcaatagctacaaccgaactgataccataggaagaaccatgaatgacgaaccacccatacccagtctgaaatcacatctaaaagacattctacaattcggtgtgaatgtagcactagcatgccaagatatgtaatggcaacaatgctgtcgcttgcccaatccctgtaattacccttgtaatgtgacctcttatcaatggaaaattcaggtgggggaacctctcccctctggtgattatccaaaaaaaaaaaaaaaaacactagcatgcccattgtctgtcatgcatgctaggatgcccaattgaggaagttataagccaacgtacaggttgaggcacaacattgtagtgtaaatttgaagtttcagcagataaaaaaagagaggaattcttgttctgatcaaagactccaccagcatctagcaatcaacaaagaatgtagtcgcatgctattactctaatagttcagtcatcaggattcggattagtaaaatgtgggcaggctaacagcaattgaaagcttaataataataactactcccttgttgtaattagtagtagtagatgggactgaggaggggaatgagagggagggtacctgactccggcgtcgccgacgatgccgatggccatgccggcggcgagaccggcgaggccgcaggcgagaccggaggagaggtgggcgtaaccgtcgaagaggaagtagggcttggccttggggttgatgccggtggagatgatgacggcgatgatgaggccgtagataccgagcactccggccatgacgacggggacgatggacttcatcaccagttccgggcgcatcacccccatggacgccacgcccacgccgctcttggcggtgccgtaggcggcgcccatgccttgcatgcgtcgtgtgtcaacctcatctcagatcagatctggccccgagaaagtgaaggggaagattgggagcttacaggagaatacgagggcggaggcggcgccgaggaagccgaagaaaggggcggtctcatcgccgctgaaggtggaggaggacatggtggtcgctcgccgtcgtcggtgagggtgggatctctctcgccggccgccggaggccggaggagtcagagattggtattggtgccgtatctcgttgcctcgtcaacgtgtgtggacctcacttcatttatatttacttgctctcttcatattacaatcactttaattttttttataatcaaacatttttaagtttaattaagtttataaaaaaatataataatattttcaacacagaataaacgtattatatatttgtctaactctaaaactttttgggcctgttttgatctggcaacacagcccaaagagattccacgtcttgaaattcctatacattagcaaatgtgaagccaacaccattgacaaattccagcacatacaaaagcattgaatatgaaagtatatgctaccatctctattcctacaacaaaacaactaaccatcaccacgaaaaagttagcgactcaagccttaaagcgtgtcactggcttgatcatcgacaacccgacatacaaatcttactagtttttcaccgagaacctcaataaggtaactagaataaataaatagaagaaacaaaagactacacatctgatccatgaaaaatttgaaagacaaaccctagacaacctaatagacctaattctataggaacttaaataaagataaaaaaaacttgggaaagattggatcctactactggagacggagggtgaaggtgatcggatagaaactgtgcgatggaggtttagagcgccctgacggacacgagcgcctgtgagccggttactatatgctaatacctcattgatcttttggtaaaaacatagcatggagtatatttgtaagagaaaagtttgaatcttaggacattaatttcactataaacatttctattaaattcatgacaattatatgcatagaactttcctaaaaaaagtttcataatattataattttatcagaatttctacagagaaaaaatagttattaaaacaacctttgagacggattaaacttatatttcaaaaacattgtaaatatctgaaacaatttctcttaaccggaaacaagtaaatgaattaagagtcgtgaggtttcgtgggctcatgggccatcatcatgatagcacagccaattttcacaccaagcatctcaattcccaatttcgcaaagtacactgtgtcgaaattggttgaacagaagcacacagcaaacagcccgacatagctcttattactgttcattgacaagataagcccgatgagcccggcagatactagatcaactaggtgaagtgtacaaagaaaaaggttttacgatattgaaagtgtaatatataggccaattatatgcattaattacaatggggtcaattcagtgagagagccaacagacaagctttcatttcagttgacccaaattaactttctgcaaacaacctaaataagaattactatgagattttacattgttgtccatatgattcacagaatagtcccaacagtaaattcaggcaaattcgctggccatttttgaattcagggttaacgctgccatctttgaaattcaggctaaaaaataatgagaactcggggaaatcaggaaagaaaatgtagaaagtattctgcagcaacattaatgttttcgtccactgctcttcatcgtggagtgcccatgcaattaatttgttgctgcccaatttgcatccaaacgccaccgtacaactgtcaatttgatcgtggtgctacactataccactagtagtatcaatttgcatgaaaattatccatatcgtactatagtgcgcctgcctttggattggaggagacaacatatgcagccaataagcaatttgtgggaaaagaggcaccccactacccatgcattcaaccatagtatatatgcattcacttgccaaattgctagctaggactacgcgccctttgaatttgcatagcttacattaattatattatctaccaaataatgtaggatcatcaaaggctacctagctagtagagaacaacaagatgcacaagcataaatggacaattttggatagtttttttagaacagactattttggatagatggatatgcataagcatataattgataa

SEQ ID NO: 48193 - DNA, 1134 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggccctgc

SEQ ID NO: 48194 - DNA, 3162 bp, Oryza sativa
caatggtgatagggagatggctgctgcattctatgctgctggattcgaaccatgggatatcacaatgtcagacctcttagctgggaagtcttctctagaggattaccgtgggattgcgtttgtcggtggttttagctatgcagatgttcttgattcagctaaaggttgggctgcatcaatcaggtttaaccaacccctcatacagcagttccagaatttctacaataggccggacactttcagccttggggtgtgcaatggttgtcagctaatggctcttcttggctgggtaccaggatcagacgttggaggttctcttggttcaggtggggacatgtcccagccaagatttattcacaatgaatctggtcgttttgagtgccggtttactagtgtctctataggggcctctcctgctatcatgttcaaaggaatggaaggttctacaatgggcatttggagtgctcacggtgaggggagagctttcttcccagatgaaaatgttctagctagtgttgtaaagtctaacctggctcctgtgcggtactgtgacgatgctaataacataactgaagtctacccattcaatcccaatggctctccacttggcattgcagccctttgctcccctgatggaagacatcttgctatgatgccacacccagagcgttgcttcatgatgtggcaatatccatggtctcccaaggattggcagcttgagaagagtggtcccagcccctggctgcgcatgttccagaatgctagagaatggtgttcataatgcaggtacagcagacttgaattcagttcttaagcataaggttttccttgctgaactcagtttcagtttaatacagccctagcgagctgcaagttaactgaaactacatgccactgttacattcaacattgctatcttcatcaaattactatctgccgctgtttattcaacattgctgtcttcatcaaatggcatgcgtagtgatttatgctactaattaatcatgatttgtatgtgctatgagtcatttgtctggcatggcaatatatgtgttagatatcctgagtctttgattctataatacactgttctgttcctgtttccaactcaagaaaacttcagtacattggtggctggtgctaggaatgaagtaccaaatgacatccaattttactttgttttttcagttgtgtaacataccgggacctaattgatggtcatatgatgacagaagcttggagctatggactcttttggatacttaaaccttgctggttcgatgcactcagcagtcagcattgttgttaccgaggatcgaataagtgggttcatcgaaataattaaaagcagattctgtgattcttgcttgcagctttgagttttgctgctggtttgaaactaggaatcctgtaagggtagtagtgttttattaggcagaggcgaggaggcctcaggcctgcaatatgctggtaatgagaataatcatgttggcgctgcagtgctgctttgggaattctttgactagcagaagaggatacatgcccgtaattaaatgtaatgtgttgttcgattatccggtgatactaaatgtcatctttcttctgtggctatccttttcaggttctgctattggatgcgcagcaatttgcagtcctgctgttgatgaaccgtattgtcgaaggtaatatgggattatggattgttgattttacaggtgtagatttacatttgattgtacgcttgtttaccggttactgtcagtggcttttgggggttttgtgttgttgtttgaccacccaacccaacaccaagaggtttcatttcaccgtgcgatcgatacatatggggatagacacaagagaattggagaagtcaaaaagttttttaagcatttgggatgaattagtaatagaacttgtgtgctgagttgtttcagggactaaatatcttgtgtgctggattgtcgtgcacttgtgttcaaataatgcaggtagaagtagaacaaggcacttggggcaggaggacacaaatcgtagaatgcgtcgtttgattgttttgttcaaagcggttggcgccaaactccttccatctgaacaactcgccaatctgattactcccctctccgtctacatatatatacccccacacccacatcgttcaagataagctgagacaaaatcgatcggaggtcgaaatggtgcgcgccatcgggcccctgctcctgctcgcccacgtgctcgtgttcgtggtgtccattgcggcggcggcggcgcccgtgcgacggccacgctgcgacgccggcgaccgcgccgcgctactcgccgtgaaggcggccttcaacaacgcgtcctacttccagtcctggacgcccgacatcgcctgctgcactggtacggcgtcgactgcggcggcgacgactacgactacgaccccaccgacggcgaccgcgtcctcagcctcgccatcatacgcgatgacaacgtcaccggcggcataccaggcgacgccatcgcccgcctcacccgcctccaggagctcatgttcttcaaggtccccggcgtcaccggccccatccccgccgcgctcgccacgctcaccgccctcagggagctcaccatctcccgcaccgccctctccggctccatcccttccttcatcggcgacaagttcaccgcgctccagtctctcgacctctccttcaactcgctcaccggcgccatcccggcgagcctcgccaagcccccgaagctcatctccatcgacctcagccgcaaccagctcaccgggagcatcccgcggctgctgctgagcaaggccgggcagcaagcgttcctgacgctgtcacacaacaacctgtccgggaggatcccggcggcgttcggcgccgtcaacttcgtgcagatcgacctgtcgcgaaaccagctcaccggcgacgcgtcgatgctgttcgggtcggggaagaaggagctcggcagcgtctacctgtcgcgcaacgcgctgagcttcgacatgtcggagctgcggctgccggagcggctgagcttcctggacgtgagccacaacgccatccgcggcggcatcccggcgcaggtggagaatctgagcaacctgcagctgctcaacgtcagctacaacaggatgtgcggcgaggtgcccaccgg

SEQ ID NO: 48195 - DNA, 1491 bp, Oryza sativa
  unsure (1)..(1491): unsure at all n locations
acatgtcggagctgcggctgccggagcggctgagcttcctggacgtgagccacaacgccatccgcggcggcatcccggcgcaggtggcgaatctgagcaacctgcagctgctcaacgtcagctacaacaggatgtgcggcgaggtgcccacnnnnnnnnnnnnnnnnnnnnnnnnnnnnnnnnnnnnnnagcacaacaagtgcctctgcggtgcgccgctcgccgcctgccattgatgtttgatccagaccttgaaactgtaaccactactgtactgtagtaataatcactgagcaataccaaaaactataggataaattaatgaagaagcaaccagctaatgctaataattaaggtccattcttgatgaacatgagtgaaatttagtgtcaatcaatcttttgagtgtatgtccatactgatactttgagctgagcagccagcctggtggcaaagcaaagtccatctttggtcagcatgcatgcagatgcagatggaggtgcagcatactatatttgacttcaattttgacctcctcacttgtgctttggttgatcttttgcaaattaatttccaatgacagtgctaatcctcctaaccaaactcaataattcgatcagattagctagccccatgaatatatagccagtcccatggccatggaaatggaaatgctgcttgctaagaataagatgctcctcctcatgctctccactctcctcgtcgccgccgcctcgaagcaatgccaccccagcgacagggcggcaaccacctctcccggagcatcagcatcccggcggagttcgccgccgtcaacttggcgcgcatcgacctgtcagctcaccggcggcgctgttcgatcgggcgagggaaggccgcgcaggccatcgacgtgtcgcgcaacgcgttggagttggagttggagctgccggagcaggtggtcaccgtggacgtgagccacaacatgcatcatctacggcgacgaagctgagcaggctgcaggtgttcaacgtcagcctctgcggcgaggtgccgacgggcgtggcgagcttcgacggcgacgtacgtgtacagcctgcagcacaacgagtgcctctgtggacctccgcttgcgccctgccattcaccaccaataatcgagcttgctgattgagaatacgatctatctttaattgaaccacatgggattacaaaatctttataaaatatcactgccaagtactagtgctttgattgggattttggtcgtgtttagttcctcctccaaaattttccaaaatttttacatatacgaacgcacatttaaagtattaaatatagaataataacaaaacaaattgcagattccacctgtaaactgcgagacgaatttattaagcctaattaatccgtcattagcaaatatttaatgtagcaccatatcgtcaaatcatggcgtaattacgctcaaaagattcgtctcgcaatttacatgcaaactgtgcaattggt

SEQ ID NO: 48196 - DNA, 724 bp, Oryza sativa
  unsure (1)..(724): unsure at all n locations
ttgacaagcttttcaatgacaggattcaggttagtgctttagcttgtcggtatgcgagtaaatgaatatcattttcaattttcttgtacataatcattgcaccatttggtgatgcaggataatcttgcactggtgtacctgtcaagcatcacaaggacacagattagcataccgagaagttgaacaccgccgcccaaatcctgtaatttccatgtagttggagcatctgggagtctgacttaaaatgctgttttgtttgtttttcattcgcacgactgaaaaattgggatatgatggcagagtatgcatttttgtacttgttatctgaggcctaaagaaaagaaaccatcatgtttcagatgataatgtttgtgttggaggttgggtgcactcttggattagtatttcgatgtagtttaaatatttgtgttagcgctcttgcttgatttcctcgaggagcacttttggaaggtgcggtcaattttgttgtgccttcattttgaggcagagataaaccacccagatcatcattatatatcccggcgaatttgggctatcttttgggagtcacctgtagttaagttgtactcccactgtcctaaaacaacttaacctanaatgagatgtgattgtccagatagagtcacatcccatcctaggttgagttattttgtgacagagggagtaaatatgagatggagtttgtgaaataaggcatcattca

SEQ ID NO: 48197 - DNA, 14076 bp, Oryza sativa
gactttggcaggggaatttgatttgggaaggatttgaattcggaatttgaatttggcgatagatcggggattttagatccggaatggcacggagacttgacaacacacaaagagacgaatttcgcaatagggtttttagaatttaatttttcccgctaggcgccacgacggaacgggcgctgcacatcgcgccgtcgaccttctctacggcgggagggctcgggcgtctccgcctccctcaccgatgatgttaccgatgccacggatggggtcaaagatggcggcggtggccgatatggtcgaagacaaaggtggcaatggcggtggctcccaagccctcccgccatgaaggaggtagatgacagcccatcatgatagtctccctcaccgtcgtcaatctcctctgcggtgggagggttcgggcgccttcgcttccctcgccgatgatgtcaccgatgccgcggatggggtcaaagacggtggcggaggtctatggggtcgaagacaacggtggcgacaatggtggttcccgaaccctcctgtcgtgaaggaggtcgaaagacagcccgccacaaaggaggtcgatggtggtgtgacggcggtggcttccgagccctctcgccatggaggttgacgacggctgcggcagtggctcccaagccctcacgccatggatgggatcgacgatggtggcggctccaagccctcccagtggtggaggatgatgaccatcggagatagagtgaatagaggcaagggaaagaggtgaagaaaatggaactgatagttaagtcccatatacagttggggttaacggagatttttgacagaaaacgtgatggagtggcatggttctaattttccgaaatcccagtggcacgcagctgatatcataaatagtagtgacattttttttaatcagcatatttgtagtggcatggatcaccatgaagcgtgatcagctggacacctgggccaatcaacaggcggcccaagtagggtatgggagggtggggcgatgcgggctgtagctgggccagttgacccaccatgcccattgagcgctgctatacatacgaacttctgtttacgatggttgtacgatgaaactttgcactacgtggcgctggcgatgacgacgacatgcatcagaacgaggcaagtccacgttagccgtccgtttgatcgtaggaagatcgtactcaaaatgtcgtacgtatagtaattttcatgtccaatgggtggttccgccactggatccaattaacccaaatttaaaagtcaagattcaaaagacataaacaaagcccatatcgagaaaaggtcctcttcaccacatgcacaggtacgcaaccatgcaaaagcaggctgaaaaaaaaaagcatgaatgctaattcgtgtatacgcacgacaagcgccgagttagggttagggttttagagggatggcctagggaggcggtgggtggcggcgacgccgaagcggcgaggtcagcagcaggtggtgggccagtgttggtggcaggggcaaaacgaggtgaagaggagggctggtgttttcctcgttttccgtcggttgccgatgcctgaagaattcaagagaaaataactgaatatacctcctcaagactcaaagttaagatcatatggtagactagtcttatgatatgtatctgaagttctgaacttcttcttgacagagttctgatttctgaacctctgaagtctgaacacttgtatgaaatgatccaccggtgatgttcttttcagacttgatagttggaagtagctggctgcaaacctgtgtcatacgtagtctgaaactgaaagaaaggcaatcacatactcacacgtagtctgaacttctgatcgattatgcgaaatgaaggtaactggggaagttcaatgtcagtctgaactctgaaccaaagcaaagtaaatcatgtggaagatggataatgatatttcacactcaccactacaaatgatctcgcacacaacaggtaaaaatgaaccaagaatcacagatatgcacagctacattcaatcctatatgcaagcgtataatatatcaatggtgtgcaaataccagaagctatggtagtttactctgcaaaacgattgtaagtaccccctccgtttttgaagatgacactttgacttttgaacattcatcttactaaaaatattacataaatatcacttatttagttgtgtttcggtttatgagtaatcacactttaagtatgacttatatttttcatatttgcacattttctttagtttggacaaatggtcaaacatgtgtccaaaaatcaatggaatcatctattataaaccaaagtaaagtacattttatccaaaaaaaaaattggtagtctactttcatcgcattttcagatttgcctgaacattcattgaggaacctgatcagtaaccaggcaggcagcaagctggtgaagtttcagtattctagtttgatttcaccacaacatgagagctagttactattcagagcgaaatgaagtactagaaagtaacatcaatacttggctgaaatataggaacatgtacattgactgatggtcagacacataagtacattaatgttatgtatcataaatacataattcaaacttgagaagaatacatattcttcttagtttcttcagacagcaaagcaatagatcagcattgtagatcagtttcaccagaaagcgtgaaattcaacagaaattagtcatgattatgaaacatgaatacttttctaacataattgggcgcgccctgtacagaaactcagatacatatcataatgctagatgactctatcatgagatatcttcactcttaatttctaagattagtccttttttgtgggagttcttttccttcaattcttgtgtagaaaaacatcaggaacagcagctgggtcgagctcatagcagtcatggagctttccacctttctcttttgtgagacaaaacgatggtattcgatgagaaaacctcaggttctctttcacaggaatcttcagaattccccttcgtacatcaggcttgaacacagagatgtaaccatcaactttagtcagataaccaaataatgtgaaagcttcagtggagtcgacgatcttgccaatagcatacttagtaccacgagtgctgcgggaaggaacccacttatttgaccagttcttgtagatggcccagacctcacctatctttggatgaatttgaaccttgcactttgctccaatttgtttggtttctattaaatgggagaatgcacaattttcattaaactttgtttccatgttttggatttcaaatgtaccacagctcacaggtacatcatgctccaaccacagcttctcctgcgctcgttgagggcaagcctcaagccaggccaaatccacgttgaacggttccatctcaactttgcttacccaaccatagaagttgggaaatttatcagtatcactgtaaagagcccaaatctggccagcttcaaacttatcatgcgagcggtcttgttcgaagttgtagaattctgaatcagggcatacataactgattaattcgatatttgttttgttgtcaagagccatgtaggattcaagagtaatggaagtaaatgccgaatccaagtcacttggaagagctgcagtgtctagttccaggaacccttctgcaacacctaccctttcatttccgttcgttttatagaaggggatactgtgagaaaaatgaagtacctcacatgatgatatcgaaaaacatgactcgttcttcactttcgcaaatagactgacaaaccctgcaatcctgaccagcggtgaaaccgtgacaccatcatccattgagccactagaaaggacttgcacaatatcatacccatatgattgatatctatctgcatgagagctcaactgcatgctccatcctttataaagagcccacacctcacccatgttaggatttatatcacaggagttcccatttttgcctgtcgatgaaacactgtgggataagtaccttgatggattgtgcaatacatctgtttctcctaagcagaagttcccacaagcaaatggcagtttttcattggtcgatttggaattttgttcatttactgtgttgtgcaccagccaagtgaactgcactttgaggttggaaggatcgacatgatttattcaggcataagctctaggcatgcaatcatgaccttaatatactgcccagatctgatcaaccgcaatttgggacacatctctggacttgtcaaaatcaaagaagtctgtagaagagtaggcaatcacaggattggcagaattctgagaagaagtatcagtatcatctttcctatgactttgttgattgtctccatgtttttcatttccttcctcttcactgtccacttcggtggggacatgttgtttggcaaattgattctcagtaacagcaacatcatcattacatgtttgctcagtactccaatcagcatcagatggagaattatacttcattttcctctcaatattagagttcatagcacggttgctgtcagagctatcacagagctttctccgacccaatatctgaagactggatgatcctggagcatttgtctctgctgatacactttctccagtcaaattctgcacagcggtggagtttggatcaggactccttggtaccaaagttccgggtatatcgttgtcagcaggaggcacatgagatttagcttggctaatttctgaaaattgaactctgtcacttcttgtcaccaggcctttacctgccatgtcaccagcccagccatattgttttatggattcatcagtttcttcagcatctctggacttgcaaaaatcaaagtctggataagggtaggcaatcaccgaattgacagacttctgagaagcagtatcagtaacatttttcttacaagtttgttggttgcttccatgtcttgcatttctttcctcttcactgtccacttcgatgggaacattctgtccagtagattgattatcaggaacagcaacatcatcattacatatctgctcattactcgaatcagaatcggatggacaagtatacttcctttgcctcttaatattggagttcataccatggctgctgtcagaggtaacataaagctttctcttacccaatatctgaagactggatgattctgcagcattttcctctgcaggtgcactttctctagtcaaattcttaactgagatggacttaagatcagaactctttggtaccaaagttccaggcttatcattgtcaaaagcgcagatgtgagatttagtttgcttcattgctgaaaattgaatggcctcgcttcttgtaaccaagcatttaccttgttgatgctgattggggacactacttcgttgaaatgataacatttctgacgttgaaagctgagacttttttgcagcagttgataggattctcgagggaacagactgctcatgcagtttgattgcgaagaacctcttaccacaatcactgcagcgggccaaaaagttccgttggtagtacagaaatcgcttctgacaatgcggacatattgtccagaatacaagcacagaagcagatggtgtcatggatccagccacattgcttatgtttgaatcagtcttgtttggtggctgtgtagcctccttggccacttctcttgaagcacactgtcttttggtgtcatacagagacctcttcacatgatcactcaatattgcatgagcttctgaaacaaacctgaatgcggcttcggcaccaaacagagtattattatcaggatgaagccgatacgaaagtatgttgtattgccttcttattactgtttcgtctgccattttatccacctgaagaacaccataccaatccaactctccagagatctttgcctcagctgaagaaagaacttcacagataattaacagctgggagatgttctcaagctcaggaaaaagcctttgagctttaatcgcgatcttgcgggcgccgacaaagtctctattttccagcttctttacagcaatttctctggccctgaaggcctcctctctgttgcattccatcaaagtattccagaaatttgaccaagaaacccttcacatatacttgttccagaatggcattaacatgctctacctatcatgttatcaagaacaataaaatgtgagaagaactttcagtgcatcaggccctgcatgcatacaaaaggacatttttattaacagaagaaatatatatggcaaaattatgaatactctgggaaaaaaagaaatcacatttgggtatactcttgtagtcttattcacttgagaaaattgtaatttggaaaattgacatacagttccttcaaaacaaaaggcatccattttgaaatgttttttttttaaaaaaaactggatggcatctttccaaaccaccacattttgaagtggcatacatgcataaaaatctttaaaaaaattgcagaaaaagaaagaggggaaatatttcgatcctacttgatgtctactaccctagcctcctagggcacccaaatcaagagctctgcacgatcaaatctctggccattatcctcgcgaagaacacactaacccccgaaacgcaaaaccaaacctccgatccaaaaaaaaaaccctaacacgcacgcataacccggcttcagccaacctacccaagaaggggaagaccggaagaacaagggggcaatggaccgcaaatgcgtgaacggatggtacctccgagctgagctggggctggaacgtgatccgcggcggccggcgccggcgagccaccgtggtgggcggtgggcgtggttaggttcttggaggaagagcagaggcagaggtgaggtgagtgagtaggagactggtcgagttagacacgtgtcatgctgggaagtgaagtcttgagatcaaggacaggtgtctttttctaataggagtatatatttttttcattggccgtacttgtgagtatactgactgcctgcctgacgttttctatgattacttgtggatttaatagttgggtttcttctgcaataatttgtatcgtgaattcgtgatgtataattaagaaaagaaaagaatgtgactgagagaaaaaaaacgaatataattgagagaaaaaaaatgaagaactccctccgtcccaaaatataagtatttttaattttgatatagtttttgagatggtatgttaaacaacaatatctataaaagtaagatattttaaataaaaagagttgtatattatgatagtttgttgaatgataaatctaataacatcaaacttacatgattaatgtttttttgctattaataatcaaagctaaaaatgtttgacttggcactattctaaaaatgattgtattttgaaatggagggagtagtgtttactcatattcttccttatacttaacatgtatacgttatatctacgttgtaacaggctatgcccatatatgtagggataggttatagggtgatttggtataaaacattgatccgatggttatgggaggcggtgcgcacgggtcagtaccacatgtacattgtaacgggtcgggataacagaactaggaatgtgctatggggtgatttgagataaaaacattgatttggtggttgcctacattgtaacaggctatgcccatataagtagggataggttatagggtgatttgacataaaacattgatccggtggttatggaggcggtgcgcgcggttggaggataggaggacaatttcgctattaaggtagtagcaatattggaccaatataagccatctagagaaagggaattgtccatgctaaatgctaatacttatctctttcttgccgattaaataggccacgtatagtgacgagtgggtctaatggacgaatgttcacgcgcgaacacttaatttcggcccagcgcagatgtgtctagtccaacataaaaagctatttcagaaaattttgatatgcacaaacttttaattaaaaaatgaatgcaaatcgaacatataaacttctgtaataaatttacttaaaaatagaaactgtgcggtgccaaaacaataaaggaaaaaacatgtgtttggagtgtcgtctaagccgcacgcaaacatttattccctccgccccaacatataatcatttctagagtttggacacggttcttaagaaagtatgtagaattaaatagggaaatgttgtgattggatgaaatgtagaggtatgtagaaaaattaaatggtggagggttctgattagttgagaagagaatgttggtgtagaagttattatattttgggacaaattctagagactagaaattgttatattttgggacgggggggggggggggggggggggaatacatgatagtatttccggaccgcacactacacgtgctcaagaaataaagagaatgctctttgtttatgtgtagcagaaactcctatatataaaatttaatattccatatttcatttgtatagacctgtggtcattgtctgtctcactgtctgcatgaggaaactccttactgaatattgaatccactggtggagaaaccctttgtagtcccggttcgtaacccccctttagtcccggtttccaaaccgggagtaccaatccgggactaaagatcgctatctttagtcccgggtgaaataaccgggagtaaagatcaccaaccgggactaaagatggctcagccaccaaccgggactaaagatggctcagcacaccaaccgggactaaagatagagctgaccttttttttttttgcatgcccctgttgctgcatggtttatatatatatatatatatatataaaccatgcatatatatgtttcaatacatatatatgcatacatatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagcttagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctcttttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatacagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgttagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccatctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgcaacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagttgggttgagcgttccaccgtgagcatagtaccagaacttcgatcgttccggccaattggctgttgccggttcgatgcccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgctagtacaccgtactgacatgcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttctttattccagtactggctgcttccctccgcgattgtatcgtacaatatctgttcctcatcgcggtcagccatctgttgatacaagaaacatctgctaagtcacgagacatttatgttttaacaatctaattcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattacattgcattacaaatataacaatcatttatattattacgtcacttgcctgctccaattttccttctaggactagctcttccactcaggcttgacggacgactccgacaacacgtcttttctgcaagataaaaaaaatgtattaggataaatgcgaagtaacatatatatatatatatatacatgtatatatatatatacatgtatatatatatatacatgtatatatatatatattgcatttcacgttaacgttcgtcctcgttcgttcgctcgttcacgttccctagctcgttcacgttcgttcgatcgttctcgttctcgttcacgttgtcgcggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggcggtattgcgcgcgcggcggcgaaggcggcggcggcgtggcgtcagcggcgacggcgtggcgttggcatgcggcgacggcgttgcgcggcgtcgaagacggcggcgtcgaaggcgacggatagagatcgagatcgaagagatcgaaatgcat

SEQ ID NO: 48198 - DNA, 3660 bp, Oryza sativa
ccaaccgggagtaaagaaaagatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaacaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgagtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatatgtggcagttgttccatcgtttcccatggcatcgacacgaacagcgctgttttggttcgtgctcttcatgtcctgggctctcgtgtagaatgtgtacccattgatctcatatccctggaatgtcgcgatagacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctctgccttgctaagagtgtagctggcaggactcaagtaatggcttcttttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcaccgcgtgaccatcttcgctctctatatgctggcttccaggcccctttccgaacactactttaagatctttaaccatagcaaacactgttttcccgctgcgatgtttaggattcgtacggtggtcggccttatgttcgaagtgcttgcctttctgccgtaccgggtggtttgctgcaaggaatcgacgatgacccatgtatacaaccttcctacagtgcttaagatacgtactttctgtttcatccatacagtgagtgcaagccttgcaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccagtgcgaaccatcggcggggtgtctcagcatcccgtcctgttgacgctcttcagcgtgccatcgcaacattctagcattccccttgttcctgaacaaacgccttagccgtggtattataggaaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacat

SEQ ID NO: 48199 - DNA, 1027 bp, Oryza sativa
cctgcagccctgtccttcaaatccaacatactaagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccatcaataaactctttggaccgccgatcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttatttcagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgcttgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagccccggttggtgct

SEQ ID NO: 48200 - DNA, 27984 bp, Oryza sativa
  unsure (1)..(27984): unsure at all n locations
accaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctctaccagtgatcaccagttcaccaccatatggcactaacactgagacctcatcaggtagtagcactatagttttctctgtgtaaacatgaatgatgaattgcacaaaaagttagcatgaccagacgaatctatatttgggtaaattcagataaatcaggtgtttgaacagctgaaatttgggtggtaatcctccattccttctgcagaaaaacgtcaggaacaaaagcagactcgagctcatacaagtcactgaatttcaaacccttttctttttttttttgggaagggggggggggaagaaccttcggtccctcgcgtcgctctcgcgcaggcggctcgggggggtgaaaaaccctagccgcccgcgcctccactccctccccaccgcctcaccgccgccggagctcgccggcggcaaagccggcagcgagcagggaaggcggcgacgagacccttccttcctggcgactcccccctggcgcgacgtggacgggacgacgccggcgaagtccctccaccacggtcggaggtggcgacggcggcgcgatgcggggaggcagcagatccggcgcctccaaggccggatccggccaccccgcgcctggatctggtgcgacggcggcgtgaggtggctggggggcggcggcaacagctcagcggcggcgtggccggcccggtgcggcagcgtgggcgcggtggcggcggctcgacggctgggacggtggcagcctggaggcggtggcggctgggagcggcggcagcagcacgggcggcccggtgcggctgcccgggcgcggcggctgggaggcggcagctcagcgtggggccggttcgggctgcccgggctcgcacggctcggcagtgcggccgtccgaatggcagcccatggcgcggctcggcggtgcggccgcgagcccccatggcgcgggtaggcctcggcagccgggcagccagggtgccgctgcagtgccctcctcggccaggtgggctgtgcggcgcggccagatggggtgcggcgaccgggtgacggggcgccggtgggttgtgccggagccgaagcagcagtagcttcactggcgtcggctcaagcccagatggcagtgtaaagggagctggtggcggttggtcgtcttctccgttgccggtcggcaccctcgcccttcctggagctcctccccttctctgtggggagtttctgggttggattgaggcggcaactcgtcagcgggggaagcctaggctgccaaagcaatgccatccagtcccgggttctcctttcgtccaaagttggcgaggaggccggcgggtggtggaacggaggggtcctgggccagctctcaggggcggtggttgatgttggctgacggaggggcgtcagtgcagtgtggttcgatgaagtcagccgacggaggagcgttggtgcagtatggcggaagctacgtgctgccatttgtctgtgtggtggttctgagttggtggacggtgatctgcagtcaaggttgtagggtcccaggcgaaagcctagtctggtggtgcaccgggccagcagcggctacgtcttcgggcgtcgtaaccttcttggggcattgtcgaggggtaccctcttcctttcttgatgagcttctctgggtgaaaactacatcttttttagataggcgatgacggcatcctggatgtcgtgaccaccgtggtggcatcgttttcggagtcttgtctctgtggtgttgccataggcctagcggcattcggccacgcttagcgggggtcgtttggtgctaggcttcaccctcagcggtttgtgcttgggtggtagtgcgtggtgtgttgtcatgcaccttggtgcattgtgatgttttttttttataatttttactcttctttaatacattcggatggcctccttcggccttcccggcgaaaaaaaaaacccttttcttttgccagagagaacgaaggtatctgctgcgaaaacctgaggttctctttctcaggtatctccagtatctccttcccaatgtgaggcttgaacacaagctatgtccatctagtcatctactttactcagaggagaaaacagtgtgctgccttcagagcacctgatgatcttgccaatggcatactcaagacacagctactgattgtgggaggagcccaatcaggtgaaccagttcttgcagatggctcaaatctcacctacctttgggaaaaaaaataatttgccgatttgaatcgcacatggatttgcagtttccaattttaaagatgccacaactgatcatggtgtatcctgctccaaccattgcttctcctgttcgggttcagggcaaacctctagctatatcaaatgcaatctgagtggctccagctttgatttcggctatccagagatagagattggggaacttatcatggtcactgtgcagtgcccaaatttgttcatgttcaaacttatcacatgaccggacttgtggaattcagaaacaggatacacgcaactagtgaattcagtgttctgtctcgtgtcgagagaaatgtaatggatgagagcaatagaaggaaatgttgaatccaactcacttggaagagctgcagtatctagttccagtaacccttctacaatgcatgtttctccgaagcaaaagcttcggcgagcaacaggcaattcttgatcagtccatttcgcctcttgcgcattcatagctttgtgctccagccagccaagtgaactgaactttgaggctggatgtatcaatgtgatctattcgagcatagactcttggcatgaaatcgtggtcgtcatacagtgcccagatctgatcaacttcaatccagttgacatctctaaacttgccaaaatcacagaggtctggatagtggtaggcaatcacaggattgttcagtcctgacttttttgggaatatgcgaggagcgcatcattgtattaagaaggaataaaagtatgtacaaagtgggtcagaaataaaaaacgaaagggacaagatataggaggggaaacgaagaacaaaagcctaatctccaactaaatttggcgacccttctccattcacaatgactaccacaacagggattgcggctttagccagccgccaaagctccgcttcacccgtcataacccttgcaatctccgcccatgttctgctcttctggttgaagacccaattgtttctttccttccaaatcgtccacgctaccagtgttgcgatggtgtcgaatccccggcgatgttccttgaccatcttcttatggctgtcatacaaccaagaatgaaaagagggctcattgagcggtaaacattgggaatgcccaatagctctaagagcaatccaccaaagttgccgaagaagcagtatcaccagcttctttttggtaattctgttgatctcctattctccttcatgttctgcatttctttccccatggatgtccaatttgatggggacatgatgttcagtagatagacttacagctgaattatcaatatttgcacataattagaaccagcactaggagctcaagctgcagctggtgaaggcaccatgatctgctcaacatttgaacttgtttctgtatccatgtgttccctcggttgaagaaagcttaatgtactgggtctgctgtgatatcggcgccaaaacgcttctgacgaagttcggtaatcgcttgctgaagctaaaaggaatctcgacggcacagcctgctcatgcagcttgaatgcaaagaagttcttactcccttttgtttgagagatgtttagatttgtgtgctgctttcatggaagcatactcccttttgctgtcatactacaaagatctcttcatatgatcacacagtattagatgagcttctgaaaccaagttgagagcagattcagcaccagaaaagagtgtttttatcaggataaaagccacagggcaaagtttgtcatgttgatattttaatgtggtgtcatctgctgttgcctccacttgaagaacaccataccagtccaaagtctcagtaggttttcgcctctgctgaagaatgaacttcgcagacagttagcagctgataaatgttgtcaagatctggaaaaggcctttggcacaaaaattgtccttgttttccaacttcttcactgcaatttatctggcccttacagcctcttctctgttgcattccaatatgtaaaaaaaataaaatttagtgcatcagttcctgcatacatacaaaaaaaatcactaatagagaaatgtcaactgtgtgacacatgcacccaaaaaacaaggcaaaatttcttgtgcacaaacaccacctcctatttcaaagattgactaggaaacaatcttacaatactacatggataccaacatcgcatacatgtagtagtgtagcttggaaacaatcttaataaaaaaatcactaattatcttgatatgttctgggttattagtaatttatgagtcattccatttatcattctctgccaaacctagcaagtaggatgtgttccaagtcaatggtattggagtcgacacagaaaaataaaaaggtgtattttcgggacaagtaacagaatgacagaactacagaaagccaaaaatgagtagcgtgcatcttcgatgttcttacgtttccaattaaatcactgaacacactaaaaactgtgtagagtactacagttcctggccttatctttttctggcaaaattgggtacactaatttattgattacaatgtactgaaagaaagaaaaaagatactgactgcaagtctgcaacccttccatgggcattgttcagtaatcagtagcagaggcctctgcaatggaatgtcaggatgggttttgaacataacttatccctgggtaaaacattgatggtattaaggttaatacagaaagtacaggttcatacatacaggagcatgctgccagacaacactatatgctgacaacagttccaacaggagtcagggctcaggagccaaacacaacttatgtcattttgacaggatttcacaatagcatttgaaattaggaaaatcactgaacacataaaacacttgtagaaaagttgtactgattgcagtgcagccccttccacagggtggcagccagcagaggcaactgtaatagaatgcatgttatgatggttttgaacagggcttatccttggcaaaacatggcatttgacaagtaagagaggccacataattagaatgttagtaacaggtttctgaatagattacaggtaaggcatatatgtacacagaaaatgagtagaaccatacatcaagatatatcataattaagaccaaatttcagttctactgtctcaagagtctgctatggcattcgtaagtcatggagtgtctgttatgggtggaattaaagtgcttggtgaggttgcgaaggagtggtggatgggtggctgaggccctagcactcatggataccagagcgtcagccgccactgctgcctttgtgcctggcacacctctcatgccactccagcccataacagtgttcctatacaggaaaacatcaggaacagaagctggatcgagctcatagaagccacggagcctgccacctctttcttctgtcaaaaggaaggaggggattcggtgagaaaacctcaaacgatctcttgtaggtatctccacaactgtatttcgcttgtcaggcatgaacactgctctgaagccattaagttgggtcagaggagagatttttatactttcttccgtgcgcccaacaatctcaccgatgacaaactcgcaagtatctacgctgggaggagtccagttcttgtagatgcaccaaatttcacctacttgcggaagaatttcaatctgccggtttgagccattctgtcctgtatgtactaaatgagagaaagaataatttctctcatacctggctttccagtcccggattttaaatttaccacaagagactggtaagtcctgctccaaccaccgtttctcctgctcatattcaggagaagcctcaagccagatcaaatgcactatgaatggttgtcgctcgactttgcttatccaaccatagaacttggggaatttatcaacatcactgtataaagcccaaatctacccaggttcaaacttctcatatgtgcggtcatcttcgaagttatggaattctggatcaggatatgaaaaaatagttggggttggggaagggcagcctggcccagaattatttttttttagataatggaatataatatcccggcctttactcaaaagagctacagccaattattacatagtagttttcatgaacatagtgtaaatctaaatgaatagaacacaccgaagatcactattattgaaactagcctaacgtaaggagatcacaattattgaagtctatttgtaaatctccaaccataattggcaaatagttgcataaccgtggtctccaactttcggcatgcaaccttcagaaactcttcatcttcatcacacctttgtagttgtgcccaaaaccagagccaatgagttgccctgaaaataacctgcatataggaaaatgatggtgatttgtcaaaaaccatatcgttcctactcagccatattattgcccagaattattgccaaaaccattggcaacgtggccatttttgggcaaggatgagtttttttcagaagaaagactctccttttgtgcttcagaaagattctccgtttgttcatttccaggatcctttctactacttctactgtcagtcgtcaaatcaatgagtgtactgccctttttcttgccaagggagatgtaagagtccagggtgacagaaggaaatatcatatccatgtcaatggggagacaagaagtgtcaagttccataaaccctgccggggcacctactttttcatttccagttgtcctgtaacaggggatattatgagaaaatcgaagcaactcactcgatgctatcacaactgcagatttgtctttagctgccgcaaataaactcacaaagcctttaatcctgactaatgggataacagtgataccatcattaactgagaaacctgacaatatttcaacaacttcataatcataagaccgatggctgtctgcatctgaattccactgcatgctccaatccttataaagagcccataactcacccttattaagatatacttcataggcaatcctctttttgccttttgtccatgaaacaatgtgagagaacatgagtctgtcatgttgaccctaagcaaaacttaccacaagcaacaggttgttcttcatcagcccatttcttctcttcttcacttgctgcattgtactccaaccaagtgagatgagctttgaagctggatgcatcaaaatgttcaattcgagcataaaatcttggcatgccatcaaggtcgtcgtaaagggcccatatctgaccaagtgagaacatattaatatccctgagcttctcaaaatcatagaaatctggatatggggacggaagttctaaagaacaggaatgctcattctgacgaacagtattagtagcttcagcattggcattgtccttatcatctgtgtctgaagtttttcctttaccttgaatgtctacttttcttgtcataggaggtggattatattgtctgtcagctctatgggcagtatcaccgaacgttttcttacgattcaagtgaacagaaaatggaagatcattcttcttttacttccttttaccattggagttcagtctactgttgccatcaacatctttctttctgttagctggtctggagacaccagaggaggccgcatatatactgtgggagagacagattggctgagaggaatcaccaaacctgttggaactatcactattcttctgaaaggttacctttttttgcaaagaaagatcttcatgatgttctgcagacagcaggcgacaaacatgtgcttcagactgattcacctttagccgaatagctacacgatttgccattctttcctcatggctgtccactttgctggtgactttatgtccagcgggggatgattgtgacacatgaaacttgcgagctttttttgtctttggaccttctgaatgatcaccaactgatgacaaccctttgcaaccatcattgttattttcttccctattgaggaaaatgtcaggaacagaaccaggatcaagctctaagaagccacaaagctcaccacctctttcctctgtcaaacggaaggagagtatttgatgagaaaacctcaaacgatcttttataggtatcttcagaactcccctacgctggtcagaaggaaacttttatagttgcttccgtgcgctcaacgatctcaccgatggtgaactcgcatgtagctttgctggaaggagtccagtcaaatgtccagttcatgtagatggaccaaatttcacctacttacggaaggatttcaatctgccaatttgagtcaatatgtcccgtatttactaaatgagagaaaacatcatttccgtgatacttggttttccagttccgaattttaaatttaccacagctgataggtatatcctgctctaaccaccgcttctcctgctcctgttgaggacaaggctcaagccaggtcaaaagcactgtgaatggctgtagcttgacttttcttatccaaccatataacttggggaatttatcaacttcactatataaagcccaaatttgtccacactcaaacttcttacatgagcgtccttcttcaaagttgtggaaatctgaattaggaattgcaaaataagtggaggaataccttggcacagtgaaattgttaaaaccattggcattataaccagtttttttcatggatgtgtctgtttagaagaaagatccatctgatcttctgtagacagcgggcagcaattatgtgccttagagtgattctgcttctgccgaatggctgtatgtgttgcatttccttcctcatggtggtccactttgctgggtactctatgtccagcaggggatgatcgtggcacaggacacctccgagctcttttcttctttatatcttgttaatactcatcaaataaagaccactcatcgcagccatcgttgtcattttcttctctatccttaccacgaactttagttgggacaatatcaggaaaatcaatgtgtcctctcttccttgccagcatattcccttgagaccttgaagaacctatagcttttgcagcggagctcttcttcccaagtgcttcttttcgtctatgaggtgcctcatcggtggatgcttggatcttccattgataaaaaaaagctaatttcagtaacaataaacagaagacaaattccaaatgggcagggaaaataatttccctgcattaaatatactatgacacagtcagttaaacccacctttttgtgacaagtcttctcttcagtgaaagcaagttcctgtgtggtcaagcaaattgtagtgaaaactaaatgaaatagctaagtgcaacaaccagaaaacttatgcatcacctcttcctcgtccttgtgaagatctggatacagcgtcaaaattaaagcatcaaaattaggatcaaccttcaaggaatgactacttgcaggggtgcggcatgctgggcattcatcatttctgtaaaaacaatgtgccactcagattatcataaaaagtaagtaccacattctatttcaaaaccccagtcaggtctattctttcgaaatgacattgacagaattttagatgaataatgttagggaccatacccaagccgcatggatttttctatgcagtccctacagaaccggtgcaaacactccgtaattatccttgccttctggataatacctgcaatagggccgtaatgcattcagatgatcagctatgcacagtttgtgcagagatgctagttaaaatttcacagatgagaagcttactcaacctagcgtaataaactctgtctagttgtgcttctctaaaatatgtagaacatgagcatagtgatgtagcttttaccaaagtaaaacaggtatgttctctagtcatcttgttatttatcagtggacagcaattatacacaatatttttttatgcgaactatatacatacttggataacagaaatatgtggactactaactttgctgcttcacttttataaaaaatagtgattaaaaaatcttacatctacagaacaatatccaacatgccaatgacaatatgaagtgaaactgtaaagagggaattgtgcaaagtaaagagggtttttatctctacatctggaagcaagttagggaaagcatattcttacctaagcatatagggcactgcacttccttccgtatatccattaacttcactagtataaacctgtatgagaaacaatatttagataccaacttagcccgcgcgaatgcgcgggcatgcatcgtagatttgtttgatacacttataaaatgaaaacatttgttgcacatcaaaaatatgatttctccatatgtttttgatcagtatttcttgcgtgaataattctcagcaattatttataatcttcttcatcgtcttttttagactttttttcattggaaaacatatataccattttttttgcgaggaacatatataccaaatcaagtgtaacataaaagtggtgtttttcttttttaaaaaaattggattactgatataatgttgtcaattttttattaatggatggattgggtgggacatgaggcttttttagcctaacatgaatacgctaggatggctaaatataattggacaatattatttttggaatatgatatatcatcaatacatgctagaataaaataaatagcggaaggtggagaggaggggatttgttttcttatatatataaatctactattataaaaatttaagatgtttttgccgaacaaaatttcgtaagtcgctcctactccgatttcaattgcccgtgtcgtgtgtcttcctttccgaaaacattaaaaacgaaatctgctctcaaactttttcgttggtgcatctcgaaagtcgtatgtcaagtccgcctgcgcgtcactcggatctccccagcacgtgcccgcgcatgacgtgcccaatgtcgtgttcttgttcccagacccagccgtgtgcctgtgtccagtgtggtttgacaggaagataaacaacttagtgtgtccgtatgtaatttggattaaggctgtgttcatttggttttgttcggaacaaatctcccgttcatgaaaaatagagtggtccattagagtgtgattaattaagtatttattattttttaaaaaaaaattggatctgccaatactttggtacgtcatctgtgtctgagtcagtttttaagttagtttgcttttggaaatacatatttgtatttgagttaatttttaatttttaagttcgttcgcttttgaaaatttagaaggagttgtataagaaatttcttagaaaaactcgcatactaacttgaaacgatcggattcctaattgcagctcataattttctaaaaacagaatatatatccaagcgaattctcacagaactaaaataatattcacccgttacaacgcacgggcatttgttctagtatatataaagtacatctaatggtgagaaataatgggtccatcggtttatatgataaggatggcaagatgtttttttttcttggaaatcttaggatattctctaatttatatagtgttatgcagtgtttgtaaaggtaacatatgctggctttatactgaaaggaatcatcatctaaagtcgattagatactatgtagaatatagaagatcatttggcttgtttggattatttgaacatgctatttttttaaagaaaaggacaattgcttattttaccctacttttataagcccaaaataccaatctaaccatatttttataagttttctcacttgaaaacagagtcagatggtaactctaattttgaaaagcacagtaaaatgagcttgaaaaaattggggtcatagttaggtttctaaacacgcacggataaaagaacatttgccccttttaaaaaaaaacaaagtaatcagaccgttttctctaaccaaggcttcatattatttttataaaatagcaactcttcatcttcatatttgagataattctttttcatatttttttaggcaattcggataaaatgtaaaagaacagcggtttgtttgaccatccaaattattttttaatgtagtgtcttagactattcatatttttactattttttaatgtctagtttagttatacatgtttgcaaaacaatatataatggcgcaacatgtgttgttgaattatttcttagtttttatggcaagtccgatagtatgtaaaatggcaacggtgttgtccatcaataaaaacattgattgaaacatgaaattacaatgtttctttggataatattgatttaatatagatatccatgtttgtagattgatgtataatgacaaaatatgtgttgacaattttttatagtattccattgctatttggatgacataccaaatgcatgggtcgagtgtgcctaaatgtcatattattcttttatatagaaaaatatagacatgtgtattttaaattgctggtttaaatattaatagagtaacatttggattatgattttggatcagaaatcatacatgtagtataaaattacgatctttcaatatctataattatttgttgtttcggttttagtttgacagctaaagatgaggagggagagactgggaaagaagaaataatgtagagctcgagcgagagattggaaggggttcgtaatactgtgtgcccatgatggactgatgggatgtacaggtggagaaaatatattaggtcggggaactctgtttttcaaatctttctaaaaatctaagtgaaaaccaatggttttttttctcagatttcaattcttttctaatatttaaaacatgatgtgatggattcggatttccggagaagatctaatgcttaaaaatagtagatctatcaatttatttttttcctttaaatttctgaaaaaaatttctaacttgaaaatgtgatacgtggtaatttcatagatatttgttatgaaaagtgaatttaagataacataatagatattgtcatctttttattattttgttcttatttgatttgtcatacagaggacaacggttttagttgaaaatagtagacttaatttcttagaaatagacttaataggttcactggtttcaactatgcttatctttctaatggttaaaataataggtccgaaaatcaataattcgacttttatttttttcttcataatatttgttctgtactaaactactttttagttaccctaacaaatttgttagctacaatagaaaggtgagatggaggaagcgtacgtacacgcacgtctggcctggactggtgggaaacagagagggagagaggagattgtggggtcctttttttcctctaaaaataaatctaatattagaaacagtgggtccactaatttattagattgccacgtggtggtttaggagcgtttgtaggaatgtcacgtagcgtcttaggagcgtttgtagaaagtttaatggatttttaatatataatagatagaagatagatttcatgcattggctaaaatcaaggtcaagtaaacactatccattattgcattggttactcatcaatattctacaatatatggaaaacagggaagtgtaccacaagattcttttcatttcattaaaacagaagaattaatagctactattcactgaaacctggctagaaggtattcacaaggtgactatacaaagacagaataaaaatatgattccattaggcattagcacatcataagtaaattgagactataagggcatgcacagcggtcatcaatgtgctgtcttagcaagtgtctcgttcaatagttgctaacatggaggggagaaaatagagttgtatcttcacaaaacaacaacatgagcgtgcaggttaagaaaaagtagagaggataaaataatctaagattgaactccatgttatatactatggtcatctgtccatgctgtcttttgagctagcttagttgacacgtacctataaaatgtggcagtggtctcaaatgttgaacatgccctaaagggcccttaattgaaagcttgtgaagtaacaattcacaggctgaaaaaacaaaatgcgcactagcagattcacgatgactgaaaagttcaatgaattcaattaaccagcagaggcatctatgcaggaccaacaaaatcgtaaaaaaataaggcaatacgaggtctacaggaattgcctgcacaagaactcagtttgtgcaaaacattcacctcatatttcggagaattgcctaaactgtcacatgtactatgtggtttgtaatgttacaataaaactagtactttcacacagataccatcaattaagcactcataatcttaacaactccctacattacgaatcttggggggtaaaaaaagaggggttttctccctatccgttcctccttgcgaccttgcatgccatcgttttctagattttctaccaaatcctatttaaaagaaatgttgcacaaaatttctaattaccgcgcaacctccaactgctaccccaaaaccccaggaaatcaaacaggaacagcatgagctgcacggaatcgaccccaatattcccaataaaaaggaataacgggagagagaaagagagaaagggatctagagcatagaaacaacagtcacctgagctagggggctaacaaggtcgtcggcggcggccggagccctgggacccaccagcggcgaggtggattggggcgggtccccgtggcactgtgaggagtgagggcgtggatagtgtggctagtgggcagaacttcaagtaggaggctgtgttccatggtaaaatgtagcgtcgcattagcatgattaataatgtattaattaaaaaataacaataaattaataagtttttctaaaataattttttgtgatactttcaaaaaatacatacagtttaacagtgttagaatcgtgcgcgcaaaaaacgatgggtagaagttgagaaagtgttcaaagaacactgttgtggtaaactcgtaatcccctccaaagtccaacagggtattttgatgggaaaaattatattgtttcatataataggaatttaactaacatttactatgttaaaaatataattttgcaatataaattgttagatttgtattcaaaagtcttgtactaattttttgtaatatatgatgaagttgagttttctttaataaatgaccaatgataattattcagctatatgatttatttaagtaaaatgaaatgagcgtcactagaattgtcattaaaaagtgattactatgtttgtctatttgcacaaatatttgttgtcttgtattttttgacagagggagtaatttgttaaggactacattaaatctttcagaagtcgtttacgaaaaactttaagatgtatataattgtagtataattatattgtacctctactgtaattacattgtgactaagtattaaatcgactagaaaccacgtctaagccctacgagcccttgctcatgagaggaagatattgtcatcagctttctagcaaatccataaaagaaatgctttgaactggagtgtcaaataaaaacgacgggagagggagtacttttttttctcataatgcaagaccaggaatattttaaattttaaattttatttattaaaatatttacaaaaatatatataaagttttataaatctacacccctaataccctttgagagggtattttttaaaagtcattccaaaggactttttttttataatgtggcacacgtccgttgacgtattctaatagtcacatgaagggtggccagtcattttgcagacaaccgcttgtcacctttccaaagagctacaaggaagccagttgcaaaataattgagacaggctatttataggcaggcccttgccgccctcccagagaacgttggagtagtagatttgtaaaactttaaccataaattaatttttaaaatattttaataaataaaattaaaagtttaaaaaattcttgttccaagccagtttgctttatcctccattcctcccaatagcaaacacgtgtcgtaatctacggcacgtgattcctctttgggcacttggtcacaaaggtgctatagtcatgctgtgttctgaaattcaaatttacaggaatatggaattttcactggaggctgaccgaaatttattaaatggggagatagacttatcatcatatagtcatagagattccgtcacgtacaatgatttagctatagttactaggggtactgtagcttgtagaaaaaaaaaaccatttatacaaagggcgaatcaggatttggccaacccatgcattatacctttcatttctccaatctcagagaacaccacttaaaatttgaaatgaagaaaaagctcgtgcactgatctcacgcgaaactgagtacgacgaaagtgcatcggataacagaatacctatggaatttcaataaaactcttagttgcaaatgctcagcagacaccagcataggctaacatacttcttccagcgaagagataatgcttcttttctagttttatcagctgaacatttagaacgttggcaccgaaaatattcacaggtgtacccaagttcatgtgaaaacatcactcgtaaatatgcagtgcgatgtatgtacagcagcagaattcatacattgcagccaaattttagaacagattatgtcacagaaagtagaaacttgatggtacatacaatggtcatgcagacaatgctgcacagtttcaacggtagtcaggagccaaagttatgtaagacccacatgactctaggaaaaacaataaacacatataacttcagaaagagcaatactaattgcttgcaagttgcaacccatatattatgatggttttgaacaggtcttatccttgggcaaaaccgcaaaacatgacaattgccaagtagcataggctatagaatttcaaaagttagtagcaggattctgaataaacaacagatcaggcatacatgtacacagaaaatggatagcagcatatatcaggatatattataattaagaccagatttcagttctactacttcaagagtctgctttgacgttggcaagtcatggggtgtccctgtagaggaaaacgtcaggaacagaggctggatcaagctcatagaagccacggagcttgccacctctttcttctgtcagacggaaggatggtatttgatgagaaaacttcaaacgatctcttttaggtatctccagaactccactttgcctgtcaggcttaaacaccgctctgtagccattaacttgggtcagcagagaaacttttataagtgcttccgtgcactcaatgatctcgccgatggcgaactcgcacatatctatgctggaaggagtccagtcagatgtccagttcatgtagatacaccaaatttcgcctacttgtggaagaatgtcaatctgccatgttgagtccctctgtcccgtgtgcactaaatgagagaaagtatcagttgtctcatattgggctttccaggtccgaattttaaatttgccacagcagactggtatgtcctgatccaaccactgtttctcctgctcctgttcaggacaagcttcaagccagatcaaatgtactctgaatggttgtagctcgactttgcttatccaaccatagaacttgggaaatttatcagcatcactgtataaagcccaaatttgtccaggttcaaacttctcacatgtgcggccttcctcgaagttatggaattctgaatcaggatatgaataaatacttggggagggacagcttggctcagaagaattgccaaaaccgttggcatcatggccatttttgggcaaggatgtgtttttctcataagaaagactttcatgattttctgtagacactgggcggcaaatatgtgcttcaggcagattctcctttttctcatttccaggatccattctactacttgtactatcattggtcaaatcaatgatcgtactgtcctctttcttgccaagggagatgtaagattccagggggacagaaggaaatattatatccatgtcattggggagacaagcagtgtcaagttctataaaccctgctggggaacctactttctcatttccatttgtcctataagaggggatactgtgagaaaatcgaagcaactcactcgacactatcacatttgtggatttgtctttagccgccgcaaataaactcacaaagcctttaatcctgactaatgggacaacagtgataccatcattaactgagaaatctgacaagatttcaacaacttcatactcataagaccgatggctgtctgcatctgaattccactgcatgctccaatccttataaagcgcccatacctcacccttattaggatatacttcataggcattcctctttttgccttttgtccatgaaacaatgtgagagaacatgagtctgtcatgtgatacctctgttgaccctaagcaaaacttaccacaagcaacaggtagttcttcatcagtccatttcttctcttcttcacttgctgcattgtactccaaccaagtgagatgagctttgaagttggatgcatcaaaatgtttaattcgagcataaaatcttggcatgccatcaaggtcatcataaagggcccatatctgaccaactgcgaacatattgatatccctgagcttctcaaaatcatagaaatctggatcagggaatgatagtttttcaaagcaggaaggcacattccaaccagcagtatcagtagattctgccttggtcttactatctgcatctgtaacttttgttttatcttgaatgtctactgtgctcgacacatgaggtggagcagattgtttgtcaccactagtgccattattgttgaatatttgctggcaattcaagtcaacatcagatagcacattattcttcttttgcttctttctgaccttggagttcatgctgccgttgtcaccagcatcttgctttctcctagctgatctccggagactggagggtactgcagaattgggcactggaaatgaatcttctgtaccaaagttctttctgtcaaaaacatttggatcagcatggtctggcttgaatcttccactggcattctcatttgcagtttgggcagaagattttctttgattcatcattgactggtttgctttcttttcaacacttgcactgctatcctcttttgtggtttccttccattgtgccacatttacccgtggtttggcatttgtgcctccacctgtcgaatgaagcttcgaatgaccaggcacattcatagcaggtgcaacagatgcatcttctctacccaacttttgcctgtcaatagtgtctggacaatcaggaactggtattgaacatccacctgaattcccatttgctgttggtacagaatatttatcttgattccttgctggaaattgatctttcccccttgtcatctctgactgaatagttctctcatcactgcctggccagctatatgtccccggcctcacatctgtgtttccacctgtgcaagaaagcttcacagggtggccctgtcgactgatgggatcacgccgttgatttggaaacatgtttgctggaaattgagaactataaggtacatttggtgtaggcacaggctgttcttgcaggttgtatgcaaaaaaattccttctgcagttcatacaacagacagtagtatttatggcattgttgtagtactgatatcgcatctgacaatgtgggcacattgtccaaaatgcatgtaagtatacaggtacactgtatttgtttgcctgagttttctttgtgggccgtgtagcttgctttggagcctttctgggaatattattccttttgatgtcataaataggacgttttgttggatcacacaatagtgaatgagcttcagcaaccaacttgaaagcagcttcagcgccagcgaaactatttttgtcaggatgaagtgaaaaggcaagcttgcggtattgctttcttatggtagcctcatctgctgtcgcctccacttgaaggattccataccagtccgtctgtccatttaccgttgcttctgctgcacaatgtacatgacagatatttaacagctgggatatgttctcaagctctgggaaaagcttttgagctttaagaacaatcttttgggcaccattgaagtctttgttttccatctttcttaaagcaatttccctggccctaaaggcctcttcgcggttgcactccatcatagtcttgcacaatacaccacagaatacctcacatgaaatgatctttcctggaaatgagtatccactgacacatgctctacatcaaatactatttgaaagtagatgtacagctacacccatgacacactagtccctgcaaatttagagtagaaaataattcataaactggaaatatccccctaccataccatcagtggtacaatgtaatacagatatgttgattctatgaataatattacaatgtacaattaaaactgaaggaacaataaaaaaataagcacataaggatagccagattaaacaatgaaggaaatgacttatacaacattaataagcagactctattgctggctccactctattaatagtagaggtaaaagatataaatcatatggcaggatcagacattcaagaatgttcatgattctatctggaggccgcacgattcatacaccaaataattctcttcgtgtaaacaggaaagtatatgttgaatgtacatagcattgaaaaccaatgcagaaactgaccaaccatcaggtgagcaaattggagcttatagtctgcatataaacctattaacaatacacaccattctcaataaaaaaatgttttctgacacgtccagttacaccccacaatgaaggcagtattacatagtcgatagctgcaatctgtctcatgaagttctccaaacacgcgccagtataaaacggtagtaactccacatggcctaaatcatcaaagcgttccgaaaacactaccaaacaggccgggtttttccttttagcgacagtactgtgttggtgtgactaggcttgaaagcattagataacaacaacgattaattcacatccaaatcagtcatttacaacccacaaatcggcagcctactatgactatgagcaaacaaatcagtaactatgactatgagcaacgaagcaaaagctactgagttagtcactgaccttcaatgttcaatcgcctgctgccgcgagactgaagaggattaagcaatcagaggatttggaggagaccagatcgagaggccgagacagcggcgggggtctgcaccagtgaactcgatttcagactggataaaacatcgagtaaaggaggcaccacgcacaatctcactaactgcacatatcaaacgaaatccgcgacaaacatttcacatatcggcaagaacacagaacgatttgggtttcggtcgcggcgcacaccaaaacccacccccaccccccaaaagcaaaagctagagagttcccttaccagcgcaagagaaacgagaagacgacgacgggggtgtgtgtgagggggggagaaggatcctcggaggagggggttcgctccggcggcgggaaggaggcggatgctcgctcgccggaggacggcggcgcgggcggagggggaggggaggaggttttcgaacgaaattttggtggtggcgccctcgtcccggagttcccgcctctcgccgccgccagatgaaagggaaaatggggaatagcgagaggggaaggggattgaaatatctagggcaaaatgggcaatttgggtatttcacattggtgtggttttttcaaaaatgaccctcaaaactactcgaaattgtattaacgtagatttatttccagagatgctaggtgacgtgattaatgctcccagagatgttaggtgtggtgaataatgtgccttgaagtaaagtgatcggtacatagagtttgtagcgtaacgtgtgactagtcaaatagcttaaaatcactctatgacacttctaactcttatatagtaataaatcgatagaaataagttcttttttcgaaacacgatacagtcgcagaccctgaaagacacgtgtgtgcatccctaaaaacagtggtggagccagaaattatataagactagggctaaagtagggctcgactaacggagtattagttttctgaaaaatttacatggtgaatcaacaaaatttaagcaagtttttaaaggcaagcctagggcccaagccctagccgccctgcctaaaaacgtcatacatgcatacattacctatatgagcacattctccaaagactgaactgatatatcttaagattgacaaagttattacagccatcatgttaccaatggattacctattactctctctgtcccaaaatataataactttagcactaaggatttgtcacaaaatataacaacttctccaccatttacttttcccacctacccccacttctcaagcaatcacaaccccttcctgttgatgcaaaaaaacatacggcctgggagatctgcttagctccagtgtaggtccaagatgttgatgagatgcggacgtgccagtcagtttgatcctgcaactgacaagacatgtaaacatcaaataagacagtcgatcggctgacaagccgatggaataattctagtcgatagccgatattagctgataccgattccagccgatgtcgatagggttttgagcaatcggctatatgtccaatgcagataatgatataaagacaatcggttgatgataataaaaaggggaaattgcaattttaccactgctttgaatcgttattgcaaaactgccactagaaaattgcaaaaatgccactagaactggcattcgagtggcatccttgcaaaattgaaaaaaacggtggcaaatttgcaaatgccccaacaataatataatccaatagaaaccaatcgactaataataatatgatatgataagtattgattcgatggttaaagcatacatcggctaaaattccgatgtcataaaatccaatcaatttagataaacagtgaaacctttgttgcaatcggctaaatccaatttgtatgtaatctttgtaagccgatgcaatgtccagataacttatcggctagcaccccgataaaacactagcattaacttatcggctagcaccctgataaaacattagcatcaacctatcggcttaacaagatttctattatcaacaacaatctagtaggtcggacctaaccgatgagccgatagatctatctaatgtgatgaatataacaaatctgtttataacaacattgtaattatagagatatatcggctaagacagaagatcggatctaaccaagacaatcccaactaaaccgatgcgcctctaaacacaatgcaagagatataattgagatatcaggtaggcaaatatatcaaccaaaccagagcgatccaagagatcgaagcgatgcagccttgaacaacaccaatgtagccgatagattcaccagggccgacggaacgtaggacttacccctttgtcgaagatcgaactgaaccgatgcagccccgtgtcaggtgccaaattccgccggttgataagtaaaacctcagaaaggagggtggtgatgcgccggagtagtattgatcgagagataaattacaatgaccccgggtatacatatttatacccatgagtagtatagtccttgtaagataagaaagaaactttactaaagataaagggaaaacataaactccttatcggatactaaagacactttcctaaagataaaaggaaactaaaccctacctaattaatagataaactgccatgtcgcatcctccttgaacttggactcttctagataagcttcatttaattgatctttacccgaatccatcaagaatacaactgttggcgattgatagtttccatcggtcgattctaggattttgaagtcaatactgactctaagccgatgattgctccgggcttaccaaattttgtcgttaacacttcctatttaattctacttactttcttaataaccgtgtccaactctaaaactctctatattctgaaacggagggcgtattaaaataataaataaccgtaaatgtgccaagtcaacttatagacagatttcatcaaaaaaacataaccaactaagctaggcacacttcgtgcaataggaagattttaaagaagttagaatcgaatcctcatgattatccaattttaaccaaatttcattagctacttgctagttgctatgtgttgcttagcctcgattcccgtatctaaaatgtgggtcgtagagagtgttcaaatggctaatggaggtatcgatatttttgctgcactttcacaagtacaatttctaaaaaccttttcattctagtattgcgtggacaactttttaaaaagttatttgctaacttgtaatatttaattaatctacgagactttttttcctttgttcgaaatctatcaatcatctagttagaatgcgcccttacccctttcttttctagcaccacattgatcatggccttatttacttaaaaaaaatatgaggatgaataatgaagttgtatactggcgtatcattttcatatatttctttataaggcataccttctcataactattcctattatcatatcatgcataaaaaaatcactatccattagaaccaatcaaaactgttgttacacattggatttttctattgtacttcaaaagctatatagttcaaaaatcaaaacataatggcggatgaagattaagtgcaggcacccaaaacgagaaagtatttagcacatgattaatggagttttaattattttaaatttgaaaaatagatttatttgatatttaaagcaacttttatatataaaaattttgcacaaaatgcatcgtttataacgaaactgaggtagaatttgtatcttcatcataaaagaacgggccttaatatgatattcccttgttacttccttcttaagtgtatcattgagaaaaaaatgcttttgtattggagaaggtaacatcaagaaagattagaactaatgggaggcatacacaattgtagtaatgggtaggaaagtggcatgaagatgtgggattaatctatatatcccatggaccactgcacatgccatgcacacaccacaaaaagcttgtgtccaatatgttccttttttatttctatggcccatagcacatgttaagcacacaccacaaaaggacaaattctttgtttgggtttaggtttgttagcttataattttaacctgacattttggcatataagttttataagccgatggtttttaagccattaagtttaatggtggggtcctacctttacttcacgtaaggacaaaactactctaatctagattttggcttaacagtataagaatggtttatggcttttaaaaaactactcgatgatacatttttcaaggaaattactcgatgccctattcttttcaaggaatacatgaaacatacgtttccagagtatcaagcatttttatgaaaaaactttctatttatacaaatttcttagaaaattgttttaaatccattttcaactttacaatatttaatttatttttaatccttgaataatttcacaaatcattcctctatttagctatttagcacaacagtatagggtgatatagagaaaaaaaaccattccatgtgagcatcatgcccaattctatcggaacaacaacaacaaaaagaaaagatagcagctagggaaaaaaatcattttgatgataagcccaattctatcgaaatatggaagaacaaatccttctaagagctactaactctgtcccatattatagctgcctttgctattcaaattttaatagcaaaggtgctataatatagaacggaagtagtataaccattttaatacattggcatgatgaattgatgatacaccaagaacaatgcaaagacatcagctcaaccatgcaacccccccccccgantggcnaaaatntaaaaggggctgtccaggcaccaaaatctttctactggaccaaacctaaaataaaagagaggccttcgttgttgaaacctcagaccaccagtaaacatggaaaatatagcacagcagcacacttatattggttcatctccctggctgatcatctctccgtggccctcctgctggctttgccatgaatgatctgcgtaattcatgagagaaaacattagcatgtactttttatattacatttaaccatcatcttattaaaaaaatagtgtaaactagctgaatgcccgtgcgttgcgatgggaattaaataagagaaccctatcatacactttaaagcctcgaaaattaaaataaaattattctcattgtaaaatatttagatcatattatttgtcattatttttacctcacttcaaaggaaatttccctgtttgatggcttgaggttagggaatggacaaaagtccacttacctcatgttcaggggatccacatgacagtggtggtgggtggtggcaaattcaccacttaccaccaccattagggtcttttaaagagtacatatatgcaaaaatagaagtaacgcttaaagtttctttatgagaaagcatgtcacaacaaaataattaaaacttatataattttgtttaatgagacaaattctcaaacgtcaagccaaaagtcaacatcgtcatgtattaaaaaaaatggagagagtatatgagaatgatttctacttcgtttttaacacagccaacaacataagatagcactcttacggtcttacctggccaacccgcagaacggtacatgcagcatctgcagagtattttagagaacaaaaactgatgagtgaaaagaaggcacatgataagaggtgggctaaaacaagcttaagtcctggcagtagacaaggaaatataaaaattgaattagacgcatggatatcatgaaaagtaacaaagggaaaaacattgcatgtgcttcccacatagtaagtacacctattctgccgtactagaaggtatggacacatagacttactttgtaagttgtaacatagaggtcccatattttcatgatcgagacatccttgcaaacaccttccaaatcaataccagctttcgtgtttcaaccagcatgctcggtataaacagaagatattaactccagagcactaagcccagcattttcagcctgggttcttggaaccatttcaaaacttcaagcaaattttgcaatggcatagtggtccaacctgcataactgttaaccatcaatataggaagcaaaaaccgaaaaatgtatgtactaaggacattgcataacaatcataaaccaaggtacataaacagaagctcatgaatcaaatgtgtcaggcataataacgcataaaactttaaaaaacaacaagtgaatacattaaaaaaataatctggatgggtaagacagtatggacaccttaatatacaattaagctatacctggactttatatagtttcattgccatagaacaggagaatgttagcgacagagcatattatatttattgccaatg

SEQ ID NO: 48201 - DNA, 17530 bp, Oryza sativa
  unsure (1)..(17530): unsure at all n locations
tatatttattgacaatggactggagatggaacatcttttttggccctgttctttacagctactagctactcctaaacgttatattttttggaaaaaagtttacatggaaaaaattgcttagaatacatttaaaaattcattttcaactttttaatattttttttatttatttgtgccctcgaaaagctataaaaaatcagaataatctttaatctataagctattatctacttcgaatggggcctttatcatcatgttccatgcatgaaaattatttggtgtaacaaatatactaccctgtttccttcagagagaattccttcaatctctttgccaattctatttctgttgctgcggcaccaggaataatccgactatccctgcacattgactgtataaacaccaatagtccgataatatctcagcaaattaaacattaaaacagcaggtgtgttccaaaacaatgacaggaagctgatttacacacataccttgtaagtgttgacaccgtcatcaacagctcttccgagatcatccagtatactatcagtgctgcctcttaagacagcaatagccaccgagtttcgaccttcttcattcttgagaacagttacccacaaagaactaaacatggtaagaagaatgaggtcatgtctattggaaaaagagcagaggcatgaaatgtactcgaacacctccaatatcttccagcgaaacagagtctgcatatcctaattcatccgcatttggctggctcagtttcaactgttttttggaagagcactggcatcagcatatacacatagtactgtgaaattgagcaaaagcttgagatcagaacttacaagtgcaatagcccccgtagtacgacaaaacattctcagtttaaattttgaattcattttcctaataataatattagcctgaaaataaaaggaaaagtaagtactcctctaaaacagaaccaaatcaagcatgaagtacccaactttgagatgccttttaatattagaacttccagggtttcagttgagtagagtatttacaatatttccaattttgaagtgtagataagaaagatgcaaagcactgacttgttcacaaaaagtagaagtggagtattgcaaccatccagcaaattcacagaagcacaaaatagtgtaaccaaagtacgtgaattacatattttaatcactctaaaaaagaacaggtccacaaggttgctgtttattgcaatgtaggtgtacagcctctacttgatcatgtactcaatagtccatgacaagggcagtccatatgttagattattgagcacatcaacagcaaaaggaaggaattgtaagaaataccatgagtattctaaagcaggtttacaactactatgccatataacaagagaagaagagtgttatcatacagtgccaattaggccataagatcataactaggtggagacaattgaataccggctaccaattttagaaccctgctacagtgctaccttctaagccttcaaagcttattgacaagatatattccactaaatctaaccaccaaataaaggcaagccttaagaaaaccatttacaccatcagagtgcaataacaaagaaaaatgagtatcatatctcaaataaaaatttcaagaagatgaatcattgagttactagaaactcccgattcatagtggaaagctacaaagataagaacaaaaatatttgatctcagatgatgatatacttcatccatgaaagggacgacaaaggaaaatagaattatcaccacctaatgtatgctactatacagtgtgggaacagccctgactaaacagtatcatcaaatcaagaatagataatgtatcaacagactggcaaagacacaccacaaattaagtgtaacattttgttctcacctttgccttctccaccctttttgacgatgctcccaacagcgccatttttcagaaccagcccgtgaactacagaagagttatgcaaacctaaccacctcgaagtagcttctcaactctaacattgtcaacgttgaagacttgaagttagcaggatttttgggcagacttgcttacaggcctgaaaaaccgtagtacaaaaacccagctactagttttcatccatgagcgcaaaaaggtccctctcacgtaagaatgcaagatggtaacttacatcagctagaagacggcacaatatatcctcctggcctgaatttcttgatcgcgactgtagatcttatccgcaacacaacctcctccttgttcctcacatccatgttctctgaacctttctccaccagatcttccaagatctcaataagcatgaataaatagcctgccatcaggcaacagggttaacaatacaaggccagctcaatcaagagggtaagtaaccttattgatggccttggtgtacacagcgcgacgatcacacttggatgcaaccccatcctgacaagctccttagccttctcaagcagccccatcagcaaaagatatggtgaggttagctccatcaccaatctcctattgctgagcaagtaccaggatcttagcagcagggtgctggacctcaagctcgttcacaattgttgcagcagcgtttgtgacaaagagcttgtcgagatggtcaatgaccatcttattcaatcctaccacaacagaacaacaacaacatactccctccatccctaaatgtttaacgttgttgacttttttaaacatgtttgaccattcatcttattcaaaaatttaagtaattattaattcttttcctatcatttaattcattgttaaatatacttttatgtatacatatagttttacatatttcgcaaaaatctttgaataagacgaacggtcaaacgtatttaaaaaagtcaacggcgtcaaacatttaggtacgaagggagtagttaagaaactagcttctggtgcttatttgaacctgtcaaatgttatacatccacagacaaaatgtagcagaagagcatgtttacgcggagcaacatttggcaatcaatagcgggaaatttaactgaactcaacctcaaaccgcaagacaaaagcaaaccatttttttactacccaaaaggccatagaattttcctcagcgccattatactaacccaatgagctcccacaatattatcttcaactcatcgctaataactaataactaatgtcttaacaatcaaaatccgggctcttctgcagctatgacactaatccaagttggatgcagtagcagtaacacggccacaaccctaacccgtttctaccaccacgccacaacactcacctcctgagctgcgggtaacgagaaaaacctggacatgaagcggggaaggaaggggagggggcctcaccgctgctcgccggcgctggggacgagggaggtggagctcgcggcggcgtcgatgtttgagggcggcctcctcttctcgatcgagaccggaggggggggggtgcttgtgcccctcgcctcgagcatggtgctcagtccaaccatcgccggcggcggacgcgagaggtgacggcggcgttggaggagtatgcgacggcggcggcgtcgcgatgatctcggcgatggcggcgaagcgcgccgaccttgtgggcctccattttgggcctggcccatgaggtccaaagctgcttactactctaggcccaaaatcttaatgggctaaatttggggcctgaaatttagttgactgacaataaagtgacctaatgctttttaaaaagtaaatttcacaaaactttaatatatttaaagtgactagcaaaaatgcccgtgcgttgcaacaggtgaaaaaattctaatgataatatacatttttcatgcataatgatttcaatgacaatatttgtattttaatgagcggcttgtttttttttataaacagtgttcgcgattttctcaaaccattttttaaaatggcacatttctttctaatattttttcttagcatgttttttttttgctttttttactgacgacgaaaaccatatttttctccctctttttttgcttttttttctcgtgtgttttttgcctattttttctgacaattattttctcacgcgttttttttgcttttattttcgaatgttcttttttgcttttttccaatacaggagaatgtatgacgaaataaaagccgtgtagtagatggcaaaaaattgatggattctatccgactcaagcgcccatcaatttagcgtttttctgatagtttttcagagcgatttgttttttaatagacggtgttttttttcttgcgaggttttctcaaaccattttttagaaatggcatgtttttctggcaattttttcctcgcatgtttttttaaaaaaaatttaccgacgatggaaataacttttctcgcatgtttttttatttttcttatggaagatgtaaaacctttttacagtgtttttttttttgcgcttttttctgacttttttctcacgcgtttttttgaactgtttttattttctcacgcgttagagtacattagagatagagaagagatatatactgattagaaatcagattttgtttcacccattttatttttttctcacgtgcactttttaattcatacgaactagctttttattttttacgaaccatttttttgccattttcttagggaatcggacgaacttttttagatgtttttttcagatttttttttcgcctttataggaatcagacttttttttccgtttttaaaggaattggatctagcttttttttaccactttttgtttgccttttataggaataggattttttttgttcggatctatggttttttttggccacataggggaaacagacttttgttgttgttgttgttgtttttctttttttctttatttttttgtggcttttatttttctttttatgcacctttcttcctttgttatctcccttttattatttttttaaaaaaacgacctcaagtaccttattgcaagattatagggacttaaatgtaaatataaaaattacagggactcaaatgcaaaattacataccaaaaattaaaatcatataaaaatagaatgctctcgacatgtaggttccatttttgcaaacagatctccaatctggcacatcaatttttttcaccaagatgtatgggatatcacggtatagattaaaaccgtatggagtggtgcccggatcttggacaagcctagaggagtggtgccttttattttttgtttttaaggggaatcggatttagagttggatttttttcgtttagagataaagaatcggacagattctttttttttatatatttttttcgtccttatttttacccggagtcggattcgtttttttccttttttcgcctttttttttggatcggacaggtttaggttttttttttcacccggttttttctggatcggatagaattggttttttcgcccggttttttgttttttcgccctttttattggacaggtttggtttttttcctttttttccgcttggtttttttacggacagatttggtttttttgtcccgtttttttacggacgatggaagcacctcttatttttttaagtagtagagatatatcaaaagactacaaattgaacaataaaatcataaactacaagttgaaggcaaagtatcacataactactgatttagtaataaaattatcactgaactatagattttagtgcttaaatccttagcactaatattatgtttgagttaaaaatatgagaaaatttcttatttgccattgaaagttcacaagtttccttatatgccatcgaaaagttgctattcctttatatgccactacttgaactttttctttccctatatgccatccatgtcatcatcttgtgtaatagggatgcaaaagtacaatattacccttttaccttttaatccctcgaggggttgttcacttgttttttttttttgcatgtcatccccataattataaatttttttactaacaaagaataatatgtaatatatcactacacaaatatgaaagtttaaatttcacttttacaattttttttaaaaaaatcaaatttggttatagcacacgtatactagtttcgattaaatttattattttcattacaacttgtgaagatcaaatttgaatttgaatttttgactgatatatcaaatattaatctatcttatcatttaatttttttaaatatttataacaattttaatgacggtaataatgacatccttggatggactagcaaaatttgacaaatcaactgcaagataaaatcgttatgctcaagtgtgtacgttgataatgagtgaataaaagcagtcagaagaacacacgagggtagttttgtcattttgttaaaaaactgacaaggtcaaagcggtttgacctcgatagtggcatataaaggatggaaattttcgttggatggcatataaggaaatagcaactttccaatggcatataaggaagtccgtaaactttgagtggcatataaagaattttctctaaaaatattcaattttggtgattgaattgatattaaacttgtcgtttcgtgataactttgttactaaatttatagttttgtactatccgccttaaatctatagttctgtgataaatctagtgttaaatatatgattttgtgatacattatgttaaatatacagtcttgtaacaatttggtgaaggtatctttaattttgtgaaatttacttttatttaaaagaaaaaactgtggcctatacttaatcgagaactatgcctaaattttctacagccttcttggttagtgaatagctgattgattataaggcaacagaatagtttattagagaaaaaataatttttaagtaaaacttttataaatgtgttattaacgacttaaaaaccaaattatagatgtgttatcaactgtaaaattaagttttaaaatttaaattttaataacggctgaattatttttaaggaaaacgatgaggccccctagctttataagcagaaacaatacactactcatataaacgagcagaaataaccaaagtatagtggtacaaattttcataggcttcacctatctacagcctctgcatacatttcacctttcaccgtatctaattaagtttcagaccaacgcaaggagcgcggccaccacggccgccgcgcacgccaccgccgcggcggcggcaacggcggcgcccaccaatgccgcggcggcgacctgcacgctgaagttgcaggcgccctgcgccacgtccctgtcgtcttcggtgacgacggcgagcccctggaagtcgcacgccgcgtcggcctgcccctgcgcctggtagtacacgttgaacgcgtacgacgcgttcccacgcgcgtcgagcgcgccgcagctgcacccgtagccgagcgccgtgcagtcggagtgcgagcacgcgtacccgacgttgtcggcgagccggccggcgtcgtcgtccgtcacgttcgggttcagcacgcaccaccgccgtggcaggtacttgacgcccttcgccggcaccggcatcgccggccgcccggcgccgcggaggtcgagcgggaacttgggccggccgtcgaacgtgaagatgccccagtggcgctcgaagttgcccggcgccacgctcttggtgtcctcgtccatcagcccgaacaggtacacctcgatgcgcgcgcgcggccggagcggcgtgccgcgccgcgccgccagccgcttgagcaggccggagtagaaccgctgcgcgtacggcacggtggcgtgcttgtcgccgtccgtcggccacccgacctcgccgatcacgatcgggaggctcccgaacccgatcctcttcagcgccgacaccagcgtgtcgaagttggcgtcgaacacgttggtgtagttgatgccgttgtccaccaccggccgcggcggcggcccgccgtcgaagaaggcgtagtcgagcgggaagtcgtcgttgccgtagaggctgaggaaggggtagatgttgactgtgagcggcgcgccgctgcggttgaggaacctgaccatgtcggccatggtgccggcgacgtcgtcgcggaacctccccgccgacggcaccgggttgctcgccggcgagtcgtacacgtcggcgttcaccggcaccgtcgccttgatccgcttcccgtacccggcctcgtcgagcgcgcgctggatgttcctcagcgccggcacggtggcgcggtcgaactggccgttgtacgccttgaggaacggctcgttgccgacggcgacgtacctgatgtcgacgccgccgtcgaagctgtacctcgtgacgttctccttcacccactccctggcgcggccgtagtcgccgacggcggcgagcatgtcgttggggacggcgatcatcgcctcgatgccggtgccggcgagccccgacatggtcgtcgcgtcggcgtcgaagatcttcaccttcttgaacccgttgtccttgagcagccgcgccatcaccttgggcggcagccggtgcgtcgccattgtgccccagttcaccccgagcccatccaccaccgccgccgccgccatgatcaccactccgaccaccaccgcgcaacgccacaccgtcgccgccgccatcgccgacgtatcgatccgatccaagaaacttcagtacgcttaaaaaggaagcaattcgatcaaccgatcgaccgacacggcggagtaacgccgagtacggatcaagcgaatgaattggaacgcaacaaccgcaactttttttttttttttgctccgaaagaaaagtagatcaccgctccggcattcaattggaaggtggcaatcataagctggagcaatcaattcgcgaggtttctggtggttttgaggttaattagtggaagaagaacacgcagttagttcagtactacgtgggtaaacaatctgagccttgaactgaaactaaaggggaaatttttcaaatttggcgggagtcctgcactgatgtttgactactctgcagccgtcggatcgcgcgccaacggctgatcagagtggatcacaaaacttgcatacacaatgaggattgacagtaagtgcacggcttcagttcgacagttttgtggtttgattaattagctaagataattgtatgattatgaatacaatcaaatcaattgacaattgctacatgtataggcgtatagcctaagcatatacagagaaactttagggactaaagtagctattctcccggtagggtttggaggacatgatgcgctgtttagtacagtttcttttatttatgcatcaaacaacaccaataaatagttaactaccacctcattactaaccaactaaacatcactaggagaacatggggatacctaacacataatgccctatgcacactactacagtactacctggggcggatccaacgtgggtgcagggggacttgagtcccccctacaccataagacctatggataccctccgaagcatccccttnnnnnnnnnnnnnnnnnnnnnnaaactaaaagttcctaacgggtcgaggttgaagaaaatgtgcccccccccccccccccccccaaaaaaaaagttcctggatccgccctgtactactatggagacaccattgatcgatcaagttcatttgccaacagaggagaaaaatactgcaaagactagagaagaagaagcggttaagtaagcattgtatgaattgtactcaattcagtaaaagatcagtcatctagacatattcaccatcatatttgacactaaagacaagaaatgagagcaagctgtaaagtagatcagtcatctagacctattcaccatcattcctgtggaagtcaagatcacaatagcatcctactgctgctgatgataatatctcctgtggaactctagatcactgtcttttagaaatctcgcattgcacaagttgcatttggttcccgcattctgatgtattgtttggcaatgatgtattatctgagttataagaagaaggttaggatttttttcttgaaataagatgtgcatatttataattcagaaaataacataacttacctttcctgaagccattgcgatagtagaatatctctcaaagaagcagatgacacatagttcctgatcctttgggatcttagcctgttctcttctgtatgattggtgcgaatgctccacctcgtatgggtcaaacttatttgctgcatcaacgatctaccaattcaaaacaaattagctaagcaggagaaaattaaacattttaacaaaaagaacagcaatacgcaataataaaattacctccacaagtctatttactggagtcacaacactttgtccaatagctggcctgtgtaaagcgctatagccataccgagtggcttgctgatttacgatccgcggatcaggagggggctgtatggatagtagaaatcagcagatcaggaggagatatgcacagttagcgcaaatgagaggcatatgcatagcaaacagaaatagtgttttaccttgtataaagagggatcagagatctttggaaccaaaatcttaggaacgtcctgtactgagttctgataattggaggtgcctgcaatttcatcattgaattgtccaatttttactgtattatgatattgttagtaagcaaaatacaatacatttaccaactaacagaacatatttggaaatggaagcatattgttctagcacaagactagacttagtaattctcaagagaagatatctaaaaaaatcacattaaaaatgaattcatcagagtaacaaataaacaaaagagttttattggttgtcaggaatagttacaacataggacaatagcttccctatacactaagaaacattgaacaacattatgttacagaacatggatcacacctttgaatatctaatgtgaacttctagagtatggaggtgatgatgcttcactgcaggctataaactaaaagttcaattaccaattccatctaagcgcatgtatatttacttccattctgattatattgaattaaactcaaatagcttctgtatttgagtaaaacttatgtgggttaatcttgccaggcagtcagcaattaggccccaagtatatttggtttgagaagtgaaaactgattaaaattatcaagatctctgaaaaaaaatggaaacaaagaaaattaggcaataagtgagatataatttgttttgcatgacaacaaaacaaagctcatggaagagtcagtttcatgagtttaataaatattcataacactgtctgtataaaggaatatagattgcatagttctaataccaaataaccatgcaatatcagaacagaactcaagatataagtgtgcgtttctttcttaatttcactgttacagtatataaagtgggagtgctatttattaatctggactgctattccagaattatactgtaattatcgtaacttaagatgggaaaaagacgttgaaatcaagaggtcaccttttgtttctagtgtcgctgaaggcttcaccccattgtcctccacatcaatcaattccaaatctgaggggttagcattttcaacgaggacctcactgcaccaattaataaacatgtgagttcattgcataactaacaaaaaaagaggctaatttaacaagagtaattgcattatgcacagtccattattgaaattcaattgctcagaatcactatttttcccgttcatcagttgcaatgcgttttcaccataagcaacagagaactcaagtcaaccatcaaatactaagggacttcttggcatccataatgtccagctagtaaatactgtcttctaattagaccacatagaaatagtagggtgaccgcccccaaggcccaagaacctgaaatatgttacgctgtttctcattgttttcattatttttcgcacttgtttcaataacctgagtgatttctgcgttctgatgcaaagtttcagcactgaaagtaagtagtggagccgtgcaatacattgtacataaatcaaaaccattcagataattggaacaagtgcaaatggtaatgaaaaactcaagaattattgctaaaactttgggagagtatatttgattacttcaacaacaaagtaggttgaaggatgggtaaactataaaaaggtagggttgtttgtgaagaaattagcctaatgctgtgatacattaaatcaagatgcatacatttataactataacttcagcacacaattttagtttgacggaaagctagtagccaatcgccatgacactactaacagttgcaccctgtagctctgccaaaccaatcaacgaaaaaagacatagaatcttacaagatggctgagagaaggctgcagacaaagctaaacagcaactctaccgaaaacaacaaaaagtagtgcaggactgctcaggccttacaaaagcaatgaactagactgcagtaataaagatcttgttgcatagggcccttagaaaccaaacttgcagtaataaagcaatgaataaagggcatagcaaactgcagacaaacctttctggaattaactgaggtattttccttaaccaaacttgcaatattagatataaagctaactgctattcattgatcttacacttaccaactcagaaagatattgtctttatgacatcatgaaagtacactatacttttctacactacacaatttgtttataattcccttataggaaaaaaaaaagttagccattccctttgtcaggttacattataaacaaaccgaaagtgaaagagcctgcacaagtggatcataatttaacagcaaaacatgcaaccatattgttgaaacatcagataagaaacatgaaaacaaattgcaggaccagtatacattcaatataataatgtaaacagactaaaccagtcagacaacaaaaaaaaggagagatggttctttttaccttcttttatcttctccagcaattaagttgtcagaatacgaaagctgtaaggaatttcaatatattattgttttaacttcatgtaaaacaattaacaaaatgcaactacatcttacaaattatcgtgcaaaaaacctttaagtttgttgtatgcatgttttgcttatcagtctttgaatcaagttccaaactagcgttccactcaggcgaacaacaaccattcataaatatatcatcaatatctttgttggtaatgtttggacgggaagtaatttcaccctgacttatgcatttcttgagctccctctggaaagatggttatatgtgagcacacgacatgagcaaacagttgattagctggaaaacaaaagaaacttcagatgtaaacaaacccatcggtggaatcgaagaaggggcaacacgaattctcggtaatcagtgcatgaacttttgaggagcttatgacacatttcctgaataattttacaagcaacatggaactgcaaaataaaaccaggataagaataactgtaagcactataatggacatcaggatgaaatgttgaactcaaaccatattgtgtaaaagtaccagacctcattacttgatctatccgaaggtaaattccgcaacttcttcttgactgccttgatgatgtcatttccttcttttcgtttctccctttgcagttcagcagcatcagctacttcctttgcagtaaatggactgaggagaaaggatccaaatgcaccttccacattcatgaaacaaaataagtcatgctgacttgagtccttgcacacatctatgacgtctaaggaacaacaatgctcccccatcacatcctcacacaggtttggatctgaaacttcaagtagtttctcccctagtgaaccaaaatgggaattacacaagtgagtccataacatgacagtgctgtcgaatgtaatgttagagcatcctcaatgggggcatttcctcagaatccatgatttgctactactcacgaaatgatgagcatctgttagagacttggatagtgaacggttgattttgctgtagtattcgcaaagaacatcaagcctcacagataggatcattcgttgcttttcacttgttataaggctccaatcacgtcttgcgaatagtacaagagtttgtagaagcccatggatctgtttctttacaaagcaaatccgatcatcatattcatcccctttggtagaccctacagggatgtcgtgactgcttggatcgtcagccttctcaatgggctcgacaacactcatcctcagctgcagcataatcatggaggacagccatcagtcctgcacgaaacagtgcgatcacaagagagtgatctgatatttttgcagcactgtccatgattttcagggcacattgtaggacctcctccttatcagcatctggttcaatactcttggcaaggtccagtgccacataggttggcagaaattgcgcacgagctgacttagggaatgtggttgcaacagctgcggccctatgcaccgcatacgcgactcctgagctctttgcaatgctgagaacacgctccacatcgacttcacaacaagcattgttgtttatatcgattgctcgttggagcctttctcttgctgcagtgattctttggctcttagaggctttttcaggtagggatactccatatgaaatgttatggatggcaggatctaatggtcgtgcaattgatagtgctctgttgaactgggattccgccaaactgtactccttagatgcagaaagagactcaccgtgggcggtagttgtctcaatgcaatctggaactgcttttgcagcagaaccatacatatcagtagcaattcatagagacatttctgggctgcccttggccgctcgggagtgaaatgccttcatattcaggtcccctacgaggttgtagatcatgggacatggagaggcgttgaagaggctcatagcgcgatcaagcgccatgtctagatcgccattcctctgtaaatccagaacttcggcagcttccctccgtaacctcatttcatcctccttttgtcccctcttggaccggctggccctggcctcctttcctctgtccattctgccgcacccgcaagctgttcgtcaaaatgccgcagtgggagcgagagcgaagcaacgattttacgaggaaggagatgtcacgtgtagtagttggaggacggcggcgacgcgtgggccgcttgggagcggtaggagaagcgaagcggcgaggcttggaggaggtgtcgagcgcggcgaggcctggagacggtgtcgaacgcggcgaggcctggaggcggcagcgcgacgagtcctggaggcggcgaggcgcggaggaggccgcgagcgcggcgaggaacggaggcgaaggcgagggcggcgaggtgcgtgggcttggaggtgcgcgacgggcgatggccgaggccgcgagggttttcgtgggatgttgggtgaggtgagtcgtgcagggccaaagggcctaaaggggaggaagtaggtgaagcggagaacgcgtgtcctccgcgctgttgtccgatcatagccgttcctttgaatagacgatcaagatgtgctaaaagagggataaaattttagcagtaaccacttgaacctctgaatattctgcattttttaacagaaaaactggttgatggcagtggcacgtaaaaatagtcatgtgaagcaatcacgcaggcaaatgatgtgtattagtagtagtgtatatgtgtgcgtgtctgtaacataataatcttagaaaagagaaaatagccattagctatggatgtgtgcatacccatcatccatgaccatgatcccaccaagcttccgccacccgagtctgcttatttgagcttaccaatttaggtggtgtttggttcggatgtggtaacgtaaacgctaatggtattgcctccagccgtaacggataccaatttatccgattacatgattagtttggttgcaggcggtaacgtcatttatttacattactgcgtttggttgcggatggcagccaaggaacgggaggctgatcaataggacacaattcgaaatttgaaacagaagcctttgggaagatcatttgctccgattacactaatcaaagaactgcttgcttccagacaaccattgatcaaataactgattatacaagtatgcttatacaagtacgcaattaagcatatgacataagctatgaaacattcgcaccagacacactccagtactatatcaacagcagctgacatcaaaagctacataaagaagctcaataaattttgacatgcaaatgtttgaaagataactcgagagttaatttcctatacatgcaacgagcagagttttggcagatagttcataatattccaaacactgtcacctcatgtttggatacaaattttgacagtgagaactcaagacaaaaagacattttgcagattagtaaacaataagctaggggcaatacttctgtctgaaaaacaggacagtactttgatcacagaatatgtagattgtcatggttcaagcaaataaagctgaagtactgaaactaaacatccttaggacataggtagtctccaatccccaaggcctatgcttatatggaattctaataattcaaaaacaaataatgaacatcttgtagatcatgcttgacagccagcacatcagtacatcaatttttctttgcctcatctgataacaaaaaaaattcagaaattagtgaaagaaacattaggtgaaagaaaatatatagtgctcagcatcataccaaattaagaatattcttgcacagacaagccatatatgatattcagaaaaaaggtagcattttttaactttaggagtacaaaaactcccagttaggtgtaagcaagtaagcaagagaccaagcacatactccagttagaagtgaatataatattactatggcattgagatggacagctgggtccattgatgcattatactagtgcaaggcaaataatatgaatgcatatatgaaatgctaagtggtaaagagcaatatgcttacaattaatgatcacaaaataaagtgatatgtttcctgttgcatttgcaacactacaagattgatcaagtgaattaccagcaagtattttcagtacgtactccctcctgagagactctggaagagcgagaagcatactcatttgagccggcacttttacaaaagcagctgcagcattgacaacttcagtaccagtcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48202 - DNA, 938 bp, Oryza sativa
ttttttgctacggtaaatgccacattttttgtagtaatcttgccaagggtcaggatcctcctcctcccattcaccttgatctgtgggctgcttctgcgatccggccgcttcttcccgctcgagctcccgcaagatgtagtagaggacctccttgggtcgaagcggtaaaaaatcaaggtgcaccgccgggacgttgaccatgatactgcgacggtagtagtagtctggagcaaccaaagtttcatgtgcaatagcaaggacttccttattatctgcatctggtgctacaatggcgatggacaacgtcacgatggcgtttccaggaactccctcaatccactccaataacttggccttcacgtagtcgtccagagaagggggctcaaagacgggccatcgagcagaatgatgggccaacgttggtgttgccacagcaaattgtccttcgcggtcatcttcatcttcttcttcatcgtccccagcagcatagccacctgttgcatcaggtgcggccgccttcgtcgtggctgggatctcaacgccatacctcagtcgtcgctcgccgacgtcccgcgcccggtccttgagctggcggagctggatggccgctcggtgctgcgcgaccatcttgcgcagggaccagtagacccaccagaggtgtcgccggagtctacctttggcacggtggatctccgggttcccgctgtagaggtagaggtcgatgcagttgttgcagtcctgcgcgagcaggcgcacctggttcatccaggtgcgcacctgctcgtcgtgctctccaccctgcggcgcgctcctggctaggtgccctacgaagctgttcatgctctccatctcctccttgatgaactgcacatcgtcccggacgccgccaagcagcacagcctctttgcggatgaccaccagcagtgagctcacggcgc

SEQ ID NO: 48203 - DNA, 4984 bp, Oryza sativa
agtatatatatataaagccatttattaatattgatcgactatttacaagtcctatagaattcatataaaattttggtgggatgaggctcaaccgtcgtagtataacgaaggctcaacatcatcatgaaaattcctaaattctaataaaaattccgataaacggaatttacctcttacaatctctttttttcctgcactacatccaaccgatcaatgctgcattttttaaggaactgtctaggtgtttttgacaattaaaaaaaccctcaaatcttacaaattctggaccattggatcattttgagatttgtgcaacatacctaagccctacatttcctcctccacatcacagtctgcccactgccacctccactttcacgcgtgtgaacgagcgcgagcgctcctctgcctcttgtgaagtcgctgtgccaccaccctgcctcgctggctagtcgaaaggggtcaacggtgcagacgaggctccctcggccagcctcctctccctcccccttctcttccacaaggtggcgacgtcgagtgtccccaccccgttgtcttccccgtctccggcggctccccaccgccagatccgccaccaccagcctccacctcctaaccagtttcgttgttttcccccgccaccaacgcatgtcctccgcccactgccaaccccgtggctccagcgccgcgtcgacacctcttcgcccgcccgtgtccaccacccacagccatcactctaagccatggggaaccctccccctctcctccaaccccaaaccctaatccatatgctccctgctggagttggggggtgtcgtcgcgccggagaagagggggagcctgccgaagttggaggggaagaagccgatgcacgaatcttggcacggatccaacggtccaaaatatgtaagatttcatcactaaatttctatcgaatggtatatagaaattccaatttttcaaacctattaaagtgcattctttgcatgatctcgtatttccgtatcatttgtaagttccaaacacaccatcaatacattcacaagtatatatgcattttacaatctgaatcagcaagtgccaaagggcttgtttaggggagctttagattctgagaagcaactgtttggtagccagcttctgagaatctggaaaaactctgaaacccagcttctccagcttctggcttcttagttcatttttcagaatctgtaactacagattctcagaagccgtggaatgtttggggcagcttctagcagaagcagcttttgggaaaaactgcagctgggacaagtttccccaaacagggccaaagtgagatgccccatttattttcactacctgttatattcttccattctattctagactttcacacgtcacactaaaaatcgttttcccatatggccaaagatcattttcccaggggggagaagacccgcctgtacgcataagcctgcgaaaaatagttgattttcgcaggcgacacctctatctttgcagacatcgtatccacccgcctgcgaaaatactttggacgaataaaaaaaatatatcgccaccccacccctcgcccaacccacctccgggtgcgccgttgccatcacccctcccccctccgtccagatctagaagggagggaggggatccgccatcgggaaccgtcaccgcctggagccgcgccaccaccgtcgggagggagggagggaggggagggaagtcgcgcccgggaaggaagccgccaccgcctggagccgtcgccgcctccaccagatctgggagtaagccgccgcctcctccaccctctgcgccgtcaccgcccttccctctaccccttcctgccagttcttggaggagggaggagaatcgccgccgccaccaccctcccccctcccggcggagccgccgccacctccaccctccgtgccaacgctgcctccaccgtatttgggagggagctgccgcctcctctaccctccgcgccaccaccaccgccctcccctctccctcctcatgccagatatgggagggagggaggggaaccgccgccaccaccgccctccccctcctagcgggagccgccgtcgcctccttcaccctccgcgctgccaccgccctgcggtcggatcccgcgccgggagaggagaggtgaggtgtgaggggaggggagggagaggtggaagggcgaagtgctcggacttagtattttgatggataggtggtgtttttaacatgtttaacctttttgcaggtggaccttttaaggtaccacctacgaaaatctattttcgtggatggaccacttaagaggtccgtctgtaaaaatagattttcgcaggcggataacgatctcgctccacggttgtcatttttacaggcggctatttagctccgagagccgagagctcgttgtgatcgtcgatcgtttccgtacttccagatgttggctcctcagatttcttctttaattgttccatgctttacaaagaatggcattttttcatgctctccccaacacgtacgtaaatttgataatacctcaacccaagaggctagagctgatttgaggatgatccatttaaggccgatatgctcgccgtcttacttttcgtcctttgtttaattagtgcagtggaaagtatcgttcattttatattaagaattttagaaacatttcaacaacggaggtcttttgcaggtctaatgatttcaaagacttaatctaaatgaaatactaaattgaaccaactggcattcttgaatcctaagaagtgcctccaggcccgtttgacactcacgtcggattaagtctaaatactaaattaaggcaatttaaatatttatatttgtgaagtgagcgtagcttaactggttagattccttgtgatggaaccaatccagccgagttcaagtacagacttgacatggattctcgtatttacgataaattattcttacgtcaatggcgaggtgccctctccgattcatgtattttaaaggaacccttagagcaagtactataaggccatctccaaccctccatgtcatctagtgcctatattatttaatacattatcacataagtaaaaatctgatgtggcaagggagttaatgaggtgagaggtaaaaagataatgaaaccatttctcatgcaagaaaccatttatacacaagaaccaagaatgaaaacaaggagatagatggataaaagaaaagaaaatagaagtgattgaatgagaatttaatttgaagacaccatcaattattagatatatagtttatgtacatagtgtctatatgacatggcaagtatggaactaattggtagtttctgggttagtgatggcctaagtacttaagcgcttgcctctagatgccatatagactcatttactaatgtggaagataaaagagaggagtgagtgaatgagccacccctcatacaagtggtaatctctacacaaacttcaataaaatgtgattatatttattagagttataggagtttgggtgttagagacaaaatattttatacgtttcctcttgatttatagagagatgatatagataaaattagaggtgacaaccacctctactgtaaaactactcatggagttgaaagaaagttgtcccacacattgacgagtgccagctcatctagacttgtttaaaattgttgaagataaagaataaattagtgcacataaaacgagaaaaccattagcacatatgattaattaagttttaattattataaacttgataaatggatgtatttgatattttaaatcaacttctatgtagaaagttttcgcacgaaacacaccgtttaatagtttgaaaagcgtgctaacagagaaacggaggtaaaatcttaatcttaatgtcaaaaagaatactagtgcacgctacatgacaataatcagatcaagctacatggattgcatagcattttgtcaccaacaaatgaacaagaaaagcatatatagcctgaaaagggaatggtaccaccacacctataacattcccttcccctcttcccttcccacacacagcgtatatccatccatcctaatcaaaagtgtcattttctcccacagctatctgtccccaaacacatctaattaaaagagtactattaatatatataaatgttgtaatggattcatattaattaattgattaattaaacattaattcagatctagatcgtcctcttaattggagtgctaaattaaatggcatatggttaatttcttaatccaccaagtggattgccgcacattctacacggcaccttggatactgagtactcctcccgggagtattttgatgcaataaataactaaataaatgcaactatccagtcttgcacaactatcaagggattaaattttgtcttggaacagaacagagatgcacctaagccaaagagagggcaggcaaagtcatactcctactaactcgtagggctgtcaacgagccgagctcaagtgagcttgcctgtctagatacaagcctgatacaagctctgagccgagtctataaaatgtttgagttttcagacatattcggttcgagcttgactactgagcttttaatttttaagtagaacaatgtatatttcaaagataatttttaaaaaatagtacatcatattaatagaagaaaaaaaaataaaataaactatatgacgccaatacaagtcatacaaataatatactcctaatttattaaataacaacaaaaatcatatattagtagctcgttggaagcttgaggttggctcaacaaagctccacgagctttgggagaggctcgggttcagctcgtttgaagctcaagtctagaacaagtcgagctcaagcagcttgcgagcctcagagctttttttttttttttttgtgatagccctacttgcaagagcctgaatcaatatagtgcaattatatcctggatgaattgacacatttcgatttat

SEQ ID NO: 48204 - DNA, 7154 bp, Oryza sativa
catttggttaatttcttaatccaccaatgggattgccgcacattctacaagacaccttggatactgagtactatttcgatgcaaggaataactaaataaatgtaactagccaattacgatgatgatgccggcgacacgtgagtgtgataccagccgccagtcatattgctttttcctggaaaaccattgccccaagctgtcaagttcactgctctagattctccccggtgtggtcaaatggataagggaggggtaaatgtgcttaagccacatctagggttttcagtgaattccagctgatatctatcgattcggtgacgcagctcgccggatttgtagagttcctgagagagattatgagaccagagactgatcgtttgtggaagtggtgatggatttccgtcctttctcaaccgcacaacgagcaaattaaatccgggcgaacaagcaccgagtgatggaaggagggaaccacgaagctaattagagtcccattggttggtttaattagtcaaagcaaaagctaacactcaaacttaaatttaattttaaagttgattttaagatatttttaatataatttctttttaatattgatttttaagtcgctgcgaataaatataaaaaagttttacttataaattaatttttatttcctattaaaccaaaataacttatgagaaaaatgagcaaccgatgaggctcttgcaagaaaaggagctgcacagataacttcgtgtcttttatagtagtatattgctagatggcaagagtgaggcatgtttaatctgaaagcctcgaaactaccgtattatactaactaaggtgtgtttagattcagggagtaaagttttggcgtgtcacatcggatattatataggatatcgtatggggtgttggggcattaataaaaaaaactaattatataatccgtcagtaaaccgtgaggcaaatttattaagcatatttaatccgtcattagcaaatgtttactgtagcatcacattgtcaaattatggagcaattaggtttaaaatatccgtctcgcaaattagtcgcaatctgtataattagttattttttagcctatatttaatactttatacatgtgttcaaacattaaatgtgacgaggtgtaaaattttgggtaggatttaaacaccccctaacgatgatattatttaatgggaaagcggtgccgaaataaaggcaaacccaacacaacaccaaagccaaagaaatgcgccgtcgatatgataaggtcctttcatcatgcacaaggcgctcacgctccatctttgcttcagaagtcccaactgatgtttatattggtagagtacgcagcccggctcatcaatcgtgggctatccaggttatattgggtctgctccaccacagatctaaccagagcaacaactttatcccgagcctacacaaccaaaaaaaactagtctgatgggtgaggaccgcccacattttaagtcgtgctcctccatcatcaattaccgatgtgggactaaacctaacaatctcccccgtcacatcaacccatgtgaccccgaagacttgttatccgacctccccaccatatgaccaatagaaatcgttccggttccaaacctgggctcttataccacttgttagagtgcgtagcctagcccaccaaccgtaggccacccaggttacattgggcttgctccaccacaggcccaaccggagccacgcaactttaggtcatgggcccccacaacccaaaattggttatatagcatcgaaagttcacgttttttttattttgtaacacagaatcattataatatattttaataataaattgagaaaatatatatgctattatatgatagaaaatataatgatactatccgcgtaatttgcgcggaccaccatgctagttgtaataatgataactaatgcgccgctaattaggacagaccgctagcgcgagggccatggggagcgcacggctgtaatagttaattaagcaggtggtgcgtgcccactatgaaccccctatacataacctgtatttggttttgtggatgttgtgctttatgctacacgaatctcagaacatgtatggacggctggcatcaatggcggatttgccatggtcggcggggtctcgatcccctactaccggcgttgcaatcatgggagcccctattaataagccctcactaaaatttgttgccatacatgtattataggagggggttataattttgtatagtttgttcagtccctactattagttcttcttggatccgcccttggctggcatactgcgtgtataaaacccggtcctgttgatgaagaaataaaatcgatccttatttgtgctgtcgtgagaggagaggggagggttgtcaaccgtgagaattgctacctgctgcttactcccactgcatgccatggccggatggtagcagctaccagctgctgctgtatcggggtaggcggatcacattggcaagtttggtagagctaagaagagatggccgacgtcacgtttggcgccgtgaaattggtgctgggcctcatccaggatgaggcccggctgctcagcggcgtccgtgaggacctgcgcttcatcatgcaagagatggagagcatgaacaacgtgctccgccacctcgtggcaaacaaggggagtgccgccgctgactaccagctccgtccgtggatgaagcagatcatggaactcgccttcgactccaaaaactgcgtcgagctctacacgcagtccggtggcgggcactgtggttggcagccctggacaatggtagctcgccaccgggtcgtcacccggatccgcgagctcaagatccaggcgcgcgaaatcagcgagcggcaggcaaggtaccacattgctggtgttgctcatgcccagcagatggacgcgaccaccacaatagagcgctgggatgctagtgtgcccaaccagagtcgcgcctgggccggcagctctaacaacccatcccggcgtgccatactccacgacggctggtttggcgactacatcagcgtggatgaggctctctcgcggctcaacccgttcacgctagaccgttatgaggtagagccaccggcgcggttggacagcgatgacgagcagcagccacggcctcagttgaacagcgacggtggcaaggagcagcccctagcgccgcagtcggatggcagaaacaaggagcagctgccgcctccccaatccggaggcggcaatggcatcaagcagcagcagccactgcctccgcagtcagatggaggcgacaaggagcagccgcctccttcgctgtcggatggtggcgacaaggaccagccgcttcctcccgactgcggcgtcaagcggcagctgccgccccagtcggacggtgatgacaagcagcagccgccgccccagtcagacggcagcgatcagccgccgccgccgcagccggatggaggcgacacggagcagcagccgcctcagtcagacggcggcgacaagaagcagaagcatattagagtcgtcacaatcagtgtgcaagacggcacggatgaagctgttgctgcagaggccgtgatcgagcgtttcaagagccgctgggcacggcggggactctggtcgcagcagctctgcctccacgtttctgtccatcggcctccgattctctcggagattacaaaggtcatggttgaaaagctgaaagagaaggaggatgatgagaagaatgaggcggaagacagggagtggcttggccataaattgaaagatgaagatgtgctgcttgttctttccggttttaattacccagcgttatggaaccaggttctggatttgctgacctcgatgagctgctctgactgtgcagtagtactctgcacaaacgatagtaagatggcaaaatattgctgcagcaatgactctgccaacgatgggcctcagataatctactctctcgttgatatttacctcaacagagcgctcgccctgctttcccacagctacggatacgaggaaggacacttgaaagaaattctgcgcaacatcctcgccaagtgttgccttgatgtcttctgcatgaagatgctcctccatgccctctactacaatcctgacatgacgaaacaccaactgcagttcctgaatataagccttggtaaagaatttacagatcatgggagacaggaccgaataatggccttctgctaccaagcactgccaaatagttacaagaactgcttatggtattcaaccattttcgcccgtggaagcggcgtccgaagggcaagtttaataagacgatggattgcccaaggcttgatagcccaagtgaaccagtcaagtgcagaggacgaagccgggcactgtttcgaagccatgcacagccagaagcttattgtttcttctggtcttagtggtacacgcaaggtaaagagctgcaccgtgcatccagtagtttctggcttgatcagcagggagtcttcgacagttgaggacctattgctcaacaaccagctgccacttgacttggatctcctctactcaatccggcacggcatgcaactccatccggcaaactctaatatcaaaaagttcttgaactcactttccagcagttcaaggttgctgctgacagtacttgatttggaaggtcgcaagggcctcaaggcaggcgacctccataccgtatgcaagattcataaactcaagtatctaagtctccggaacacagatattgcccaactgcccaaggaaataggtcagctcaagctcttagagacacttgacatccgaggaacaagggtacaagtgttccacacggcgctaccaatgctaaagcacctgcttgctggttgcattattgactacccaaaggaagacatcatcaagtccaaggaatcattctccacggtttccatgcctcgtgctgttgcaactatggaaaagatggagatattgtcccgtgtcaaggtttcgaacagtgctaaagaactgaacaacattggtgacaagctcgagcacctaaagaagttgggtgtggttctatctggcaagaaagctagcttgatagatttgttccttcaggttgacaaactccacagatgtcttcggtccttatcaatccgaatggatccaccaggtaactgggattctattgatgttattttattgagacctccaaagcttctggagagcctacacatctgcagcatcagaagcgggttgcctcccaggatcaaggagctccatcagcttgccaagataactctacgtgacacctttttgaatcagggtgccctcgatatacttagcatgctcaaaggcctacgctatctcaggctttgctaccattcattcgcagaaggcgctctgagcttcgtgaagtttgtggaacttgtggatcttgtcattgaagatgatattgttaacagtgtcgccttgggtaataatacttatggtggagaccctgataaacttgaaaagatagtttggtccttcactcacatggaggagctttcaggggtcagtacgctgcagagtctgacacacatcgaactcaatgggagaacatggcacctacagaatctggaaaaactgaaaagagaagtagatgaatgtgggattactttcacgctcaatccacctgagaatggccaaggatcaaggctgtaggtgctatcgtaccccataatcatcaatgctgagaaagatggaactccgtaatcctggggagtatttctaaattctactacggctgcttctactatggaataaagatgtttttcctcttccatctgtcatgttggactggtattgcacctttatgtttcgagtgttaatggcaatctcatattgtaatattgtttccattgctttcagtttggtttagttgcatcctgcattttatttctgcatgtattagctcactggaagtagtccggggttatcggaattcagttgagccgttaatttcattttctgttaggatgctgagctgatcactccaaatgtgggatgtcacgatttggtggatgggcgtttaatcagcatgctttgcatgtaaaatcctccagctttggagaagagcaaaacaaaaaaaaaaagaaggaaaaaacagaaaatgctgcagcttcacgcagcacaaaaacttttgccttctgctttttttttcagtttcgtcagacattttattcacgcaccacataatcgtcaatgctgagaaatatgcgggttgtattaattagatttatctgcatccagaagaaaacatgtacatttaatatagtgatttgagattgcttaatgtgcttctttttttaatccaaaacatgttttacatattttgcatcagcgtgcaaacgattgttgggctgagcaatttctttggacttaacttatttccccacaagacaatgagcattcttgagcctaacgtacgcgttttgaaaacttaacaccagttgctagttgtccattcctagaataaactgcacaagaggagtatagaggaagcaaggcagcatataggccagcagctgctaccagtgtgtggttgtagttacagctgatagtaaaatggaattggtaatcaaccgaagaatagtcgcgcttcctagctatccccattcgagagagttgccacgaaaagggactcctaccaattaatagcagaagatttgcaattcctaaagccatctcgcacctactcctatccaagttacagttttgctgccgcgccatcgatctctcgctctcaccagcagaaaagataagataacatcatccattcgctatccctcgccaatctaatcccaaaaagtgaaatcgcgacgtctcgatgttcaattcgaaaagcagaacaacaataatgcagctgagacgaacctgcggtgtgcttccccccttctttcgtccagctaggcgaggttcgaccccgcgcgcgcgcgctcgcgcagcgcggacctcggaggcccggatccgccgtcacggtgggggtgcttcgccggtggagctcgccgcctcgccggcgccgccgccctcaaacccttgcgccgccggccaatgcagccatcctgggcccaaaaccgccatggatgacgaaaggcgacaggccgaagaacatttgttgggctggcggacgtgacgt

SEQ ID NO: 48205 - DNA, 9708 bp, Oryza sativa
gtacatgtgaggggtagcaccgtcatatcgcgtgcgtagatgggtcaatagcgatcaaggcggacagaaaacgatcgagaattgatggaagtgttaaaaatgggaacaaggtgaattttgggtgctattaaagtgaaccgatatctttcggtgctataaaataaaaaacgtgaactttcgatgctatataaccaatttttccatgtcatatatgtgtaatccctccgtcccaaccgatgtttgtataaggccatatttggcctagctctaactcccaactccaacttacctagagctagagttgtgccaaacagtccagattctctgtttttgagagtggagttagcagaactactcctaaaaactgaactacgggggtggagctaggtttttgctgcttcacagctccactccaacccaaaagatccactaccgtttaatttttttaacatatttacacaaaaataccattgaattaccccaaacccatctcttcacctctctctccctcccacctcccaccagctggtgcccaggcgacgggtccatggtggtgctctgacggcgtgggctggtggcacacggcggcaacggacaacgcgagcagggatggcgcatgggtagcgaccggcggccggcagcgcaggcgggacaacgcacgggtgcacaggcggcacaggaggtgtgagcggggacgacgagcgggcagcgcacggtgccgacagcagcgggcgagcagcgcacgacgcgagcgggtacagcgcatgggcctcgtgccgtccgccgccgcggcgacgcaaaggcggcagtaggtggggacgacgcacgggcggggacagggcggcagcatgcgagcgacgcaaggggagcgccgtgcgggcgaggacagagtggcagcgtgcggacgacgcaagggccgcggcttgcggccggcgaagggctgcgcacgcggggacggtattagggatttttttttggtttttttcattttcagatctggagctaaaagttagccaaacacttttcaactggtatctactcccacatgagctagcttccactggagtaaaagtttagagctaggagatggagtttggagtcttatcaaacggggtctaagtacgatgttggttttttttagagggagtacgagttttttattggcacccgaaagagggatcacatacacaaaacatagccagattagaaaaataatttcgtgtggcatatgaaagatgatttacataaaacaacatcaatgcagaatattctattagcatatgaaacataaattatattttcaaaaaaaaataatacatgtaaattaaaaatcttaaaatatacgcacccttcatattatgtaaggagctgttctattcccccgaaacaaaaacacttcctgtggtagagttaggattcaatctgctgttcaacttaagaagagttgggttggttcggggttttgtcaactgtgtagccaaattgagaattcagttcatatttgctttacatgcccttttgcaactttcacctggtgtattatgcttttggatggccaaggattcctcatgactttgaggatacccttaccatggtggctggggatgatagttcgaaaaaggctaggattagatatatgttgcttgctacggtgtgctggattctatggtctgttaggaatgatatgattttcagcaacaaactcatcgcgacgcctctaacaattcctctttgcgttgcagtggaaaccaatgctgaaacctgaggaagttcctacgctggatgtgacggtggaagatgtgcacgatgacaatctgcgaccggcatgagtaggggttggttaggttgtgagtctgttagtttctctgttttctgtagttgttcattgtcgccaaggtcgctggttggcacacttggcagctgtggctgagttttgttgctttaaagttgttcccctttggatgatggttctcatgttttgctacaatgaaagctggatatcccagcaaaaacctatgcaatctctattgttttctgtaaaaaacagggccgtctggcctcctttataaaaaaaaaatatttcattaactagtactcagaagagtagaatactccagtattaagtacactatccattgagaatatatctcaagtacactgctctagacataacacgtcagggcatggttagtattgggtctgctcggttcagctagacagtggctgtacagccgcagtgctgcagttgttttagtataaatttacttggtagatcctgttggtgtggctgcagcgcagccactgctagctcttccgaacacagccattgggtacgcggcggaggacgcaagaagtcaggagcccgtgagaccggcggaagcgagacggcgcatattgcaaactgaatgagcgcgtgtcgggggagctacagtaacatcgaattggattgagtttgttaggattaaataacatattgttagccaattgttatcccttcttcttagcattagtttgttactacctccgtcctaaaataagtatagttgtgagtattcgtgtctaacatttgatcgtccattttatttaaaaaatttatgaaaaaaatttaaaaattagtcacacataaattactattcatattttatcatctaataacaataaaaaaataatcataattttttttttcaaataagacaaacggttaaacgttggatatgaacagttccaaactgcatttatttttgggatagagggagtacaattgtaagctcatttaaggagcaccgtaccgtgggaagagaataaacaagccgattcaatctattactctcatatccatttatcttttcctctcatcttcttctgttcgtctctgtcggcgccatgggtcgccgatcctccaagttaccgaagcccagacctccgaccactcattcctatcctatttgatcaatcccaggcgctcgtgacaacttgacataagagaccatgaaagaaacagccacaagtaaacagccgctcctggaacctgccgatccaattcaccgagcttcaagacacaatggcggatgcccttagtggcatttcgctgcttgcgtctaaatcggatttggccgatctcagccgttcggtcgtggtggccacctcgagcatcacatcgctcgaacagctggcggcatcttcatcggtgaagtccagcggcgctccttggctaggtgggagcgggatcctcgggccccaacccccggcaccgcatcaaccacggacttccggcgcgccacacgactcttccgcaccgacgacaggcgggggtgttcctcatttctacaaactcgaattccctaaattcgacggcaaagatgatcccctgaactggctcaaccattgtgagcagtttttttttaggacagaaaaccggcgatggcgatcgggtgcagatggcaacctaccatctcaccggtgaggctcaagattatgaggaacacaagggaccccccaaattgggagacattcaaggagttgtgtcacgtccagttcggccctccaattcgaagcaatccacttggcgaggtcaaacggctgacacagacgtcgacggtggcgacataccaggccaagttcctcaccctgtctatccgagagccagctggttcagctcttcaccacgggccttcgcgaggatctcgccatcaacgtctagctcaataaaccagaggacctgcaggaggccatgagcctcgcacgcgcctatgagcgcaaggcgtccaagcacggcggcagggccaaaatcggcggcgcagctccacggtggcacggccgcggcgacagcaccagcaccgtccgccgaaccgacggccgacacgggccaatgaaaattccgccacctgcctccggcggaactagcggaacaccgccgccgaggcctgtgttacaattgtgacgagaaattcgtgcgcggtcacaaatatgcacgcttgttctacatcgagtacgacgacttggcgtccgccgccgccgcccgccgatgacgacgcaaaacctgccgaaccccgcgtctcgctgagcgcactatccgtcgtcggcggcgacaacaccatgcggcttccagtgatgatcgacggcctgcgcgtcgtctcgctcatcgactcgggctccacacacaacttcatccacaccgagctggcgcatcatctacgactccgtctcgagccggtgcgcgacggcctccgtgtcgtggtggcgaacggcgaccgcatagtcagcccggggcgttgccacaatctgccgctgttgatcgacggtgaaatcttccgcgtcgactgcttcgccctggacttgtgcgccgtcgacatcatcctcggcacggaatggttgcagttgcagaccttggggccggtactctgggacttcaagaacatagaagaacaccgactggttgcattgtcagctgacagagacttgcagtaaactgttgagatggatcatttaagcagaaaccaatatgccattagcaaataatttgtgaacatgagaataaactggaacacagccccataccacaaaagaagggaattggagagtttatattcataaatctcaaagcggtcttgaattaatggcggtgattagacaaacattgatctcaaaaagatcaagcggcatgctccaaattgtatcacagaccataatcattaaagaaacacacgatcaccagcaaatggtgaagtattgcattactactatggacaattgaacaatcacttgtgtcactaccaccggaagaatctaactattaagggcccctttgatttataggaaaaatatagaaattttggaggatttcaatcatatggaaaaaaaatcctatgaaggcctttgaaacaaaggattgaatcctatctaatcctttaaaattcctatggaatgggtaatcctatgcacattttggaggaaaattagcaagaggtctaacctcttggaacatttcctatctctcgtcttctgattcctgcgtttttcctgtggtccaatcaaacggccattcctgtgttttttttatgttttgtaattctctgttttacaattgtattcctgtcagaatcctgtgtttttcctattcctctgttttttcgttcctacgattcaaaggggcccttaagtgttactctccttttgacatttgccatccacgacttcacacatacaaaattaccttgcaacaaaactaagggcccctttgaatcaaaggatttatataggaattttataggattcaaatcctataggaaatttttctatttggccctttgattcaaaggatttaagctttccaaatcctatgaaattcctatggaatgacacattgtatgtggattttggaggaaatttagcaagagctccaacctcttggaaaattttctttgagtctatctctttcatctgattcctacgtttttcctgcgctccaattaaacgaccattcctatgtttttcctgtcttttgtaattctctgttttacactgcaatttctgtcagaattctgtgtttttcctatccctccattttttcaaccctgcgattcaaaagggccctaaatggatttggtgcaatggaaaaaagaagtataaaataccgagggggaaacgtcttgtgtatctactaatgcgatgccaatttcatcctcctgggattcggaatcagccaaatagggggtggccagttggaccaaatctgcggggacacaatttcttcacggcggaaattttccaagtccaacactccaatatcacgatggttgttcttgtatccaaaaagatacagttcgttattatcagtgaagtaaacatgatttgccttcagctgcaggtactcttcagcgtggagtcaaagcgtttggccgtgcccaagaaacagcaagttctcgtccaagctacttatttccacaatctttccttctgtcaaactcactttatgtaccttgatcgtgttagtatcacacacatatgactcagagtcgaactcagattctgaatcaaacgagtgatcatcatcttcatccccctccggtacatcccacttcggtagatcatcggaccgccaaatttgcagtaggttaccgcatgaagcttcaacgatataaatattctcatacagaaagtccttcaccttacccataactatctttggcgcgacctttgggtcggtaagatcaaacatgtgtatttctcctaacaaagtcgcagcatacagcaacccatctttaaaaaaacagtcctcatagtcggaatacgggggcagccatgtccacttatcatcaccagcccttgcgaacgagagctggcaatacggattgtggatgagcaccacagtatatcctcctcccatggatggatcacaagacacaaatgccttgtaatagaggatcgaggacgagtcggaaaccgtcacctctcccgtgtgccacaagtatttgtacccgttggcagcagcagcatcgtcgtcatagatgggcttcacctgctcaatggtggtgaccgatggcagggcgatctgctcgccagtgatgggattgacaaggtgcaactctgatctctcatcggcgtttacaatccagccatagcaggacactatgatatgcctattaggtagatcctggagcggcaaaacgtacgccttcttctccacgaggctgtagaggcccgtcgccttggtgccgtcagaatcaaatgtgtacagcatgcatggtgtctactgtggcttgcaatgtccaaggctgcatatgcttgtgtacgcggatcgccaagaggagcagacggaaccagcccggacgaggtcagggacctccaaggtggcaaatatgctcatcaaaacatcctgtggaagctccatcagtgctggatggatggagagatttatcaagcagactacttgcacagctacaattaacttgtcctgttgttgttccttcagctgttctaggattcagaattgaatccgaatcgcttgttggcagaaaccccaaaatttgcttgcccaaacttctcacactgtcaatatcatgaatctgaactactgaaggcagcagcaacaccccagttcagagttcctccttgttttccccctctaaatccccagttgacaagcagtgattcttgcgacaaataattcttccaggtgcacatatataactcgtaaagcaatcaatctctatccgaataggagactgaagagttaatccccaactactccctttcttcgattgagcgacggattcgggcaaaaaagaatttccaactctttgccaaaaatatggcatcacataagatcagatcccagccgccattgtccatttccaatgccctgattaacaagcagagtgggattgggttgttactaaccatatggaaaatcggaaacctccggctgcgagaaggcctccgatttctcggacgcgtagcgccagccgccaggttcttcttcttccctccgccgccggccgacgtccacaccgatggaaggcggcgccccgcccgccggcggggagagaaggtggctgccgccgggataccagaggagacgagagcggcggcggcggccgggacaacctcgacgagttacacaatgcaatttatatatttgtattttggcccagtccattaaacaacaaactatatacgtagaaatttgatatatatattttttatgtagaaacattctatgtataaactattcgtgtagaaactttgtgcatacggattcgatagtacacgagtaaagaagatgtacaaacgttttacgaatacgaaagcccaattttatgcatagaaactgtcgacatatagactttatatattcaaataaatttaaagggttaattgatcagtgccactataaatatgttgattaaaaaaataccactattattcgtgatatctgctgcgtgacactaaaatttcataaaattgaaaccataccactccgtcacgttttctccgtctcggcactgacgcgccaaccaccaccaccaccaccaccaacagcggtggcagcacccccattcatcggacctcgccaccaagccacctctttgcgccgaccgcacgccgccactgccccaaccaccatacaggcacacattgtgtcacgccccgaactagccccgaacggaactagcccgtgacgctccaaattaacatgttaatcgataccagtcctaggaaacagtgctggtatcacaggaagacagaatatcacagcaatagaggtctctttattacagagtaggagtatagtcatgttgggcggcggacagatcccgagctcacaactgcattacaaaagggaaagcgaaagccaagacttggcccattcatcacaggcgcgacttgggaactaccccgaaaccctaaaactcatggtagcggacgtgctcctgaaagaactcctcgtcagcgggatccacttcatcttcttcagcaactgggggggattatttatatagagcaagggtgagtacaggagtactcagcaagccatgggaattaagtgtttgatgcaggcttcaaaggaaagactgttgtttttgcaattgattttatttaaactcctctttgaaacaactaagtgagtgcttctcaaacgacacggatgagacagtgtgtctcgtccggtcggagtatgtgcaatgtatcagtctttgaattgattcaaggttggcacccggccaacagctttcaaacggccacccgggcctggctgatcccatcagccgcggattttccaaacatcgaacccattccacaacagtaatttcacaagcagtagtcaatcaaaactacgctaggaatcacctcacatccgcccatgaccgtgggcacggctgctcgaacaatttagtaacctctgcagagggggtacactttacccacacgacattactaacccggatcacccagcccgtgcagaacggccacgtttggagaccttgaggctttcatgacaaggcatttcgaaagccgacacaggttcactatatgccaacgagaggggtcccagaccgacatcaggttaggtcccagaccatgctgtgccaggaagcccgggggttctccccagcaccaccccgttgaatccacattagctaattactcagccaggggtgtcccatttcacccatgtggtcgcacttgtcttatgtacggataaaattccaagggaaacggtccttaagtgcaagagcgggaaaccgtactcccggttcgtcccccggtctgcggttttggaaattcatttagttcacaagcaccgacccaggtgttgggttttccaagtcttttgtaaaaccccaagttttacccatcgtcggatattttaaatttgaggggaggtgttccgatgcccgtgcccgaaggcccgtgcatcgaagcacaacagttgacaaaggaggtttaagtgtccaataattcaaggagggtaattgtagcaattaggattggggccagcaggctatctcacaagctgcgaccgaattacttgtgttaaacctattcatgcaatatttctggaaaagaaatacttagatttaaattataggtgcaacatgatcaaaggtgacttgccttgctcgagatcttgagcttgatcctcgaaatcctcgcactgcgggtcttcgggctccgaaactacacgcgaagcgggacaactcaaca

SEQ ID NO: 48206 - DNA, 2344 bp, Oryza sativa
gcacggtacattgtcaccacaagaaagatgagtagtactagtgctatcatgattgtatcgataccataatagatgtacagtgccgactaatcaatagatttggtaaagagaaaaagaaacattttgagaagaacaactttttgcttttaaaagaaaagaaattgaattaaataaattttgtgcataaccttgcatgtgctgccaacttatttaatttataagagaatagagaagagcagttctatattttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaataacaaattgataatagagtactattaaatattcgcaaataaaaaaaattattacagaggtagatagttcctctcaaagaataacattctacgcagcggaaaaaaaaaactataacaaactacggaacagctatggcaactccactccacaggcatcttaaccaagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaaacaacatttaataaatatttaagagaataataaaaacagttgaataattaatcaacattaaataaacaccatacaacacacccgtgttgcataggcccaaccacatttgaacaaccaaccccagttgaacaaattaaacctccaaaccaggaattatccattccaaaccaggagtcaaattaattatcacattattaacattgatgagtagagtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccatggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacatcgcacgattaaccatcgtgagctaccattgaatataaccttaattaataataataataataatttatatttaacccctttagttagctaatgtttctaagcaaggctaagcaaacttacatatagcatttagccgaaccaatccaatatataaggtcatgctaatcaagttataacccataggaaaacaaagtcatcttcggccattaattaattgggaaaggttcaccacccgattgacattcgaaaacaatgcacagtggaaataaaataatagctttaaacgggatcaacatgctcaaagggttgtttgggatctgtgtgacttgccttgggcttccgcaaacgcttcggaaccttcctcaacggaaacgctctcctccggaacgtcggaaactaaagcaattaaacaaaaaccaacaaaacagtacaacaacaagcataaacagtatatgtggatatttttaacatgtagatcttgattttagaaaaatttagcaacttgaaccactcgaaacggatctacggttatttagttatgattttccgaagttttaatctattagaaaattggaaaaaaaggaaaagaaaaggagatgatgacgtcagcatgacgtcaccccacggtagccggctagggttggcgagctcgccggagattagatggtcggccgcggatttggagggcacctacgcgtagaggacgacgaggcgaacccaacggtactcaccaaagtgccaaacggcgaacgatgacggccggcgactaggaagcggcggcggcggctcgggttggacggcgacggcgagctacggcggtcggcggcgaagggggacgggcggtgtcacgcccagaaattcccgaatagaattccaagcagaatgtgcattaaaatccccgtccaggaccagccgggg

SEQ ID NO: 48207 - DNA, 1332 bp, Oryza sativa
caaggccatggcaaacgatctgcctgtggctctagcggattccgcccgatcctggctccacggactaccccgtgcacaatcggatcatgggcagaacttcgtgatcacttcatcgcaacttccagggcacctttgaacgccccggcacacagtttgatctctacaacgtcgttcagaagtctagaggatcccttcaagattacatccggcgcttctccgagcaacgcaacaagatctccgacatcaccgacgacgtcatcattgctgcctttactaaaggcattcgccacgaggacctagtcggcaagttcggatgcaaacctcccaagacggtcaagcaaatgtttgaaaaagccaacgagtatgccaaagccgaagatgctattacagcgtccaagcagtcgggcaccacttggaagccaaagaaggacacgccgaccgcaggagggagtggaagtaacaaccgcaaggatcgcaagcgtaagcccgaagaacttgtggcaacaacctctccatcttcccgacaacgtccccgcgtcaacacattcgacaagataatgaactcccaatgtccgcatcatcctaactccaaccacgtggccaaagactgcttcgtctacaaacaatttgcggagcaatacgtcaagaatgcacgtaagccttcagacggagagcaaggcacatcaaagaagaaagacgatgaagacgatgcctcgactggttttcaagatcatcgcaaagaactcaatcacatcttcggcggacctctggcttatgaatctaagagaaagcagaagctaacagaacgggagatcaatgcggtcagcccaacacgccccaataccttcggtggtcagaaatagcaatcaagtttgaccgctcggatcatcccgaccgagtggtccacccggggcggtaccccctagtactatacctagtggttcgcaatgtcaagctccgaagaactctcattgatggtggcagtgcactcaacatccttttcgctaagaccctggacgatatgcagattcctcgcacggaattaaagccgagcaatgcacccttccacggtgttatccctggattatcagctacaccactcggctagatcactcttccggtcactttcggcactcgggagaattttcgcacagaaaatgtttgtttcgaagtcgctgatttcgagacagcataccatgctatacttggacgaccggccctagccaaattcatggccgtcccacactacacctacatgatgatgaagatgcttggtcctcgaggagtcatatcactacgaagcaacatcaagaaagccgtcacatgtgacaa

SEQ ID NO: 48208 - DNA, 5249 bp, Oryza sativa
catcagatccgactgaaagaatccgactgcttgaagatctcgtttattacacccttcggggcctactgctacatcaccatgccctttggatggaagaacgcaggagtaacctatcaacgcatgattcagagatgtttctcgactcagatcggccgcaatgttgaagcttacgttgatgatgtagttgtcaagaccaagcagaaggatgacctgatcacagatttagaggaaacttttacaagcattcgtgctttcaggatgaaactaaaccctgaaaagtgcatcttcggagtaccgtcagggaagttgctcggatttatggtatctcaaagaggcatacaggccaacccggagaaaatcaacgccatcctcaacatgaaaccgccaagctcccaaaaagacgtccaaaagctgactggttgtatggcggcgctcagccggttcgtctcatgactcggcgagcgggggatgccctttttcaagctgctgaagaagactgacaattttcagtggggacccgaagcacaaaaagcctttgaagacttcaagagacttctcaccactccaccagttttggcctcgccgcatctacaagagccgctactgttatatatgacggcgacctcccaggttgtgagcacggtcctggttgttgagcgtgaagaggaaggccatattcaaaaagtccaacgaccaatttattttgtcagtgaggttttagccgactccaagacaaggtatcctcaggttcaaaagttattatatggtgtcttaattaccgtcatgaaattatctcactactttcaaagtcactcggtcacggtggtcacatcgtttccactcggggatatacatcataatcgcgaagcaaacggacggattgcgaagtgggccttagaattgatgtctttggacatatcgttcaaaccacgaacttcgatcaagtcacaagctttagctgatttccttgccgagtggaccgagtgccaagaagacatgccagaggaaaagagggaatattggactatgcattttgatgggtcgaagaggcttacaggcactggagctggggttgttttaatctcccgacttgagaaagattgagctacgtattgtggatacatttttctgcgtcccataacgtggcggaatacgaggcgctactccatggattaaggattgccatctctctaggcattcgccgattaattgtccgaggggactctcagttggttgttaatcaagtcatgaaagagtggtcctatctagatgatactatgactgcttatcgacaagaggtacgcatgttggaagacaaattcgatggactcgagctcacccatgttctccgacataacaatgaggcagccgacaggctggccaattttggttcaaaacaggaagctgctccttcagatgtgttcgttgaacatctttacgaaccaaccgtgcccagaaaagagacaattgaagccatggatactcaaggcgtaagcatgatcgaagccgactggagagaaccgttcataaaatttttgagcaaacaagaacttcctcaagacaaaaatgaagccgagcagatttcccggcgcagcagactttacattattcatgaaactgatatgtacaagaaaaatccatcaggaatactgcaacgctgtgtgtctttggaagaaggaagacaattgttgaaggatatacattctggtatttgtggtaaccatgccgctgcatggactattgtcggcaaagcttaccggcaaggttttttctggcctacagctgtatctgatgctgacaagattgtgcggacgtgcgagggttgtcaattttttgccagacaaattcacctaccagcccaagagttgcaaaccatcccgttgtcctggccgtttgcggtctgggggcttgacatggtcggcctgtttaaaagggcagtcgggggttacacgcatctctttatggctattgacaaattctccaaatggattgaggctaaaccggtcatcacgattacggcagataaagctagagattttttcattaacattgtgcatcggtttggggtacctaatcggatcatcactgataatggcactcaattcactggcggagcatttaaagacttttgtgaagacttcggtataaaaatttgctatgcctccgtggcacaccccatgagtaacggacaagtcgagcgtgctaatggcatgatacttcaagggataaaagcacgagttttcgaccgactacatccctatgctggcaagtgggtcaatcagctgccgtccgtactttagtctttacacactactcccagtcgggctaccggccagtcgccgttctttttggtttatggtgcagaagcaatgttgccagtgaagtggaatttgaatcactacgatttcggaacttcaacgaggagcgttatgaagagggccaagtagacgacatcaatcgattagaagaagcccgtgaagcagctttaattcagtcgactcggtatttgcaagggttgcgccgttatcataatcggaatgttcgatcgtgagcctttttagtcggcgacctggttctgaggaaaattcaaaccacacaggatcggcataaattatctcccttatgggcaggaccgttcataattgctgaagtcacttggccaggttcttatcgactcaagcgcgaagatggtactctcatcaacaattcttggaatattgaacaccttcgtcgattttatgcttaggcgtttcgtttgtatctttcctctttgactgctaatctcaagtttttccttgaagttttcagtcgggggctactatgataataatggagtgtgatttttatcaattcaatttgcttacttgatttatcattgccctatttggtctttcgacttagtcgatgaggactgaaggtttttaatagcttttgcgggttttaggctcaataaggctagataaaggcttttaagaaatcaaaagctaagtatggaacaccaagcatagcataaattcatcagtattgtacaaattgagccttcatcatcattaattatcaaaatcattgttatatcaatcagtatcagttttttcatcatcagacttatcagacccagtcggccgaaggtcgacttcttggaatctttcaaccacatcagcagcaatcttgtcagcggctttctgcgcatcgttaatgaggtcaagagcagcttcttcgctcgtcccatctgcaaagccatcaatggcatccatatcaacccttggataaagggatttggtcatcgccaacgccagacttgctcccatacttccagcttctttgatgttcttgaaataagtatctggagcgactctcagcttgtcgaagattttggcagcatcaagtgtactcgaaccggcgttattgaagaacatggcccggatgagtggagtagcatcattagcgactttatccctggctccttcaagcttgttgatcttgtcaactaagacatcaaactgtgcttgagacttgatcttgcggtctgcatcaacagattcacattaatgaatcagcatatagaagataatggcttttgaggtattgattattggtaccttcaacctcctttaaagctgaatccctctatcttgccagctctgccttgtcattttccatagtttggatcttcttctctagttcagatatcttggcagcttgcagtacattaacttcggttaatcaagattacagagataacagcccaaatcagttgggcagagtttgcgcgaacctttggatgagccactcagtttataattggattcctggagctcagcaatccaatccctcaaatcgtgttcattctttctggcaagttctctggcctcgtgcagttgactcctggtggtttcgagggttccaagatgaggaactagtttctcaagggttgcggttttcgcctcgttcctaagatgaatcctctgcagagcagtttaatcagcgctcgagccagacggcaaacaagatggctgaggtcaggcatcaaggaacttacatttacaatgcgagtcgcttggttgagtgccttcttcattaggcagacctcttcgtcttctttttgccggtttattataattccttgaggttgcaagttgtcatcccaccacttgaccagaatgggagggcacgaatcttcggctgcttgtatacggggaatttcttcttcatcaccaatcattggtcctaatgtatctactgacaaaggttagacgattgatcagagttatttgggtcgacatggtttcagacaaagtgtttacccgtaatgatttctggacgaggacgagtggattcagatgcctttaaagtagatccagatctccggtcattgctggcgtcttgtccgcgagggttgtctgcttgggtttcaacttctggaatctcttggcttggccctgcgtccgacaggtttccagtcgggggctcctgattaactccagcttcggcttcggccgactggtttccagtcaggggttcgtcgctgggttctacattgtcgctggcctgcagattatcactcgggagatcttttgcagtcggcccggtttcttttgaggaacccgcctccatgttggtcgggtcagagtcttttctagatagatctatatcagatggtttcctgcaagtttgattgtcagtactattatcgcaatgggtgcgcatcaatgcaacggagatcgtaatatgagttgcacctagagttcttcctgatttttggcacaggacgactggatgttttcttccttggagtagcctgcttcggcagtttattggttgcctctcggtctccaagctttctaggagtgtcgcctttgtcgtcacttagaaccagcttcacataaagctagagattatcttccgtcacatcggagggcgcctactggctctcgaagctttctctctcttccgccatgaatgtggactggatggtttgatttggtctgagatacggctggaaaggaatggggaattggagtggtggatgccggcagaaattttgtggagtgtttgaggatggattggagcggattgctgaaccctagcttggccggcgcagtttgtactgtagcaggaaatggggaaaatggcgagagtctcggcggggatgacgaagagacgtttttcacttcggtgatattagggtatcgggagtgctagcaggcctgggccggcacagtacttcagcccaattttatttccagcgt

SEQ ID NO: 48209 - DNA, 1288 bp, Oryza sativa
cggcagccggctagggttggcgagctcgccggagattagatggtcggccgcggatttggagggcacctacacgtagaggacgacgaggcgaacccaacggtactcaccaaagtgccaaacggcgaacgatgacggccggcgacgaggaagcggcggcgacggctcgggttggacggcgacggcgagatacggcggtcggcggcgaagggggacgggcggccgagcttcctcacctccgtgcgcacctaacggcgacggcggcaagcggcggcaacggcggaggcgatgcggcggcgcggctggagaaggaagatgagtccgacatgtgggccccacatgtcggtctccacaggagagaggagcgggcggcgtcggctgggccggcttgggccggttcggccgcgcggagagagaagagagttgggccgaaatcggcccaacggcttaaaaggggttttttgaacttttttaaataaaacaatttgtgaaatgttgttttaattattaaaaatacttcccttgctcaattaattcccagaaaattctagaaaatagaagagcaagcataatatttaataaaattttatctagctcattttcatgttgaaaaattttcctagaaaattagggtttagcttgtaggcttttaaaataatttctaaaaatgatttaaaatatgcatttttaatttagtcgatttttagggcgtaacaaacctaccccccttaaacagaatctcgtcctcgagattcagaagaactgacgaacagatgaggatgagctgacttcaattcatcttctcgctcccaagtggcttcttcttctgaatgattgctccactgaaccttgcaaaaccgtataacgcgattcctggtattcctctcgcttacttccaaaattctgactggcttctcaacataagttaaatcttcctgaagctctatacgatcaggatctgcttcctccgtaggtacacgtaaacatttcttcagctgagacacatggaacacgtcgtgtattcccgccattgacggaggcaactctaactgataagctacttcacctcttcgactcacaatcttaaaaggtcccacaaaacgcggtgccaatttccctttggtttggaaacgatgaacacctcgtaatggcgtaacccgaaggtatacataatctcctcttcgaaagccaaatctctgcgacgattatcggcatagctcttctgacgtgactgagcaacgcgcaacctttcttggataatctttactttttcttctgcctctcgcaatat

SEQ ID NO: 48210 - DNA, 3991 bp, Oryza sativa
attgccttcttaggactcaatccacgtgtggcaatccatatgaagcacattaattcaacctgatgacgtataccgagccatattgttagaatcggctgtatcggctaaccctgttcgactcgaactctgccaatcctgtctgtagccaatttggatcatagccgattcttgctctgtttccgcaacgatcttcgtcttggattctgctttgatctaatcttcttttccaacactgatattaccaaatttggtcgttaacacatgccccccaagtccgaaatatttggtaagtttcggatttgccatatgtcgactccgagtgaaaatcgcacttgccgttttccgaccgttactccagcgctttaaatgctaaccgtcaccttcgagaaacttcacgctgtttcctccgttttcactgctgaagcaaacctagttttctctctctccggcgatcccctcggtgcgctcggcgatttcaaggtgatctcctccccggccaagcttccgctcacgatgatgtcgacctctgccggcttgtccgctgcgccatcaaccagcccgtctgttgcgccgtcatccaagtacgcagaggtatgtatccatcggctagatccctttttcccgtgcagtagatcgattttcttcatctcatcttattttcttcttctctatctcttttgcacttgtagcatcttaccaatcttgttgcggttcccagtttgtcgcacgaccatcagtactttctcggcccaattggcaaccttgacccctctgaatttatcattgttgagaccaacagaatcccctttagactggccaacccaaacttaagtcactggaaaaacacctttaaatcatggccatctattgagaaaagtacccccgagaaaagctggcctttgtggttcgaatgggtatcggctagcaaacaagcccactgggatgaaatcggaatcagccaagcgctagcccttactacagcaaatttggctaaggatgagcctctgatggccgctgcaatctacttttggtccaacacccttaatgccttcttgttcaaccaagggccgatgacccctactttgttagatatcatcatgattactggtctggatgtgacctcatcggctaatcccatgagcttgaataccaaaagcacctttgaattcaagaccaaaagcattagggttggtcggggtatattgtagcatacatgggcaaagggccagtcacctctcgagagcatgtagcttttctactgatgtggttggagaaatttctttactgtggatcaagttgtggccctgcaactgtggagattatggataccccatacccacactgcatggttatccgactggttataggggataacttatatctatggaatatataacggatcatgacttgggtattacgtttccttgtatattatgtaacggcctaaagtcctggtttgataagattgtaaagtagatttaggaaatcaataccgtattggttaaggtttctatcttgtaatcctgccccccgtcctatataaggtgggcaggaggccctctagggggcatatgagcacatatgatcgtcagatctaatacacccggcggattcaaatccccaaacaggagtagggtattacctcacattgagagggcctgaacctgtctaaatcctttgtttccgcatccatccacttttaggtctcgtgcgctacccccttttattattgccgaattcatgttttgacagttggcgcgccaggtaggggttgcgtcgaattagccgtcgaaaagtgtgatggattcaactccataagaaacgccaagatcaatctcaccggtttcgacgactcaaatcttctatcgggtttgtcgttccaaataaacttttattagattaattttcaatcattatttgatcttcttacatttattggtttttttcatgccaactgagatcgtgacgaagcagtcggcgacctcgtgaatccaaccgacgtaaatttgatcacgctttgtgctgatctatacgccggcacatggcccggtgacagtcttcatgcatggagcatcgccggttataaggaacacacgtgcttatgttgattcaatcaacaagcacgaccaacttaatcatgccatatatccaatatatatgagtcttatgtttctttgtttaataacagattaatctactaatcgctttcttttgcatgttcgtatatgccgatcaagagcaaccatctgtccatgacagcctttgactgctgccacacgcgcgtcaactagcgattgttctggccgggatccatgtccgcgtgcacccacctgtcatggcgccgtcaatttaatcctccatgccagcatgcaaaagcatgcatctttcgatacatgtacatctgtactttttattactactaatctcagtttgatgtgtggtttattttttgcatgcaccctggtttcccgagtccgattccctatgacttggtttgatctggctggactcggacctgtgacttgtacgtgctcatgacatgcaggagcatgaatcggtttaatgatctgcttgtgtggacgcatctaatgttcatgctacatgagatcaatcggccaaccaaataatatatgcatgcttcatatatgcattgatatatgcagacatacatccacaagattaattttcttgatgctaattagagatttcttttgtctctttacatgtatcgccggccgtctccatcgccgctaactggtgccctcgcctacgcgattggatggtcacaccaccattgttgggcatctacgtcttcaccgaccggccgcctcgtccgccgccgactggtgtctccgcctacacggctggcctattatgccgctgttgttgggcgtctatgacttcaccgtcggcctgcctccgtcgccgccgactggtgtctccgcctgtacggctggcctattatgccaccgctgttaggcgtctacgacttcaccgccggcctgcctccgtcgccgccgactggtgtcctcgcctatacggttggttggtcacaccaccgttcatgggcatccacgtcttcaccgactggcttgccttagccaccgccgactggtgtctctgcctacacggctggcctattatgccgccgttggagggcatcttcgctttcaccgtcgaccgccttcgttgccgctgactggtgtcttcattgttattgatggacgactttgttcccacattggccacctctgccatcaccaaggggaatattacaaagttgagtcatcatttatttcattctttatatgatattttccttttcctctgcctcactatatcaactggttcgccgttgactagtgagtcgggggctacagatgttatatcatattttttaaacaatttttataatatttatcttgattgcttgcgatataatctgagtacaaaagtgcctatcgagttaggagttctatcttcctatgctttttgtttggttgccgatggatagttgcctttgggccgattcctagcacccgggggctcgttggatggaccgagtaacgcaaggtgctaagtattattcggaataaatcaaaagcatagagataagataaatttattgtttgctcttaacaattgcaaaagtacccgagtagtaaattctgatccgtgaaactttgttccattaatgacgaactcatatcactcatatgcatgtttgggaagtgcctaggccgacacccgatgcttgggggctatgactagtcgggcagagtgtttaaacgtaatgagtcatctgctcggggaaatcaaaattgacaagaggagaaaaacatatttataaacattttaaaatgcttgaattttcctctagtattgtatttacatcagatactactcatcctatatgtttgttctgtaggatccagatccagatatgcacaatagggattcatggctttaagcttatttcctacgcttcagg

SEQ ID NO: 48211 - DNA, 907 bp, Oryza sativa
aagggggtggctatcaagctagcaaagtggatgggttgggagacaaggaattttatacaggttcaggtcttcttattcaagagtaataccctactcctgtccggggatgattccaccgagtatgttattgattgtatatattggagaaaagaattgcgccccgagaggcacacggaccctccttatataggggaaggagtccgctttacaaaatacagtccatatcctaacggaatatgggattatagataaaatacaatcctaaccgactaagatctcgggtatttccttgacatacaagtaaaaaacaaacccgagtcttcataaagatattctatctatatttggtaccgtatatccgactaaattataactgtcatgtagatatgggatatccatattctccacatggagtgtactgggtgcgtccgtgtcgaaaattcactctgtgattcgcgcagcgaacttttgtcacttaatgccaatattggcctatattagcatacatgggtgcgatgaattttagcggaataaaaaagttcagaaagcaccaaaacatgtttttggacatactgtagagaattgggtgcgtccgtgtcgaaaaatcactccgtgactcgcgcggcaaagttttgtcaattaatgccaatattggcctatgttggcacacgtgggtgcggagttttacaccggaaagaataacttcaaaaagcaccaaaacatgatttttggacatattggaatatgctgggtgagtccgtgtcgaaaaatcactccgtgactcgcgcggcgaacttttgtcaattaatgccaatatagatatatattggcacacgtaggtgcaatgtttttcaccggaatgaaaaacttcaaaaagcaccaaaacatgatttttggacttattgga

SEQ ID NO: 48212 - DNA, 2994 bp, Oryza sativa
gcagttggatctacataatcccttctttcgccacgtcagccctatatccatccatgtcagtgccacctcatcgccttgtgtcgccacgtgtcgttccacgtcatcgagtccacatacaccgagtcacccatacactatgccaatgacagtgggcccacatatatttttcctatccaaaattaattcaatttccgaaattaaatatccagagaatattcttggaatattcctttttcttttatcctcggattttccccgaattcaaacttcaggaggccataacttttccgtttgaactccgattcgatccattcttcctcctaaattcttctaaaatcgagctttacctcctgatttaattggttatttcatttgatgttatttagttattttttctttgtgtttatttgtttttcgtttgcaatcgtgtagacgttggagcggaagagcagtttgcttcagaagacgctgtgcaaggacagtactaggatcaaggcaagtgcactctttgaacatattgaacccatttgtgaaatgttttgttttgaatacatgcattgttttgtttataaaccatcgatgggtagcgtgacctaattgttattattatcctacctttgataattattgattgcccatgattccttgtcaccctagtctttgtgaattgaacattgggctgaactcatggtagatcgtggcacaaaagaagagagaattccgagccctccaccagggcaacaggacagtgtctgagtatctccatgagttcaatcatctagcgcgatatgcaccggaggatgtccgcactgacgtagagaagcaggagaagttcctagcaggcctggatgacgagctgaccaaccagttgatctctagagactacgccaactttgagaactaggttgacaaggcaatccgtcaggaggatcagcgcaacaaatggacaggaacagaaaggcagcgtagttccggtccaaccaaggaaaccaccagcgatcgcgcttcactccaggacagcagggtggacctactgttggcaactttttgtgacaagttgacaagcacgatcgcagcacctaaagccttgcggtgatcctagagtcgccaaccacctcgatctagcaaagagctaaacctagatgggttttgataactaaaccggctagcggagccgatttctagataactacccatcttgtgggcaaaacggaaggttttcaggacaaacctacaaagaggtgtcgcactctcgcagcggcggtggacggtttacggcgcaaaccgacaaagatggacaaactaagagaaaattaaaagcaatatgaaaaacgattcgattgattgattgtagattgattttttacaatgaaccggccatgtcccttatataggtgttggtcttgccctatacaggccctccttcaagtccaactcggggtagaaaccaaaggaaacccaaaacatgccttcccgagcaaggaaaccttgagacccgacgaaacacagtcggactcgaacctgccggtcagaccggccacacaccgccggtctgaccggctctcaaccggcggtctgaccggccaagacacggcggtcagaccggcccactcggaggaaaccggtagacttccaaattttggcaatctttcctattttaatcctaggtgccaaatttgggtgtaaacacctaccaccatgatcgtccgccaacatcgccctttcaactcgagcagcttccaccagggcgctagtggcagccagaaccaccagggaggtcagcccaaccgcagtgcagctccacgcccaccattggcaccagcacagtcagctccatcagcccaagccaagaaggagactggagcaaagccaggatcctgcttcaactgtggcgagcatggccactttgctgacaaatgcccgaagccaaggcgtgccgggccaaggtttgcccaggctcgtgtcaaccacgcgtccgcagaagaggcgcaagtagcaccagaggtcgtactgggtacgtttcctgttaactcaatccctacaacagtacttttcgattctggtgcaacgcattcgttcattggaaagaagtttgttgggatacatgggttaataagggaagaacttagtacaccaatgcgggttcataccctagggaatagctccacttcggttcaattcagcccttctataacaatagaaatccaaagatcaccatttctagccaacctcattcttctcgaatccaaagacctagatatcaatcttgggatggattggctaaccaagttcaagggtgtcattgattgtgtgaatcgcacagtcaccttgaccaatgagaagggagaaacagtagtgtacaaatctccagtctcaccaaagcagggggtctccttgaatcagattgaggtggaaattccagtggtcaccgaggagaagagttcgaggaagttggaagatatccccatagtctgcaagtatccagaagtgttccccgaggacctcactaccatgccacccaagagagagattgaattccggattgatttggcaccgggaactgctccaatttacataagaccgtacagaatggcagccaacgagctagcagaggtcaagaagcaggttgatgagcagctgcagaaagggtacattcgaccgagtacttcactttggggtgctccagtcatttttgtggagaagaaggacaagacgaagagaatgtgtgtcgattatcgcacactcaatgaggtcactttcaagaacaaatacccgttgccgcggattgatgatctgttcaatcagctgaaaggagccaaggtgttttccataatagacctgcgatcaggctacaaccagttgaggatttgggaagaggatattcccaagcagcctttaccacttggtatgggttgtatgagtgcacggttatatcttttggacttaccaatgcacctgcattcttcatgaacctgatgaacaaagtgttcatgg

SEQ ID NO: 48213 - DNA, 889 bp, Oryza sativa
cattatagccagatgcttgttgtgccaagtcatttgctctagaattatcatgcctaacatatatctaatagaaaaattatcaaaattggcaataatatctaaacatgaattgaggtacctatttagtgatccgtccaagcatttgtagactccggtgacttgttgcaccaccaattccgaatcaccaaaagcttccatgtattagctccaaccatcaccataacttgtaagccaaacaataaagcattgtattcgacttgcttatttgtacaataatactccaaacgaacagatgcttcataacacatgccattaggtgaaaagaaaactacccctatgccttgaccttctttgcaagaagaaccatcaaaataaatcttccaaggtataacttcaactaagcaaacctctccctcataagcaatatctgtatgatggtctactataaaaccacatacaatttggcctttcatagatttcaatggttcataagccaaatcatattctatcaaaacatatgcccacttgccaattctcccacttagaattggcctttgcaacatgtgtttaataacatcggcttgacaagtaactatgcatgtactatataacaaataatgcctcaatttggtacaagcatagtataagcatagacaaagtctctctataaaaacatacctcgttttggcatctaaaagacggcggctcaaatatgtaatgatatattccttgccatcttcctctgtgtcaaaacggcaccaataactttgtcttcgaggcaatatataaccgaaaaggctttccagctttaggcgctcgtacaacgggtggagtagacaaatatctcttcaactcttcaaacgcctcttgttgttttgcccccaagtaa

SEQ ID NO: 48214 - DNA, 926 bp, Oryza sativa
acacatgacctggaattggcagcggagggttcatgctttgaaactctggaggcaagatctgattggcaaccactgcgaagtatatatagatcacaagagtgtcaaatatatcttcacccaacctgatctaaatctccgacagcgaagatggttggagttaatcaaagattatgacatgagcattcactaccatccaggcaaagccaatgtggtggcagatgcattaagcaggaagagctactacaatgctttatgcaccgaaggcatgtgtaaggaattgcagcaagagcttgaacgtctcaacatgggaatcgtagaacacgggttcgtagctgctctagaggcacgtcctacgctcgtggatcaagtcagagcagctcaagtaaatgatcctgagatagctgaactgaaaaagaatatgtgggttggaaaagcccgggatttccttgaagatgaacatggcacaatctgcatgggagaaagattgtgtgtgcctgatgacaaagagctaaaagatctgatactcactgaggctcatcaaactcaatactccattcatcggggtagtaccaagatgtaccaagatctcaaagaaaatttttggtgggccagcatgaggagggaaatagctgaattcgtcgcgctctgcgatgtttgtcagcgagttaaagcagaacatcagaggcccgcaggattgttacaacctcttcagatcccggaatggaaatgggaagaaattgggatagatttcataacaggtctgccaggacatcatcgggccacgattcaatctgggtggtcgtggatcgacttaccaaagttgctcatttcattcctgtgcatactacatatacaggcaaaaggttggcagagctctatctctcgagaatcatgtgtctgcatggagtacccaaaaagatagtatc

SEQ ID NO: 48215 - DNA, 857 bp, Oryza sativa
acttgtgtatttgggttagcaaattccatagatgctttctcgtccttaatgagaattaattggccttgttctctcaacagtatatctctaggacttctcttttcccttttggggactgaaattaacttagtttcttacagattagaagcatcatccatcaatgtcaatctctcaatagtttcagaaaaaaatgacaatgctgtctctacagaaccaaatagtacagggaatccatttcaacagaaactccaaaatgaattctctctaccatcggatatcgagatgccactgcaaatgtctaaggtgatgcttcatttcttatctttgatagggatcatccagaaagatgcatcctgcattcttgttgcagttgctcttacttatttttcattccgtgggcattgccacagcaaaaaagcaaatcaggagtgaatggtagttttgctgctcttgagctttcagaagcttcagtggaatcagctggtgcaaaagctgctgcatgcagaactctttctgttcttgcttcattgtctaataaaggtatcaagttttcatttaaatttttttttgtctaagttcttttgcaaatggaactttacaaggtttgcaagatatcgagggactttaagtttaaacaagtatttaaataagctccaattattatcaatggggaagtcgaaagttttgaacagaaaatactaggatatattacactgcacgattttgtatgtaatcaaagtataaggtaaacaattctgtgcataatttggtggatcatccaagtgcacgtatcattgtattttctttattaaaaaaaacagtttgccaagacagttaaaatgtagtgctatccatgg

SEQ ID NO: 48216 - DNA, 747 bp, Oryza sativa
tgagctgattgatgagttccacagattccttcatgtacttcgccgattgcagccttggcttgatcggcactcaaacacttgagtaacaccccatcaatcatccggtaatacaactcatcatccaacagggtgtatttcaaagctttatttcgtaattttcttgaagccaattgagacggatttcgcaaatactgaaatacatcatatctccaatcatcggctgtaatcgtagcaacctctatctcaacatctctcaacatcggcttatatcccgatgccccttgagccaaatcattagcttcaatgttttgctctcttgacacatgtttcaaagttccagccgaaatccactcattaattctcggcacttctcattgtaaaccatcaatgtatcattcttggattcatattctcctgccaattgactgattaccaataaggaatcacccatgatttcgatagcgtcggcttcaacttccttaagcaattgcaatcctttgagaacagcttcatactcagcctgattgttagtcgcataaggtttaatagtgcagggcaaactcaaaacttgcccctcgaggagaaattatgaccaagccaataccacaaccatgagtgcataccaatccatcaaagaataaagtccatggcacaatttctaccgagtcgattgagtcatctcgatgatccacaataaaatcggctatagcttgtcccttaatcgcctttggtgactcatatcgaaga

SEQ ID NO: 48217 - DNA, 710 bp, Oryza sativa
ccatcggtgggagacaatacttagccattgtgttaggctgtgtttagatctaaagtttagatccaaacttcagtccttttccatcacatcaacctatcatacatataacttttcagtcacatctctccaattttaaccaaaatcaaaactttgcgctgaactaaacagtcttagtctatttcactgctagactgtacatgtgtttgttatgctgaaactatttcgttgaattttatgtacgtatatcggaagcatgcgaggatgttggcagggcagttggaccaaacagtttagtaataaaatctcagaaatccactggattcggtaaccttgttgcgtacggtcaattatcagttatacacattggatcagcaaggtgtggtatagtgtgccggtatttcatacaggcggcgcgcgcaacggcgccccatcctctagtttaccaagggtgtgtttagttggggaaaagaaaatttttggatttcacatcgaacgtttgaccggatgttggaaggggttttcggacacgaatgaaaaaattaattcttgaactggccttaaaaccgcgagacgaatcttttgagactaattaagccgtcattagcacatgtgggttattgtagcacttatggttaattaggtttaaaagattgtctcgcgatttccttcataactgtgcaattagtttttctttttatctatatttaatg

SEQ ID NO: 48218 - DNA, 3026 bp, Oryza sativa
  unsure (1)..(3026): unsure at all n locations
caatgctttgatgtagtggtgcggtggtgcctgtgttgactaacatgggtcagcttgtgaagaatctattcccaatatggttgtttggactattgatacgtaggaggcttggagttaaccttgctaccggtattacgctaagagaagagccaaaacacattggcaaacaaacaccttacatcacgattgatgtgatgggtgtaagtcgatttttataagtggcaaaaaacgagaagaaaatatctagagaaatggaaagagaataggagaagaaatcaaattttcaaatcacaagggacatcatatgtgctttgtctgcttaggctactgttcctgtggaactattcaccacatcatgcatgggagaggtgatgagatcttggcttacggaagtaggctcatcggccttggtgggtcatggccagctgaggagccagccatgtgggggcagggaggagtgaggctccctcacacagtgtaagggcatctcccagcgattgagttgtgtttgagaccagcacagctacggaggtgacggaccaaaatttctggcagaaatgctatcaatttttataatagtggagataaagatatggattacatcatgatataaagcatttatgagttagctggtttaaatagcacaactagatattcgaaacttttaacaagatactgaaaacattcaaccacacaagtcgagattaaaatttcagcctgttattcaatcaacgattcaaaatttctagcagagcaattttaaagtgtacaccacatacaaatctaaagtcgcaaacaaggtcatagttgtcacttaatcgtctctcatattaatatttgcacaacacacaggaagaatcatgggcatatttgtcacttgaacaaataaaacagaaacttcaaaagatcaaagcaaaagaaataacatttccgatgagaacaaatcattagaacagaacatgacctgatatattttccctcaagcaaatacacatctgtaactgtgtcatcatattcacaagttacaaatacaacattctcctgtaaatatatcaaaagtannnnnnnnnnnnnnnnnnnnnnnaagtaaaaggaaatgagtgtagtaagactaacttgacgagctctaacaccaagatgtgaaaggtgaggtagttcctgaagaagaataacaccaactatattatccccagcagctttgacctatcaaataatgagcaaaaccatggtttatcagttatgggggtgataagatcagcaaataagaacttggcgctcccaaagtacctcttcatctccatcagccttatctacaattagaaccacaggttctttgacagatgaaggtaatgatccaggaagaattctttccacctgaataaagaaatcgtttccacaaaacatagacaatcagaccagataataactcaggcccaggaaaaacttctagttggactgaggatattataaccattccttatttagtaacctgaaggaaatgtctcttgcaaggcactggcccaagctgatctaatttaattagaaatgaagcatacaataatttacatgcatgtttatgaaacaaataaacatgtactatctccaacagaaaacaagaacctagagagtagaaaaatggaaacagtagaaatttctatatgtcactaatgaaaattgaaggcaccaaaaacctagatctagttacttgcctgtcacaggaaaataaaattctactcagaatgccactctgacaaggataaagatcttggttaatgctaaatgagtcttatactcctcccaaaacatgtgacgtccacccaaaattccaaatgtgtaataaaacttcagagaataatgcacagaggaagggtggactgtgatagatggagtggaaaggactaggagactataagctaggatgatgaatatttgggagaagaaaacatatatacaaacatgtctttgtccataaaaccacacatttatggtcatgatattgcacttcctgtctgaagtgccctaagctaaggttcccttgctctattgtaagtaatcaggttggtgcaacagaagatgtcaaggagtgtttcctactgcagcaacactacaaggaaaaaaaaattgaggtctctctctctctcccccttgaccagagagaactgagggcaaagcaacctaccttgccaaattaccccaatcagtactcgccctccctccctccctcctccccccccctccttcctctctctctctctctctctaccagagagaactgagggcaaagccacctaccttgccaaattaccccaatcagtccctgggctgtgtcaatggatatgcacaaaatttcatattaggattatggtggcaactcaggaaacaaggcaatgcaaacagaaggaagttcaatgcaagaaagtctgctgcttagttacagaaaatacccgcatcagagttccatgggccactccaggaacaagaacatcccagccagttgatccaagtacttctcgaattgctttctgaagtactgtgcatagtttagatacctgaaaaacaatgctagacatatataaaaagttaggttcagaataattagattgattacagctccagaaaaccacaatttccagactctgtacagaaaaggattacccagcacgaatttctgcctctgtgtaagttctcacactgttatctggtattccaagggctttcccaataacctattaacaagacagccacacagaatctaagtttgaaacataaccaaacaagacaaaaagtctgagtgcaaaacttgtatggtcaaatatcacaaaaaaaatgtaaatctttaggaacgaccatctgagtaaagttgtccatgaaccaattttccatgcttacatgccactgaaaatgtctgatcccagatatgcccctgaaattttggttcttccagttttaccactgctttttaattcatgcctgaaattgcaatcattgtcaatgttgcgggatcagctcagctgacgtgccaacaa

SEQ ID NO: 48219 - DNA, 728 bp, Oryza sativa
caacgtactgagcaaagtccggaatattgtcgtcttccacttcatcttcttccatttcaacaccttgctcttcgtgggatgtccaacaattatggcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaatcgtacaaaaataattattcttacaataatgatagtcatacaataattataagataattacaaactgtttcaacagtcatacaataatgacatatctttattcatacaaaaatcataaaatattacaccaaataattcttatttactatttctaaagttttaaactaattttaatgtgttttacttcttttaattttcattttagtttttttttctagtattcaagattaactttcacaatagttttccttctcaactattttataaaaccttctttagcaaatcaactaaatttctatatattctttcttccccacacaaattttctccctcatcaacttacaacaaaattttggagacaaaaaagcgtgcaaaacatagctacaaatgtaatatgacaaaaaagggctgcaggaa

SEQ ID NO: 48220 - DNA, 12007 bp, Oryza sativa
cgaaccgcgcgcgtgcgccgcatcccttccccaaaccctagcgcacgccgcatactccctccgcatggtgagccgagccgctgacaagcgggtcccacccgggaccacgcgaggtgagccggtccaccggctccctctctcctcccctcccgcgcgcgctctgggccgccttctgggccggccggcccatttagctcggccgagccgccccttttctctcgggccgcgccctagccgcccgagggaagtctaattcccctccctcttccttttctttttccaaaagggtttaaataaattctttttcctttagaccaaaaaaccaataatcttagaaattcaatatgttcccaactgtaaatccgttggactccgttcaacttccataattcctcaaatctcgagatctatctaatggcatgcttagaggtcattaatagggctttatttttcgccgtttgttgagttgtcccattttgcgtgtcgtttcggagcctgaagacccgcagtgcgaggatttcgaggatcaagctcaagatctcgagcaaggcaagccacctttgaacatattgagccaatatttgaacttaattatattgcttgcaaaatattatgcattgataggattacacttaatttgtttgcgctgtctgaaaggcagaccggtgggcctacccaacttgttgcatctgatccttccattgttaattgttatatcatgttcccttgtaaccatctagctgcgcctcgatattcgtgcactctgtgcgagtatcgacggtcgccttcaaacttaaaatctgagtaacttcttgggtaaaacttgggttttacaaaagacttggaaaacccgacacctgggtcggtgcttgcgaactaaatgaatttccaaaaccgcggaccggggaacgtaccgggtgtacggtttcccgctcttgcacataaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttagtctgggacccctctcgtcggcatatggtaaacctgtgtcggctttcgaaatgccttgtcatgaaaacttggaggtctcccgacgtggctgatccccacgggctgggtgatccggttagtaatgtcgtgtgggtaaagtgtaccccctctgcagaggttaacaaactgttcgaacagccgtgcccacggttatgggcggatgtgaggtaattcctagcgtagttttgtttgactactgccttgtgaaactgctgttgtggaaaggggatcgatgttggaaaaatctgcagctgatgggatcagctaggcccgggtggccatttgaaagttgttgcccgggtggccgtttgaaagttgttggccgggtgccaatcttgatcaattctaaggactgatacattgcacatactccgaccggacgagacgcactgtctcatccgtgtcgtttgagaagcactcacttagttgatttcagaaaagagttcaaataaaatcaatttgcaaaaacaacagcctttccttgaagcctgcattaaacacttatttcccatggcttgctgagtactcttgtactcacccttgctctatataaatatccccccccaattgctgaagaagatgaagcggatcccgctgacgaggagttcttccaggagcaagccggctacgatgagttttagggtttcagcctagttcccaagtcacgcctgtgatgtttggtccaagtcttggcttctgcttcccttttgtaatgcagttgtgagctcgggatctgtccgcagcccaacatgactgtacctctactctataataaagagacctctgttgctgtgatattctgtcttcctgtgataccagcactgtttcctgggactggtatcgattaataggttaatttggagcatcacgggctagttccggtcgggactagttcggggcgtgacacattcatatgctaattataattgactagagaatttttaaaagtttcaaatcatgcatgtggcatttacatatgttaattagagtttttcacaatttaatttactatcattcatatgctaattatatttgactattcgaatttttaaaatttttaaatcatgcatgtggcatttacatatgttaattaaagtttttcacaatttaatttaatataattcctttgctaagtatatatgatgattacaatttttattaattttaaatcatgccgtatgtatatacatatgttaattagagcttttaccaatttaataatatcattcatatgctaagtatatatgattattagaatttttattaattttaaatcatatatttgcttattaagttttatccacttaatttattatagacaacaataatttttcgaagtaattgtcattaatctttgtactttaaataattgtaatgcattatcttctattttagaaacacatatgtaatggaaaataatatttagtgtgcttatcagtagtcccggttcttaaccctaccgggtttaaaaagaatttggaaatagcgggaaaatatctttagtcccggttgatagaacaaccgggagtaaagatttctttactcctggttgttgagatcttttttttagtcctggttgttctcaacaaccgggagtaaagatatctttaatatctttactcccggttgttctcatcaaccgggactaaagatctagggctatatatattcccagtgcgcgccctcatcttctccaccaacacttagaagtttttgcccgatcgatctctctcggcttctccttcgccgccactgcctagggcatccccgcgccgacgccgccgccatatctcgccatcatctcgcgctcgtcgtcgtcgccgccgccgccgcctcctccgccgccgccgcatctctggggtgagagccgccgcgcgccgcctctctctcgatctctctctccaatctcgatctctctctctccctctcggttgccgccggccgccgagtttcagacgccgacgccgacctcgtcacgacacgacgccgcgccacgacgactccacgccacgagacgccacgtcgccgcacgccaccgccgcgccacgccgatgccgcgcgcggcgccacgccgccgccgcgctgccccgccgccgctccgctgccaccacaccgagaacgtgaacgagcgaacgaacgtgaacgagaacaaggtgaatgaacgtgaacgagaacgagcgaacgaatgtgaatgagccaacgaacatgaatgagaacgagagaacgaacgtgaacgagaacaaggtgaatgaacgtgaacgagaacgttgtcggacaaacgtgaacgagccaacgaacgtgaacgtgaaatgcaattataggcaggttaatgaacgtgaacgaagaaacgtaggtgaatgaaacgtgaccttaacgagaacgcgaacgtgaacgatatcgtgaacgaaatgtgaacgtcaaatgcaatatatgttacttcgcgtttatcctaatacatatttttgtatcttgcagaaaagacgttgtcggagtcgtccctcaagccggagtggtagagctagccctcgaaggaattcgcccaggcaagtaacgtaattatatatatatgattgatatatttgtaatgcaattaagattattagatttgtaattagacttaattagcatataagattatgtagtgttctaatatacgacagttacacttagaatacatgactatttgagttttagtagaagattattggagttttagtataagattattagatttgtaattagacttagcatgtaagattgtgtagggttctaatatacgacagttacacttagcatacatggctatttttgtcttagcatataagattatttgagttttaatataagattattatatttgtaattagacttagtatataattattgactagctagggtcctataatatacgtcacatagacttagcatatatcactatttgagttttagtataagattattagatttgtaattagacttagcatgtaagattgtgtagggttctaatatacgacagttacacttagcatacttgctatttttgtcttagcatataagattatttgagttttaatataagattgttaaaacataaatgtctcatgacctagcagatatttcctgtataaacaggtggctgatcgcgatgaggaacagatattgtacgattcaatcgcggagggaagcagccagtactggaacgaagaagaggggaacgaggatccaaaccagtatttgaacgaggaagggaacgtggagagggatgcggaggggaaccaggaggggcacgtggaaagggatgtggaggggaaacaggaggaggaggctagtggaagtcaaccctccgttggacagaagagggcacgcgggcaacgaggtgccgcgaagaagcttgagggttggcacatcataacggaagtggaagaagatggacgacctagtgccccggcagaagccgccaagaactatgtacgtcacagcggttgggttgtgcgggataacgtgcctgtcagtacggtgtactggtgaagaacaagggcacgcggagatcatgagagctttgtcctagattcggagaaagagatgctgtggaccacaatgctcgagacattcacccttcccgtgggtacagaggacaaaatggaaaggtggactctaaagaaaatggcagaacagtttcagagcttcaagggagagctgtacaagaaatatatcctgaaggggcagacaccgaacttcgacacattcccaaagctaagggatcaccgggacgagttcgttgcatataagacaggtgaacaagggcaggcgatgatggaaagaaacaaagaaaatgccaccaagaagaagtaccatcaccacttggggtcaggcggctatagcgtcgcgatgccgaagtgggaggagatggaggctagcttgcttgagaggggtatcaaaccggccaccgctaattggccggaacgatcgaagttctagtactatgctcacggtggaacgctcaacccagctgatggctcactggtcttcggcgatcagatacgagaggctgcgcgtcgactaacagatgcagttgaagcctcttctcaggacacattccgaccggatagagagagggacgagctgtcactcgccctgtagactccagagcatccaggacgaacacgaggcaaaggggtgattccttggaagattgggttcaaggaggacatccacacgtacaggagtcggatgaggagcaagagagataccgaggcgaagattgcagatcttgagttcagggtatcgagctacgagctcagcatgcaagaggaggtggcaaggaaggttgatgaacgcatggccgcacatcggtccactgatccccagccgaccattcctcctgcaatggtgagcccgttaggaaaccgtagcagctgcgcttcaacggggcaggtaggatcacagagcatggacgccatgcaaacccaggacgaatccacctgccccgttgatgacatcactcaacggacaccatgtgagctacatattcctttcaagaacttatcaataaaggtaagctcgtagtttatatattttagatttgcccattccgctagttgctgcttatatatgttgattactaataaataacctctcaccacatgaaggtggtgtcgggcatggccatcccaacggaaccttcaggtacttaccactgcaggccgattccagcaggatactcgaaggtcgaagttgagttggtcaaaggcgcgtacgaggacctcgagctggattaccctagaggagacggtgagacgcatctatgagacacaagccatgccattattctatgggcgacaagcggcgtctcgtgcaccatctcctccggccccgccatctcctcctcaggatcctgcactgtctcctcctcatgctccagcaccgtctccacctcaagctcctgcaccgactcctcctcgggctcctgcaccgactcctccgcaagctcctcttccgacaccttcaaagtcaagggccccccaagctccaccacctgcccacacaagggcaacgaagaaggcgaaagttgacgccgccaagaacaaggacccggggtacgattgcacgcaagaggagcttgacgcttacgtggcatcagaagtcaagagacaattcaagcctcgaagaccagaaaagaagattcctatagacccgagtgtcatgaacttcttcaggggtatgtctgcacctgccaaggaggccattaagctatcggactatgagcgaacgctgaagaaagcatcttctggaaagtccaaaacagtccctcagcttggagagcaaccaaaccaggacatcgagccgttggtgaccggtaaagaaatgacgatagaagaatttattactgacaccggtctaactacggatcaattgctaggagtcgcaccaatcgaaaaggcagaagtgaaatacatgtacgaactcggtaaaccgcttgtcaaccctgagcttctgcagtccctacccacacaaatgtacaagttccatcagctgtacatggagatgagcgccaccggtagagagatgatcggagcgaggatcagggacacggacttcttgcaaggagatgacattctctggatcaatttcaagggaatctacgaactataccagctggacgccctcaacgtctctattatgagttgctggattttgtaagtatatcattcagttagatttcttactacgtctcctttaattaattaagtccttgtatataagtagactatagaaaataatatactcccttttatcgttgtagaatggagattcaaagggcccgacggcggggggttttcgatactggattcatcgaccctcggaaagtaaacgtcgcaatgctcgaccaatatccgcaagccacagaggacaatatcgtccatctcctgaaggcgcagcattacaagacgttcatactgttgccgtacaacacagagttagtttaattttactgtcttcctataccaaatttcattcccgtacgaacttgctaagtgtttcatatgtaatgcatcccacgcagattgcagattccactgggtgcttttactcttcgacctgtcggcctgcaccgttaatgtatatgactcaatggataaaaaagagtctacgtttgacaaggttttcgaacttatagacaggtattgtcataagttcctctgttaattaagaaaatcttgttatgttaattgctactacgaatcgtagctttaaactccatgtagggcttggtatcagttccgtcatttggtccgtggcaaatggagagaaagacttaggtggaagttcaaatttcctgtgagtacacatgctctacatttatatttctccgattcaaatacatacaagtgtatattaattagatctctcgttgtttgtcatttatttgtagtgcgcaaagcaaaagaagggaactaacttgtgcggctattacgtgtgcgagtattgccactgccttgcagaccaaatcatcaccacaagagagctcaatgtacgtacaaataaattcaaaatttcattacgtatcgatttcttgttaattactaatcaatttcatacattcatatagtttattcgcatgagggataacctgaccacgcacaaggaatttatcgcggcggttcaagaacaactcatgggattcatcaacgaataaatccttgatcccaagggtgaattctactacgacggaaacacaattcataggtccttagcttctgagctagcgactactactacgtcgaaatcgtagctagctaggacatataatggattgtaattaatacatgactacatatgtttctatatgcatgtgtacacattttctataacgtaaatatattttggtcatatatatatatatacatatgcatttgcataacatatatatataaatacatatatattatgcatgtacatatgtattgaatcatatataaatataatataatatatatatatatatatgcatatattatatatgcatatatgtactgaaacatatatatgcatggtttatatatatatatataaaccatgcagcaacagggccatgcaaaaaaaaaggtcagctcgatctttagtcccgattgggattaccaaccgggactaaagatagcgatctttagtcccggattggtagtcccggtttagaaaccgggactaaaggagggttacgaaccgggactacaaagtgtttctccaccagtgtaccccttgcgattttctcggtgacccatgcttcgtcttgtcgactgattgataggactttcttagaaatatatgatgcaaggaactttcttttatgacggcatatcacatattgtatacattcatctaatcgtccaccacgatggttttgaaccatgtgtgaatgccacgacatggtcttttaactatagcgaccaaattctcctcatagctccatgtgcaaaaatcttaaatggccacccttactaacaaattaatttgccaccacggttttcaaatacttcattgcagccaacataccagaggacgatgtggttgttagcaagaccattacaagaagcatccggagatagacacatatatattgctgtttgagttatggtagtctcagtcctaaacaaacagccaattcaagatgttcagaaatgcaagtgtactcacaagtcacagcaactcaacaatctgcatgcatctcctgcaaatgtggcatagatatatttctctcaagctagtcaggcatgagaggcgtcgggagtttgggggcctcattttctcatcaactagtcaggaaaatgtagatgtgcagtgccgtataacatgctgagcaagcagcgttctccctgtactctaccttttgttaacgtcagtgcagcgtcgccggtggtggacgatgcacgcaggtgcttcgctgttctaactgatctcgaacagctggatgggggttcgatttcatcggcgaatcacgattgggtgcctgttcgtcagttcttgcatgctctgttaattagtgagatcagtaacgttgacacatatatactgtaaaacatgtgtaacagattgatgctgatatcaaatctattttgagatagcccttccgtattttgagacagccatatgcctctttaaatatgccggttaaaggtgccgatttttttttcgatttcaacccacggaggttgggaaaggcatataggtgccggttttatcactaccggcacctgtagaggcgatagctatttgatgttttgtagtagtgtttgctttttcctagtcttccaacaagcattgacatactacattgtgtgttcaagatagtccaatcaataggtgtttgattgcatataaatcttctttgtttgattgcattcattacaaaatcgcatcgtagtgttagcaccgcatattactagtttaacttgaatgaattgaggcaattgccacactttatagcgtacactgatgttgccagataaaatcagcggctaggaaagaacagcccggattgctagacaaaaagcgcatgccattggaatagtcaacgaaactaaattgggtgatcctatactaccagaggatccatggttggaaggcagcaggaaatcatgaattacgtactttgaactggtgttatagataatattatatgtaccagttggtgaaatggtatgctttggctagaccaaaagattatgcgatttgctccggtccaacaaaaagtatctcgagataccggtaccttatggtaccaaatcgtttgcgatcgttggatctaagaatgaccatcttacctagttggatttaggaccttagagtactactcaggtcactataattactgggctacatgctctttcgctgtcctgatccttttgtaatcctctatgagtatgtttctctcgtgcatggagatcatccctcaaggacgtgtcatctgtcgcaggtttgaaagctgacctagctagccatgttgcaagtttgacgctcgcgtacgtgcatggcaatctgtttgcaaccagccatgtttacaatactagttcgttgttatgtgtaaataaaaggaaaagatgtttggtgttatcagaattattgaatcggtacaacaacatgtatcataccatgcatcgcatcatggaggagtggtgagaccgtgagactatgagctaagagtttttaatgtttcattaagtatcttgtagtatgctttattgattgaaatttggtgttttattattcttttaactgatgtctatcttcaagtattgatgaatgttgggacaaaattaatacaacaagcatatgtgtatcacttctgtattcaatgtgcccaactgtaagcagtgtttatatatttatacaggatgtacaagagaaaattacatcgctaccctaatcgctgatttatctaggtggctggatggtgggcctgtttatggctctttggtaaactcctcggtgacaggagggctgcgcccattaagggagcggcacagattcccgagggcgcctgctattacccgggtaaaggcgtgctgcgggtaatagcgtacgctgtctgccctcgtcagcggcgtcagaggtggttggcagatgcgtactgtgtatttatggtgttccactatatatccgttcacccatcttacgcctagggctgttgaggccctagcttcttctggagcccttgtacagctccggaggacctggaaggctttgaagtccttggacagctccggagtccacggacagctccggaggccttggacacccccgtagcccttaggtggctccgaaggccttggatgaccctggagcccctaggtggctccgaaggcctgggtcggctccgaagcctatgtttagctaagctccggagtctaaatcagtagatgccttcggtcattcttctgatgtggatggctccggtaggtgctgcatcacaggacggaggctagctccgctacccggagccactccccccaacaaagcaaaccactcaaaaaaaaaaactccagctattctaaataatctgtcctactcaaataaaactaactctttgccaaattatgacactaacaagctgcactggagtaataatataatggaatttctacaattgtagcgcctcccattttttttattaatctcgttcacctttttcctatgattattctatatcctatatatatgtaagcatgctcttatctctcatatctcctcatttaagtagggtttaatatattatttttaattctaattctcttgtaccctgtgtatgaaaatatcacaatgtaaatattgaaacttacaatataatttttgaaatttacaatgtaagtgtaggtaatttacactgtaaaacaatttcattattttttactgaaacatacgattcaatatattctactccatgcagaaatatgatttactatctacgtgctcaaaattttctgaacggttgtcagaccacaaaactaatgcctgaattgtaagatcaactatttgtcttataatatcgttcctcgaggaaaatattgcacgcatcagattcagataatcaatcacggtctgatccagggattataacacgaaatccggacttcctgcactgcgtcaaacacaaaatctgctcggtttttccgggaaaatacttagtgcaaaccatatatgtagtcgaaatttagaaactaccgttggatcgagaaatggacgttggagattcgtgcacgtcaccatgagttaaaatttaactcgcagattcactcatgagtgaaaattttacttggagttaaattttaactcac

SEQ ID NO: 48221 - DNA, 17904 bp, Oryza sativa
caaatttagatgtagtaaccaataatgcacataaacgcctataaaaatgtgaacacgtacatacgatgagtccgtctggttttccacttcccaatggcatcaatcttaacgacaatgcctccttccatcccctctttttcttagacagtcatttctccctatatcttcagttcaaccatgtatgtaagttgttgatttgcttgatctcacgtctccttttccaacaatctcataattcccttttctcgaacaaacatgaggcgaataatttcaccgcacggttgatgcacgaaactatggtgtataactagctaggcaaaggaggtattcggaatggttggaggcaacttatgacgaccatcgaccgatccgctgaaacaagaacgacaacaactaacgaggttggcgcagcggagaaaggtgagggccatgtgactcaatcacccggcgaagtaatgatgctatgaaggagtctggtgaagaggtacatggcaaagccagggccacgcgaatcttggtgatgcgatgaagcgaaatacctggtggcgaagcaaatgcaccaagtggcaaagcaggctcggctccgtcatgccaaaaccaggggaaaccatcgaccaaccagctaggccaaaagacaattgctatcctcataaatgtctccatcagagggacaaccatattaactcactagcacatcaaactatagggttgtaaatctggccagtaaacctataaatagaccttaatggcggtttaacggagaatccaaattttcaattacaccatacttattatttttcaattccttccacttagagtagagcatgtctttcggcagaggtgttcgtaattcgaccacgggaatctcatggcatatcatttgctcatcaaatggcccgggtttacaaaacttggtgtagtagcagaacgcttgccaaagtgacttccaggtaattatggtaccgatgagctgctgttcaccaattacatggatccaagatcccgcctcgccagtggggatgagttcacctcgtcctcactgatcatgatgggtcgtcggcgttccaacagtgcgttcatcagcagttgctcagagtaaattaaaggaagtgcagacctagctatacgatgctatatacgtatatatatatatagctattctaattcgttttaattagtaagtcctacaggaaccatccgccagcgtaataagctgttgtacttgtaaagaaaacgtagaatattaaagattggatagcaaaagctccatctctctcctctcaatctcaccagtgcggtaatggcccaggcggtaccaacttcacacatatataatgtactcctagctactagcacatgacactaattatgacatggaattaatttttcagggtttcttctaaactactggtaactgcgagagccggtacaataacggactatgaatcagctataaaactttctgatgaatagcgtacttaactagttattttccccgggcaaaactgcaaaattccatacgtacttcatctatctatttatgccacactaatacagttcttaacaaaatcatgtgtatatgctttgacaaaataacctttgagatgcattctgaaaaataataataaaaaagaaccctttgagatgcaagtaagcacctagctgcagaaaattaatgaccaaggtgttttgtgcgtacatgtattatttactactaggcatattctgagtatattattgcacgtacacagcagttaagttttttttttcccatggactatatatgaggaaccatggccttatctgttctgtgtcaagggtctccacacagggtaaaaaccaaaaccacaaatacttgatcttggtgctctgagtgaatcaaagtactatttgttgatgagatatcccatgaaacccaacataatgttgaataagccatatgggtttgggaggcctcaagaacttacctatatatgccgaaattcacatcagatgttagagaatcgatgacagttgcccagcatcgcttaatcttcttccgtgcattccttctctttgctctacaagataattttacatggtaaatctaccatgtgatatgacagccatcttgatcgcaactgcaagctgatggtatctcatgcaatgtgagatcattagttgtagatgaacaggttaatggtcagcagttcttcacaacatgtattttccttacaggaagaaactttgcagttaattagtatcagtattgcagtatcaaaacaaagcatacaacaaaattttgcaaaatagaaattcatatcctaaatgaagagaccaaaatgaaaagtttttcctcttgtcatagtacggttttaaatagtttaaattgataaaattaaactaaaacaaaaaccaagcaaaacaaaaaaaaacaatgaagagcgtggtattacacgatttcattcccgtgatgatggcattcattgcatataaatgggataaaaaaatgcatcaatgaccaaagtctaaaactccaattttcccctccaaggtgtcttactcaattgttttccccttctagtgtttacatacccatacttgaggatggctctcaaacctaataggattccctcacacatcttttccctaccaaataaaaccctatcacattgccggttacaaaatgctcgttgctgccgatttggaactggcattgttgctcgaatgctatcgctactggtccaaagaaacaacaatatatagtgcttctagaaaaaaaaacaccgttgtctctctaactcgcagcagcaccacatcaacgtaccaatggccatgcccgtcatcatcatttgcagcaactagcacccaaaatctgttgccatcttttcccacaccaattaagctagagaagctagatcgatagccccgaggtcggaccggtcagatctggcaaacaagagcttggtccagctacaactgacctagcttgttccctgtaaaattaaatcatgatataatggtctgaaataaatcctagaagcctaaacatcaattggcaattttgacctttggagccgaaggatttgagtggcttatatttgtccagaattgcataggtgtactctaacatgtgggacagagttcatgtggatccccatcatcatcatgatgggatgagattaatttgctccatcctgcctagctagatccaacgatcagaaacgatttggtactatgaggtaccggtacctcgaagtactttttgttgaacatgagtaaatatcatttgcaatagaggctttagaatgcaggccatccatcaattggggcagcagctttatgcaccatgaaaaggacaacaacgagctctatgtaggcctggatcttcatacaagtagtatagagtgcaccttcttaattccttttctgttcggctctccctctccataaaatttattacttccaatcttcaggttcttcgtctcccgttcttgacctcacttctctcattacaacttgctcaaatctgcctctcttcttgaagtaatattaggcataaaatttgaccacaccaatggatgcaagaggtgatatagtatgtgggcatgggaggtgtagggaatggcaccctcatcaagcaagcgtgatgcatctttcatcagtgatctcaccaaggttgcaatccaacagtgtttacatgaagctgttcgccgcctgcaccccagtatatacatagaggtttacttttaccatgcacgtatggtgccctgtcgttcggagatggttcacttcttgagttgcatgaatcgcagaatggaaagcgtatatagtctatgcagttgaggttttgttcatttggcacggtataataaatgagtgggattatcctatgctgacaaaacaaagccttagtttagtgtaggagttatgtagtggatccacaagctgtcaagagctgaagtttcagacgttcaaaaatggatccagagttagggtttgaattcatcttgacacaaacgtgggctgaattattaacttgtgctacctgtaccaaaatttcatttgtatatcacggtgacaattgtcatttctttaattttgacctcaaacgaacaaatgctaactaaaggacagatcaatcatcgcataggataaacaatctgttgaaacatagcaagtggagtagtgtctgggtattctacctctgattgggaggtgctgattagtgtagggccaacatgcatgggagcatttctatcatggtgagagatgtgtttatatgcagccaaacaccagcatgcatatatctctcaactgcgatatctaggcatgagagatgttgggaatttcacggcctcatgcagtcatgtcctgatccataagctacgggaaggaagaatctgtttgtagcataatttgactaatatttagttttatttgggtaagccacattatttagtttagttgtctagatttatcgagtggttagttaaatgtgtgtggattgctgggaggcttagcagtgatacttgtgacatagagatactatgggtcagctaagtttaaccacattcaaggaaggtttttgcgatggtactatttgcatgtacattagagagtgaagacctgtgcagttggttacttggttgctggtgaaaatttgctgcagtccaggatccttttggggctgatgatcatattcgtgcagtggagaagtctatagcgtgctgctacttgactcttctcttaaccgcttgcatgcgttggtgtgcggctgcgtgaaagatgcagctgtgacgtcggattgtaaacgatacggcatgattagagcgtgcagctgctaggaagatagagatatatattttccatcttatcagtttgtttcctttgtttgaacgttgctactttttgtgttagaccgatgaccatgctacccgtgtgtgtatatatatatatatgccggtgtacggttaattgaggatgccgaacaaattattaatctactattttcctattctttactttcctgttattttcttttttttttgtttttatggctgagttctagcaacataagtgtttggttaatctttaccgttttgcgttgaaaaacggtcgtgcttctctacgaaaacgagaaggttattatcctttgcaaacattgctaggaaactagtcatttgttgttacgtaagtacgatattatcttcttggctaattttctcgtaaattagtcgtgtttggttctacgaaagtgaattaatctcaaagtcggtttagttggccggttttgatttattgattttggtgactctgttgattacaccgtacatcgttagatgatcttgtgttgaccacgaaataatgtcaacggaatatttttcactaattggcttctacacactctcgcaatcccaatggctttgtggcagatgccacacatttcttgccacagagaatattgaggatcattagggaaaaatatttaattgatgatttggttgttttgcactattttgttagtggcatacgcaatgttttaatttggtggtttttgcttcgtataaagggttaatccgggatattattagggatggcaacggggcagggcgggcgcgtgttgggctggaatgaccccacccctgacccccaactctccacctggccccggctccgagtggacatgcggggccaaatcaggccctgccactggcccctacggggccccgcaacctgacatgggccccgcattgagtagcaattccatcgaattgccgtgcgtctcagcgtttgtccatgcacgccgctcgctccctgtgcttgcgctgtgcctgtgcactgccgccgcgtctctgtggcaccgctgcaactctgtaccgcgctgctaccggaagagactaagagaggggcgtgcgacgggagtccggaggggagaggaggggaggaactggggagagcggcgagcccacgagatctggcgaccggagagagccgggagagaacgggaggggactgcggagagggcgaccggagggttggggactccggggtcgcatgagtgtgtctgcgcctctgcgggctgcagctgtgtggtggcgtgggaacaaggtgtgaggggagccggggtggtctagttagggtaggttagggtttttttccttatatatgctgacttctactgttttactaagatgggcttcttgggcctataatgggctatattttaagaggtaatatacggggccccgcgggtggaatgtctcccgtcccctcacccgtcaaaatgcggggccccggcccagacggacccacggggcagaaatgtcccccacccccgccccttagtgttgcggggacccggctccgtggggaaattgccatccctgctattatagttgaagcataaggatttaaatataagcagaccaccacctaactatatttcaaacgtggtactaaataatcatcactacagccacgcctcacgcctggatcacttggtcctaaaccagaccacgtgaacacgtcaagtgcaattgatgagctatagtagatgttacgagatttactccggtccaataaaaagtacttcgaggtacctgtacctcacaataccaaatcatttcggatctttagatttagctgggtaggatggacattgttagatccaacgatcggaaatgatttggtaccgtgaggtatgggtacctcgagatactttttgttggaccagagcaaatctcatatgttatggatctttagaagaaagtaaatttccatcaaagccaatatctaaagctagtttacaaagtcctataagaattcggcttccatcggatggtctattcaaccaaagaaaaagccaaaatttgaattttcaaacttaattttgatattgattttgagatattttcaacgtagtttctttttcagcattggcttttaagtcaccgagaacacatatataaaagttttacctataaatttatttttattctctaataagccgttttggcttattaaaagaaaagccaaacgattgggcccttcgcctcctattccacaggagcatcttttctcctaaaaggatacatataccgaaggttgttgcctaatcgataggtgcatctaattttggaagaaacttaacacaattcatggtaaaaaaaaacagaatcacatgcagtaattgcgccgaaataaattctagcttattaaaggtggtataacactacaacagtgggttaatttggatataaagacttgcatatataatgagaaaattttcctatattctctgtggaaaactaggtgatgtacaaggaactttgctctccagctagacactatagcaaaagcatccaccttggtttcatttcgaacaaagatagctaagcatgcgaataggaggtgtcgggtatttctttcctaactagaaggagaacaaaggggcatgcattttgttgctttgcatctgcagatgaactatgcagattgtaccactaacaaataaaactatgaatttacccccaaagactttgctaaatgctaattcgttgtgatgggttctgtgaaatgcatgactatagataaaatataatagtcatacattccacaatacttggttttaattagtgaatcgaatgctcgagaaaatattttttttcatatatgacaaatctctctgtagtatttatttttcaataattgagcctttttatattagcttcttattgaaccaaacagtaagaaagataaaaaaaaagtgcataccattaggggtagagtcactcccataatgttagcatggatgtgcaactggtccagatgaaccccctgccacaccacgttcacttaaccatgtcaaagtaattggtgtggctaaagacttggctgtgttcttaatcacctcttaccaactttactctctcgtttttcactcgcatacttcctaaaccgctaaatggtgtatttttcttaaaaaaatctatataaaagttattgaaaaaaatcatattaatccatttttaagtttattttagctaatgattaattaatcatacacaattagattgttctaatttgcgtgcgtggatgattaattaaagttcccaactttcacctccgaatgcagtctcaaagaggttcaattccaaatcccttctgtgctatcgtactaaatattttattgaaaacattttaaaatatgaatgagttcactttaggtcctttaattggcatgaaaataagaaaaccacaaacactggccttgaaaagagtacttataaaggtagctcatattgagagagggatctgcactcacatacatatattttttttttactaagctcccatgcatatattatatatagagagaaggcgggtgcactgtggccttgtggggatgggaggcatgaggaactcaacaaagcgcagctgtcacatataatgctctcagcactgtcatgccataggaataacctcgcaagagcaaagcaggtgttatttcttggccgatcactaatggtagctgtggcttggcgggttttgatcgagcttgtaaagcgcagatatctttgagcaattttctcggcaattgagcgtacatcgtcgtccatttctcctgtcgacactggttgatactctctctagttcatattataagttgtttgattttttttttttgctagttaaacttgtttgagtttgactaagtttatagaaaaatatattactccaatactttgatattttagatgttgctaaattttactataaatttaatcaaacataaatataaaaaaagtcaaacgatatgacataaagggaacggaaggagtaggaccgaaggatatatagtatcagggaagagagagggaaatcaacatctaacacatgtatggaaactggacatgaccaaacatacgccgttcaacaaattcattaagctatccataagtgatttgcactaacgcatacatggcttgtaacattgtagaacgttcaactcttcaagtgttttaagacccatacagatcttaaggggagagcacacatatggaggaaagattggtttcatcagagaactaaaaatcatgtcctttataaattaaccatccattcgaagtttcggtgcaagttcagggtacaaattaaacatactgttaccacggggaactattttaaactctcaatgcatgggacatcccatcgttgtttgcatgtcatcaaaatagttaagaaaaaaattgaaaaaatttaacaagaatgattaatatgtgataaattacaccataaacatacaaggttaaatttaacttctataagttgcaacgaaaaaacaaatttaattgcgaatactcttgtatgtttgtggagtgatttattatatattaatttatcttgttgattttttttaaaaaaatttataaccatttatatgacatgaaaataacgaggggatatcccctcgagggtttagaatccactcccccgttattaccacaccccacgagtgatccggtcgatcaaagttgctctgttgccaagacgcgacgaggcatatttgttgaatgttgatcatattgcataagacaatatcatatatgggtagtcttatgaacttaattatctatgctgaattttactccatgtattgcttcaacattagaaagcctgttgaacgtacagcgtgcctttgcttatttattgatgaaaaatagggcgaactgggtattttagtggcaaataaggtaccagtacagtttcaaactgtaaaaccggtctgggatttttcacgtttgttaccacagtagtatatcattggtcaagcaagcatggacagaatacctgacacaagaagttaagaagtactcctaaaaacaaaaacaattgttcagactcacaagcagttcaggacatgtactagtctgtctgtgtccagggttcgtagccagaatttaactttttttgggacggaggggtatgtccttatcttttttaaaaaatatgcgtcaataattagcatttgttgcgtcagaattgacaagtctcaaaggaaatcggattagaaaaaattatatcaaactggcaggttgatgagatttgtagttatatagttgaagctttttcgtttgagtttaacatgccagaaaagcgttataagtggtgcaatctattttgaaatacaaattttagaattgttcaaaccaactcggatggtggctatatagaagtgatagaacgctaagagatatacatcttagagatatacatctttttcatttgaaatcatgtttctttttttgcgaggaatgtattaaatttttagacaagaagagtcaaaagaattgcaacaaagaaatagataataagtgtcacgccccgaactagccccgagcggaactagcccgtgacgctccaaattaacctgttaatcgataccagtcccaggaagcagtgctggtatcacaggaagacagaatatcacagcaacagaggtctctttattatagagtaggagtacagtcatgttgggctgcggacagatcccgagctcacaactgcatttcaaaagggaagcggaagccaagacttggaccaaacatcacaggcgtgacttgggaactaggccgaaaccctaaaactcatcgtagccgacttgctcctggaagaactcctcgtcggcgggatccgcttcatcttcttcagcaactgggggagggggaattatttatatagagcaagggtgagtacaggagtactcagcaagccatggggattaagtgtttaaatgtaggcttcaaggaaaggctgttgtttttgcaattgattttatttaaactcttttctgaaacaactaagtgagtgcttctcaaacgacacggatgggacagtgcgtctcgtccggtcggagtatgtgcaaggtatcagtcttttgaattgatcaaggttggcatccggccaacagctttcaaacggccacccgggtctggctgatcccatcagccgcagattttccaaacatcgaacccaaaccacatcagcaaatttcacaaagcagtagtcaaacaaaactacgctggaatcacctcacatccgcgcatgaccgtgggcacggctgttcgaacagtttaataacctctgtagagggggtacactttacccacacgacattactaacccggatcatccagctcgtgcagaacggccacgactagagaccttaaggctttcatgacaaggcatttcgaaagccgacacaggttcaccatatgccaacgagaggggtcccagaccaacaccagattaggtcccagaccatactgtgccaggaaacccgggggttctccccgacaccaccccgttgaatccacatgtctcttggcatcatggctcccccgattagctagttactcagccaggggtgtcccattccacccatgtggtcgtacttgtcttatgttcggatgaaatttcaaggaaacggtccttaagtgcaagagcgggaaaccgtacacccggtacgttccccggtccacgattttttggaaattcatttagttcgcaagcaccgacccaggtgtcgggttttccaagtcttttaaaacccaagttttacccatggttggatattttatattttgaggggggtgttccgatgcgcatacccgaaggcccgtgcatcgaagcacaacagttaacaaaggaggtttaagtgttcaataattcaaggagggtaattgcagcaattaggattgggggccggtaggccgtctcgcaagccgcggccgaattacttgtgtaaatcctattcatgcaatatttgtggaaaagaaatacttagatttaaattataggtgcaagatgattgtcacgcctggaaattcactagtaatttccgaacttatttgtgcataaaatcctcgtccaggaatcagccgaggtacacaaactgacagtttaatatacaaatccatcataataataacgttagacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccttaacatcatgtctaccatgcgtcgcgatactagaaagtacccgaatagaggctgtgacaataccctctgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctctaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtacaaaaacaagcataaacagtacatgtggatatttttaacatgtagatctcgattttagatgaatttagcaacttgaaccactcaaaacagagttacgatgatttagttatgaatttttaaagattaaaccggattaaagcatttatatggattttaattgaattatgacgcaataatgaattacttttgaaaaggaaaaggaggattattgcgtcatcaaaggcagtccgggtgcatgggacggtctaaggaaacgaacggccgagatcgattctatccaaaacgggcggccgggatcaacttgatctaccgcggttcacgggacaaggcgacgatgacgtcagcggtgacgtcagcgatgacgtcagcaccggcgacagctcggcctcgcgcgctcgccggcgaacgacggcgcaacgacgcaaacggaggacaccaatgggtagaggacaacacggcgaactcaccggtgaccaaaaccacggcggaagagcaacggacggcgccgacgatgaggaagaagcggcgacggtcttcgggtcgacggtgacggcggtgctccggcggtcttcgacggcggcgaagcagtggacggggacggcgacgacctcgcgatcccgatggtggcgatggcgaccaacgacggcggctgcaacggcggcgcggcgcggctgaaccgacggcaacgacagcgacggctagggctacgcggaggcggcgctagacgctacggcgggctaaggcaaaggtgacggcggatagaggagagctcgggggtgcttttaaaggggctagcgagcggcgacggaggcccacggcgaccggcggcgagatggaaagctagggttggagggagaaaagtcgatccgaatcgagctcaaattcgtcgatttccaaacgaaattgaccgaagtttctataagagaaaaggaagagaagatcgaggagattatttcccctcaaacgatttcaccggaaacggaaaggatcgaccggattggaaagcggcggcggctagggtttcggccggcagcggcgcggggaggaagacgggcctgataggtggggcccacctgtcagcggctgagagagaggaggaaggggcgcggcggattgggccgactgggccggggagggagagagaaaaagagaggttttgggccggctttcggcccaaagccaaaagagacttttaaaaacctttttcaatttaaattattcatgaaatacttccttggctcaaataaatcccagaaaaatctaggaactatagaatcaagtaaagtatttaacaaaattttatctagcccaattttatattgagatttaacaaattaaaattagatcttctcttttaggcttttaagatcatttctaataattccttttaaacaacaatttataatttaaggatttttaaacaagaaaagctcttaacacttataattagatcattaatgatcaaataattactgaactgttctttgtatcatttaggaattgagctccgaaaaatccgagaaaatttcagagagtagacttaatcatggagaatttaataaaaattaaatccatccatgctttatatttaggaaattttatttcccacatttaacttcacttgtaaattaatgaacatttaatataaattctaataatgatttattaaataatttataaatcctgaaataaaaatcaggatgtgacaatgatcaacggtgacttgccttgctcgagatcttgaacttcatcttcgaaatcctcgcactgcgggtcttcgggctccgaaactacacgggaaacgggacaactcaacaaacggtgaaaataaagccctattattgacctctaggcgtggcattagatagatctcgagatttgaggagttttggaagttgaacggagtcaaacggtcatacgattgggaagatattgaatttctaacattattggatttttggtctaaaggaaaaggatttatttaaatcctttttgaaatagaaaagaaaagaaaagaaggagggcgggaaattagactttccttgggcgggtagggcgcggcccgagagaaaggggcggcttggccgaacttaacgggccggccggcccgagaaggcggcccaaagcacacgcgcgggcggggaggagagaggaagccgatgggccgggtccaccttgcgtggtcccgggtgggacccgcttgtcggcggctcggctcaccatgagcgaggtgcacgcggggcgtgctagggtttggggaggggaggcgcggcgcatgcgcgtggttcgcggaggacgcggtgcggcgggcccacgcacagcctcacggctcgcagttaaccgcgcgcgcgggcagggctggagggagcggcggaccggggtcagcttgacccggtcgcggccgaagtggcgctgacgtggcacctacgtggctgccaggtagacgacgacgtcggccggaacggacggcggacggcggcggcaagcggtggatcgaaccacggcgatacaggcgaaagcgagcacaccgggaggttgcacgggacgaggggagacgagccaacggctcggattcgccaggggatgctcgacggcggcggattgcggcagcggcaaccggcggggagagaagggggaaacggcgacggcgcgacgggagaccgattcgggcgagctaaagcatctacgtgactccgggaatccgttgctagcgtcggattgggcggagctacgccgagcaaggccggcgacgagcgggcgctacagagcacgggcggcgacggcggcgagcacacagcgagcggcggcaacggtcggggcggcggcagctagctacggggaggctactcgtgctactacctaagtctaaggggaggagatggaacgaggaaggagaacggagggaggcactaccgtgcggggtgatggggcgcagtgacgaggggccgacggcacgggagtgatctctccggcctcgggccggggaagaggaagaagacgagcgcccggagtccccttccgcgtcctagcgcgcaccggctcctccggcacacgcgacggtggcggtcggcgagagagatagagggacggcaatggcgcgagcgaaaaatagggaagattgggatggaaaaaggaagggagggcgcctgggtttatagggtgacaatgtcggtttggaaaccgaccttgggcggtcaaggcgcgagctggcgcttggcgctcgcggccaaaacggcgacagaggcggatgacgccggcggggaagagaaaaggaaaaaggaagggagaaagggggcttgccccttgcctattcgggaaaggaaggagggagagagggcgatgaggaggagccctgcctcctttccttggaagcacgcgcggggagaggcggggccgagttgatgacgacggcgatgacggcgggggcggtttggaaaggagcggcgacacgggcggcaggcacgggctcaggcgcggcaggcactgacggcggcggcgaccaggcggtcggccaccacggcgtgcgcgcgtgggaagcaacgggcggcgcggcgatttgggcggcgtcagcgggaagcggcagcgagggcggagggcgctcggctcggcgcggctcacgcgcacgcacgcgcagcgcacgggcagagcgggggagagagagagagagatgggggggagggagagatgggccgagaggaattcggcccatcgaacccgagggaggcaaaatagacttttgcggagggatttgatttgggaaggataattgagattagggtttggatttggattcgggacttgaacttgacgatagatcggggatttgagatccggaatggcacggagactgactgcaagcgaggaaaattttttttcgcaattaaggtttttagaaattacattttcccgctaggcgccacgacggaacgggcgctacaataagttttctacaggtgagagggtaagaatattacgtgtggagcctaggttagaatcctaaaggctgcacatgcgttgagagtgtctattgagaaattgtgtgacttgtgatgcactattccttgtaaaatacaaaatattttttctgtgcttcttttagctcttataaaattttaaaaactcatataatgcttgttgtcggtcgtccggcgttgaacggaaaatcggacgccgacgccgacagttgtagaaataattttctctctcttcattctccttcccacgcatctactatatgctttctgctatagactttatgcatgcatgtgtctctatttataagctttaaatatctttttcttcaaaacagtttatccgattgtatcattgtatttgttgtaattaaatctttacaacaagatctcacttgattgtatttagacaaaatatgtatatatatgtttcagtgtattaaaatttaatgttttgcgtgtgagaaataaatgtttcagttggaatttgactatgttgcacattttttgttcaatgttgccattgattttttttaagtgttgcacatggtgctatttgggtgatttaata

SEQ ID NO: 48222 - DNA, 13806 bp, Oryza sativa
  unsure (1)..(13806): unsure at all n locations
atttgcccagactgggaaagcagccctcgttgtatcgttgcttcccagccctggttctgagaagaacggtaatcatagcacttgaggagcaaaatttgccatcgttttaagcttagcaggctatattcaattccatgcctttctgatccattttatcagctgctagctctgagcctcgtcgtccttatgttgttgactctcttctacgttggttcatgttatactatttgtgtatataaactacagaacacgaacaacgggacagtatagcggctgatcgagaagaaaatgcagccgttccaaatcaagttccacacattccgacctcctcctgctttgatggtaacttcatgagctggtgggacacttgctgaaggaagatatggtgaaggatcaaaggaatattttcgatggaataatcatttgcacggcttgggtcatttggctgcaatgaaatgacagaattttcaactgaacctacagcacggtggaacatgttgtgaattcgatcttggaaatgtgtaaacaaatggcggcagctcagctagtcccctaaattagatggcccttagtcgtttgttgctgcttgtggccgctggctacctaaaaatcggttcctgtattgtgggggaaaaccttggttcctctgtttgtaaaaggattttccgtttgttttacttgctttcctctataaatgaatggtagagctcatgtcttttccctaaagagcatctctagcagtagcccctactttcgagtccctaaaagttaaataggggctgccctcaatgttctaggaccctaaatatgtctttatgtctagcagtagcctccatatcttagcccctattttttttctcttttattttagtatagaatttatatttatatctagtttaacacatagtaatttaaacataaataattctagcgcatggaattcaaccatattcaaatttgcaatttcaaacaccacgattcaaaattgaattcaaaattttcaaacatgaaaatgatatatcctagaagcaaatattgaacataacccacacatgatagaaaatgcaatgaaacaaactaccgagcaccatgaagcgcccacaaatgttccataagatcatctcgaagttgctcatgtacccgtcggtcttcaatttctttatgtatctttagaaatttctctaacacaggtttattacgtcgttggtattcctccttcctcaacacctcactgtcctcctgatcatagtcaaaatctacattttcatctcgctcattgtcaatgatcatgttgtgcatgattacacaagctgtcattatgtaccatagggtctctgtatcccaaaatctagcaggacccctcaccattgcaaagcgggcttgtagaacaccaaatgctctttcaacatcctttctcactccttcttgaacttttgcataatgtattctcttgttaccttgtgaattagaaatggtcttcacaaaagtggcccaagaaaggtatatgccatcagcaagatagtaacccatggtgtatttatttccattcaccataaactccaactctggagctgtccctgatgtaagcctttgaaagagtggcgatctctgtagtacattgatatcattaagagaacctggtagtccaaagaaggaatgccaaatccacaaatctttagatgcaacagcttcaagaatcatggttggcccatccacatgccctgaatattgtcctttccagcctgttgggcaattcttccacctccaatgcatacagtcaatacaacctagcatccctgggaacccccttggagtgtttatagccatcaaccttgcagtgtcctcagcagttggtgccctcaagtattgatcagcaaacacatccaccacagccttgacaaagtgcttgaaagctctatcatggtgctctctgaaatcctcacgacttcatcaagactatcggctggaatatcatatgcaagcatgcgaattgcaccatacaccttctgcaatgcagtggcaccgagaagacccactgcatttgggctctgcctgaagtagtcatcatgagcctccacactagccacgatgcgcaagaagagctcccttgacattctgaacctcctctaaataattttgcactatatataggaggatctgcaaaataatcagccactatgcgtaaattgccagcaaacctgtccctatgaattatctcacgacctgggactgaaccatgatgctttcttttggtcctcttatgctctatgtctgtaagaagagcagctgcaatgtagtagtcatcatcgtcagacaactcctcctgatcccaccaatcggtaatgagatcatcgtcgtcgtcatcgtcgtcgtagaagtccatataaaaaacactgccatcacaaaatcataaaattaataagaaaatttagagcatatgcacacatccaactacacatacacggtacagagtataccccatatacagtatgcaacattcaatctatgaaaagcagtggaatcgtactagtacagtaccacttactcctgtatatatatatatggttctaatcgatccattgcaacaattgtacagtgctactaagtataaatacagtgatatattcaccgtgtttagatccagtttttcttcaaacttccaacttttctatcacatcaaaactttcttacacatataaacttctaattttttcatcacatcgtttcaatttcaactaaacttctaattttagtgtgaactaaacacaaccattactagctgagaatttagatttttcttgccgacaaagtccactacaattctccaaaaaaatattaaaaacaagtcagtctccaccagaaccatctaccaccacatgtccacaggtgtcaagaacagagttattcagaaaattgattagtactctaccactgaacccccgcaccacatgacctacttagagtttctccagaaaaatcaatgggggcaggaggccagcgtgggggcaggcggcgtgcaggtgggcgacgtgtgtgcgggcagcctcggagggcacgcgacggccggcgtgtggccaggcagatggcgggagatcggcggccgggcatgtgcatggactgccgccgaaggcctcgagaacggcgggcaagaaaggtatggaaaagtcttacctttctagggcagtcttgatggaggtgctgggaattcgtcggtgctcgccggagaagatccgtcgtcgcagccgtgcgggaataacaagaaaatgcacgaagcaaaattatatccgcgccaaaaaaaaatgacgatgggggcgtgctccggagtccccaggactggggccttgggggaggatttgagggcctcctcactttgggggctgtagtagggcccctgctggatctagtttttttatcttaactctcaaaaattgaataggggctggatttgaagtccctgctggagatgctctaaaaaaaagaaaatgggccgttatatggtgtaacagttcgtcaaattcattattcatttggttcatttgcagctctgattttttttccccatttgcttgtgtgcattatcaccgggaactatcttaaacatatttcacgagggtgtatatatctatatatatatattatcttgaaacgatgtggtatacatattttattgaaaaaatagcagtgtagttgacctcagccaagaaacaacatgatgagaatttattttcacatagtatagctgcactctggggaatacaatagggcagaacaattcgtccattataatgaagagttgccgagccagaatgggcctctcggcatccctgtcagggtgtgtcctatccatagtcgaaaaaaccgaaccggatcatcgatcaaacctaaaagattggaagttgtataaccattgggtcagttgtgaaaacataaaaacaaatactccccctgttcatagttgatcattatattagtattcattctcttcgtctgttggttatttcctaattttagatgcttcccatactccaatacgaggatgaagcctaaatatgattgggagtatgtcccagtgtgtactcattcctgtggtttttatttcaacattcgtgctttttttaattggagccaaaaattgcatccaaatgtgattattctacggtgtctcggtaacgattctgattatttggctcgaagcgtcagctccgttcatcgagacatgctcagcgtcctcgtctttttcttatgcttacgcttatcagtcaaaatttaaattttcaactttaaatttaaagttgattttagagttttgtcatcgtagtttatttttcagtctttgtttttagatcgtttagaacacatacataaaagttttattcacaaattattttttatttgcaaatatgccgtttgacctattccaccaaacaaccaaacaatggggctgtcgaactcttcttattattcttttttttcttttcactcgtgctctcccatcaatgccggtttgagagttgacacagatgagtctcccagaagagtagtgatgcaacaaatctagcaccgattagagcagtggaaccagctatggatgagccttctgtgatggtgatcaaagagataaccgggcagagcaggcgtgagaacttcccttgccacttgctctgcctaaaggtctaatgtctgcacgaacaccacgccacaatgttggaagggcgcggtgggcgtgcagtacgtgagtggggaagccacaagctatttggcaggaagagggggtcgcacacgttgcgctgccttcggccaccacattagtccagaaatgcaacgcccagcagcgaagggtccgatgaagggatgttgaataattcccaatgccttccatgcatatataggatcctagctaggagcgacagagactcgatctgatgagagtcgtcggaccgtcaattttaatttgcctccaaaactgagctacatatacgtgcacatctgctggcccttttaagttaactcagctatctaagtggcccgcggcagtcgagtgctatgtatatagatggcacatcctctcagagtctttttaagtagctcagcttgaaatttatggatggatggtttttcacaccatctccatatatatccttcaccccaacctgcaggacaatggtcattatcacaattacaaaacaccttataggtgctggttctagatgaaaagcacattggtgctggtcgcatatagaatcaacaccatgatcctcaccacaatggctctccgcccaccataggtactagtatattattaaaaaatagcaccttttggtcacattgaatgcgctcataatatatggcccatcttttagaagactaatggacttgtacttctatctcttggtgctgcacagtactaaattgcttgttatattacagtaaccagaacaaccatggcataactgagctttcgatgcctcttagacctaacatacatgctgcatggtcaggggtggatctacagtgtaatgcatgctttcgacaccaacgacttttgtcaaaatctatagcgaaactgtttatccatatattataccatcacgatctaagtataattagcatactatgacaccaacagacacgttatgacaccaacgaatcgatttttttttggatccgccactatgcatggttgccacttgcccatactatttcaacaaggatattaccttagctctgttcagcaagctattccattctacatgctttgatgatctattttaagctgttacccttgagctactcccattgtcctttaatttgttcgtgactcagttcgtcttgctctttataaatagagagcacaaatattggaagtgtccatctggttagaataaatggagccttttgaggtggaatggtttgtcaaatttatttggtatattgcctctcagtttttcttcttccttttagtcacgtgcatcgccaccggaaactatctaaaaccaagttttcacgagttcctatgtgaactatattgcaacaagaattaaatttgaaaatatattgttcattcaatttttttaagaaatattcgggatgtaaaatcttttgcacaaatataaaagtcaaattagtacacgcaaatttatttgttaattaaactctaactactacacacatattcacagtcaaatttgttatttttgttacaacttgtagaagtcgaatttgaacttgcatgtttgtgagatgatatattacatattaacctatcttataaatttttttgtaactttttcataatcatttaggtggcatacaagaaacgggtggacgtccacccgagagattagaattcatccccctcataaacacgcaagactgcatggagcaagtctgtaagctcgggggttcccgaaagggaaaaccgtatgtaaatttgctcgtgttatatgaagtaatttcttttgtgcatcccagtttatttgtctggctgagagtttatgcaagggaccctgtaggagatagctcttcggtacttctcatcgttagccttcatcttgcttaggcattaggagaacgtgtagccgtagagaagtgttctcttcgggtgaaactgtctggggagacgataagctcttagctagaacgaatattctagggatatgagaagaagtttattttacaacgcgaataagttatacaaggatgagcgagggctgaatggctttctcaagttattaccagttttccgttgtacgatcgtttctacatcactgctaaacccagatttccgatacctcctctgttcctatatgtttacatggatatatgggatatatggatgagttcgttgatacattgaagagggacaaactttgttctttgcttgctctctacagtttacatgtacagccacacaacttagttctctacctcgtgctatcccttctgtctctctagttaccgttacatggctatagcctatatggcctagcactatgtacggagtatatgtttatgtgcaattacacaaaacagatataaaataacttaactgcaatgtttatgcagatagaaccatcaaagaaatctatctattaatatattattaaaacagctttaaaaggaggaaccacattcactgtgggagctagaaattcccacattaattggagcaaaaggaaagaagagtcaagtagaaatacaatttaaaaataattgaaattcagaattaaaaatatgcactattgaaagaagattccatgtacgagaccaatatgacattaattaatattcggaataaaaaaataaaataaaatatgaaattagaaaaaattaaaaagatagttcaagtaggaataccatttcgaaacagctgaaattgaaaataaaatataaaaatactaaaaaaacataatacagtattaattaaaattcaaaataaaaataaaataaattctaaaattaaaaaaatattcaactaggaatataatttataaataactaaaattggtgataaaacataaagactattgaaagaaaagaccatctaaaattcatgacgagagtaattaagtaacatacttataaagaattaaagtgttggaggttggtgggacatctaaaaaatattaataaaacaccaaatagaatcctaatgacgattaaaagagggacgacaggcaggccgtcaagtaaccagtcaacgctgtcggcggaacttctagaaagtaataaaaaaccccaatgataatcatattcaatttttaaaatcccaatgactaaaaagaagagacagcgggtgggtcatacaggagtacagtgacacagccgtcgacagttggcgggacttctagaaagtaaaaaataaattccaactatagttatgtttgatttttggaatcccaatgaaaataaaaagttggcggcggacactgcgtagaggagtatagtggcatcgtttgacgagacttctaaaattataaaaactgaaacccaacaagacaataacctctaaaaactataaggtccaatttttaaaggttcagaacttctaaaagtaaaaaaaataaaccacaatgataataatattcgatttcaaaatcttaatgacaataagaaggaaggcagcgggtgaaccgtaaaggagtacagtggcaaagccactgacagtttggggggacttataaaaagtaaaaaatgaacccaaacaataattatattcgacttttaaaatcgcaatgacaaaaagagaaaagacagtggacggaccatggaggagtataatggcagcgcttaatgggacttctagaaatataaaaacaaaaccgaatgagacaataaactctaaaaactatactatccaatttataaagattccaaggagaattaataaaatcaatggtagatcaagcaaacaaataaaaaaagagatgacaaaagtaagtggtagcaactggtgtgatttttataaaactataaaattagaaacacagggatgataaggtttggtctttcaaagtcttaaaaaaacaagatagctatttaataaattttcaagtaaaatcataccggacaattgcaccggccacccagatagtaacatttggttagaaggatctactgaatactactactagccgcactaaagcacatcaaaatagcactctcgagtatattggtttaatatgtttggacaacagagtaatactactactactccagttgctaaaacaagcagagcccatgaagtggcccgtgccacattttaatgcgcgaagcgaggatgcatcaaagtgcttccacagctggtctctggtatgtcccaaacacctctcatgcctaaggggcgcaactctgcaatagtagagcagctagagttgttttagagccagcagcagcgaatgcacaagttgcctagcttgtggcctatccctcgatcgatcgatcgatgcccgttccatggatccgacgcggctgaattgatctctgatagtgacactgtccagcgaattggatgtcctatataatgccccgtttagttctccaaaagttttttctaaaaacatcacatcgaatcttccaagatatgtatgtagcattaaatatagattaaaagaaaaattaattgcacagttagggaggaaatcgtgagacgactcttttgtgcctgactagtctatgattagccataagtgctaatgacggattaataatgctcaaaagattcgtctcgcggtttccaggcgagttatgaaattagtttttttattcgtgtccaaaaaccctttccaaaatccggttaagcctcacgtggacagcataggagggttggaggcagctggagttatctataagtagtctggccatgtactccttccgtcccgtattaccaaacataagcttccatttattaaaaaaaagcaatgttatggtgctctctacgatagtattatactatcccgttcattgttaaggataagacactatcccgtttattgttaaggataagacagtaattcataatacagtgatcagaggtaactttatcatttatgttttttcccagctagatcgtcatgtaggtcatccattgcaatggcattactcatattccatcgaaaaaacaaataagaaggaaaaaagtttagtcgcagataaataatgattgtacccctcctcatcttttttatttacaataatacatctccatatttctattaccttaaactagacgataatataaatagatctgaactattcgattaaataagaataatggctcacattattctctactatcaatagagaacaccgtagtggggctcttatgataaacataagcattaagcagtaaccaaaacaaccatggcacaacagagtttccgatgcctcttagaccttatatctgctccgcaagcaattccattctacatgcttatgcgatctattttaagctgttaactttaagctactcccgttgtccttttgtcatgactcagttcggcttgctctttataaatagagagcacaaatattgggagcgtacttcgggttagactaaattaattgagccttttgtggtggaattaatggtttgtcaaatttatttgttatattgtttctttgttttccttctccattttatttgcgtgcattatcaccgggaactatcaaagaccaaattttcacgactacctatatgtactactacctccatcctaaaatgtttgacgccgttgacttttttaaaaatgtttgaccgttcgtcttattcaaaaaatttaagtaattattaattttttttctattatttgatttattgttaaatatacttttatatatacatatagttttacacatatcacaaaagtttttgaataaaaggaacggtcaaacatatttaaaaaagtcaacggtgtcaaatatttagggaaggatggagtatattgcaatagtctacgacgtaacgagctgatttttttttttgcgtcttatccaaatttcgttgaagcttaaactagcttagcagtgtaagtgattaatctcggccttggcacaacaccatgggaaaacaactactccctccgtcccaaaaaataataacttttagcacttagaatttatcccaaaatataataacttcttcaccaatattctcttcccaaccaattacaacccttcaccatttacttttcccacctatctccacttcccaaccaatcacaacctctccctatttaattctatatattttttattaaatgtgtccaactctaagacttctcaacagtgatgttcctaaaaaaacatttattaattaggacagatcaaatcgtatgtccatcccaactggacacaacaaagggaagaagggcaaggacagaacgggcctctcgtcggcatcgatcgcggtagggctgtcaatgagccgagcccgagctagctcgcttgcataggatcgagctcatacaagctcgagttcaagcctataaaacgtccgagcttttatacaggctatgtcgagctcgatcaagatcaagctcgactattgaacttaatatttatgtaaaacaatgtatatttcaagaataatcttttaaaaataattaatttctagttcatcatattaataaaagagaaaaaataataaaataaatatatgatgacaatacaagatatacaaataaaatatttgatctccaagtttattaaataacaacaaaattcttatattagactcattggaagctcaagctcctcgacaatgctcatgaactttggagaggctcttgctcgactcgtctggagctcgagccaagctcgaatcgagcctaagacaagtcgagcttgagcagctcgtgagcctcgagcttttttttttttgacaacctcgaggctcgcgtgctcttcatatagcgaaaatgttgcaagaaaatatcaggtcggctccggcagcgtgcgacgcgcgtgcagtgcgcgagctgcgaagccacaatctatcaaagctacaagtgggataagcggcaattgtagacgctgagcnnttcctccanngtcgccccgttanngtcaagcagtgcagaaacgagtgaggggggatgtttagttccatggccactgaataattcccgatgcctcccatatctagctaagctgagagcttcgcttggagagtcgatcctcacgtcaaatttaactaatttgcctcaccaaattgagagagataagctatcgatgcgttctgtacacaagtgtacatgtacattgaccttggttatttaactccagctctcgatgtgtgtcacgcatctttgaagtggagtactatccttctataaaatgatgactgcgtctaactgtcttagtctatgggatgaatagcactcacatgaagagagatgaccacggaaacagttcccttatctccctacttgattacatgagatctaccccctctgtctcacaaaaaaacccatccctaaattcccaatgcaagtttagtactaacatgaaatgacctaaatgcccttcttcaagtacaacttcttgttagtcattagcacttatctaggaaaaacaaggaaatgtaaaaatccctccatcgtcatttgcatatgagtcgccgccttgcaagcctccaaggctccaacgacgatactgcatgcctctacgccaccgctggcctgcacgtctccatccgtcggccccgccacagacttcggatccgccacctcacaaacctctatgcacgacgccacggaaggtcctagtcatggagagagggagggagcttccaagccacatccatctactggagctgcgtcctgcaacggatgatggggatctagggatgaggctcgggttgaagttgctcttagtcaagcagagcaacgccaagctgtagcgaagggtccaatctaaggctgttgaataattcctgatgcatcccatgcctagaagcataggatgaattgtccaacatgttaagaagatggaatcttccagttggcacacaatggtgcacacacacaatcattcgacggccatgtacttctcaaattcttttttcacatattgagctatgcaccttgtttctctacctcctactattatgttactttggttgtcttctatagcctatcactacatattaatgtgcattattggtgtctggggtgccatctttcgacaactataataactcaacaactatcttcatgtagccaaagaaaatattcagtccaaccaacaagctatgagggtatattccctggtcacgagtacttgactttttggcaatgttctaaatcttcagctaagcctcttagtggttgagctctccaaaaactaagaccagctatagctatagctaagaaatttagcggtttttgaaaatataagaaaaaaaattaaaaaaaatgatagaatttgagctaaaaattgacagatagagttcatcaccaattcgtagttcatacttcatatatggaattcatagtttctaattcatacttttagcagctaagtgcagctatctttggctattttggtgatgctatctctaactaagtgtagctattagctgccgacaaatcttagcgtcaaaattgaagtatcctagttgttcccctccctatccgctatctatagcttgccgctatagctggagatttattagaacattgctttttggataaaatcaggttaaactttaaccttcaaatactacaattttctcaaaaaaatatattttaaaaatatttagttcaaaacgtaaaaatagtgtgagtagatttttcatggaatgcacattgatagtctcactatatctctgactagatttataaactaaaattgtagtctaaggtagaacctcaaataccgtaaaaagaaccaaaggtcaattaatatttgtcgtcggaggggctaccacattatcatgaatagattaaaccatgttaaaatagaggattgtggaaaggtctaatatttttcgtagaaacaaaaaaaataaaagagcatgacatgcattagaacgaccagaaaaagatctccatgcatcctctcaattgaattgcagtaaccagaacattgcacattcaaatgctgcaactcacactaagaaaactagatttatttatggttggggttccaccaaaatgcgaccgattgaggtctctgtttgtggtagggcggctagagaatacgacgcacggtcgcaggaccgattacgctcacattgctcgctaaaaccaaccatgagaaaatgcagctgaaatggggccgggggtgtgcgcagcgctaggaagg

SEQ ID NO: 48223 - DNA, 14478 bp, Oryza sativa
gaacatgtgcttactttcgagaaaatacggacgcatttttgcaaaatcaccaactctttctactttttcctttcgtttttttccttcccccaccccacctccacacaaccaccgcccttgccatgtgtggcggtggtcggtcggcggggtaccgcgagcggtggttgcgcgcccgtgtggcggggcgcggccaaccggcggagtagctcggccggtcagcggtgctaggcacgggcaagcaacagtctcgacacggcgtggaggcgcggccaacgcctttggtactcgttcagtcattacaagacggtcctgcagccacacatcaagtggtcggcatgcgctgtgggtatggcagcgccatgaatggtcggcataagtggctccgctagctggtgttgttcgccactttttcccttttcttcttcattcttcttcgtctatatttctgtttccctcttcatgtccggccagcaccttcacgacagtacattacatgtgtcttggtgtggcggcgtggcttcagtgggcatggacgctgaggcttgcacatcgacgcctgggttgtggcacggtgtgacctcactgtcgtgcggtcccggcgcaatatggtgtccgtgggcgttgtgacatgcacagcccgcaagctgtttcacgaattcccaatcagctttcaccgacgactccaagtcagacggtagtggatttctttgggaatagcgaaaacggaacggggaataggggagaagttcgttttcgtgattagatcagcaagatgcaaaaggaatctatgaatttttactagttttcttcgtcgatattcggtagaacatcgtgtgaccctgtattatatgcctagtcaaaacaagttgcataatttctaggaatgtaagagacataaagatataagcttgtggtatgctttctcattcatcaattgcatgtacaaaactttcgtctaactctctatttaattatagccaaagtcatggatgcttcaataatttagtgatggacacattttgtcatgtaaccaggcacacctatgtttttaaacagtctcctggaaacaacaaaaaaaaacgaactcattatgctaacaagaggagttccatttattacattgaaatgtattaaccctcgaccataaaacaacatatatatggtcaagaaaaatttacagcaggtgggtactactccaatttgcaaggaatagctaggtagataggacaggactgaccgacggctcatcatcatcgtgagaatgagagctgggcttagcataacaccatactggggcagaacgattagccggagcgcgtcgtcgcggtgccgagggatgctgcaggcatggatcaattaaattttaaaatatacattattttcttcgattttgcacatatatacctgcttttgtaatttttttaaaaatatacctttcccgcagattggaaatacggcaccgtacagttgaccgatgggaggggcggtggcgcgacgccaaaacgcgcgatcgcgtcgatcccgcgtgacaatagcgcgcgacggcgtccattcccagcaccaggagcagttgcgcagaagaatagaccgacgcgctcccgcggaatggtcgcgcggagccgcgccaccaccgccaaatcccgcaacaaacaaaggatatactcataaaactttgattgtattaacaggtagctagctttagcattcactattctgacatgcatgcatgacttcttggcactagcagctcgaattgaacaaaggcagtgaaacgactatattatgtcagcaccggtgccgcacaaccaatctacgggaccgacggatgcggtcgcgcgtcttggcgtcgcgccactgcccgataccgcattcccaatccgcggaaacatatatttttgtaaaattttcaaaagcatgtatatatgtgcaaattctaggaaaatactgtatattttaaaatttaattctggaatggagtagccgtggcaaccgcgcattcggcgtcacacgcgcaggcgcccggttagtaagcagagcgatgccgagctgccaagtgttggatccgacgcagccaagtaatttccgactcctccatcccatgcctagaagactactagcgagagatcgagatcgaactcgtctcgtccggccgctagctgcacttcgaataccattaggacagatgaaagtttagtcgcggttgttataaccggtactaaatgggataatcacttctccaatagtacaaactgaacttcgagcaatacattaggacatatgaaatcgtacgaccatcccgacatggctggacaaagagaaggccaggccagaacgggcctcgcagccagcatcctccccgtgctcttcatagcgaaaatattgctcgtatgttcatgggcggttgcacaagaagcgcagaaacaagcgagggcgaagctttagttccatggcggctaaataattccccatgcctcccatatctaagctaggatcttaattagtttcaacaaatcaatagagtcgctacggatgcgtgtacgtgtatacatgctaacatccacactgacccggccagctctttagttcgctccagctctcgatgtgtgtcacgcagctttagaagtggagcattgtcttttataaatagatgaactatgggatgaaaatacaatcggaaaggccatcatttatactccctctgtcatgagacatgcatgagacgtcaagtctgtataaggctaaataaacaatcaaggtactacggcgacttaacagcacaagtacagagagaatatgtacgtactacaactactgtctttgattacttgctgcatgccaacaaatatatttagaaaacgatcggcaaataaacgataaaaaatgatacaccaatcacagaagacacaagatttaacgtgaaaacccctcttaaattaggagagaaaaaccataggcgccagctagcaaatatcttcactatatatcggatgaggttagaacgccgaacggcagcttacattccagaagtatatataaaggtgaaaccctaaaacggccgctttgctccagcccaagtctccggcgacgggcctccgcttcgctccgtccgaagttagcctttatacgtgtgcaaatgaatttggattaaaactcaacaaactccaccttgagacaaattccttcttgtagcataaatcaaaccttcaccctcaacacaacaaagaaaaacactttcgacgccaaataatctattgggttaaaccattataccaactaagcttgagaaaagctcaaacttagcaatatgaactgactttgtcatcatatcagcaagattatcatgaatacttatcttgcagacatttatcttaccttgtgcgactacatcgcgaacataatggtacttgatatcaatgtgcttatcctctcatggaacatctgatctttagtgaggtatatggcactttgaccgtcacaaaacaggttaatgcaagaatcaactccatgaagctcaggaaacaatccgttcagccaaactgattccttacatgcttcagtaatagccttgtattctatttcagtggtagactgggcaacaacaggcttcaatgttgccttccaactcatggctcaactaccaatagtaaacgcataacctataagtgatcttcgcttgtccaaatcagcagcaaaatctgaatccatatagccaataagtcccttatcagtcctgccaaacttcaagcaagcatttgctgtgtctcgaagatacctgaaactccactaaatagccttccattgttttttaccaggattagtcatgtatctaccaaccaaactcatagcataagataaatccggacaagagcaaaccatggcatacataaaaaaatcaacagcactagaatatggaatccttgacatgtattctacctccttatcaatactagcacattgtaaagctgataatttaaaataaggtgcaataggagtacaaacagtgtttgcatcatgcatgttgaaacgttgaagaaccttcttaatgtaactttgccggctaagaaataacaaaccagaatttcggtctctagtaatttccatacctaaaattttcttagtagcaccaagatccttcatatcaaactcactactcaacagtttcttcaatgtagtgatttcttctttgctcttggcagcaatcaacatatcatcaatatataacagtaagtatatatatgcgtgatccattaacaaatttaatatacacacagctatcatattcagacctcttcagctatgtgacggcccaagccaccggcgacgggcctccacttcgctccgtccgaagttgacctttatacatatgtaaatgaatttggatcacaactcaacccatcttgcttaggctccaacaaaaacttaaggctccaacagacctgtccagattcgttgtaataggatatgtcacatccgcctaaaatcctttatatcatgggacgggggagtagcaccaaatttagtcaagtagtgaaagttactaatatatgagttttccaacttgtcaaaatttattttatttatcaatgacatcactgtatgtgttgggtacatccaagttggatgtagaggtcaggcttttaatcattttttttaaaaaaaagctgaaaatatgtatccttagttgcaaaaggtctcttgatggtaatgagccgagttctatttattacgttccagtttattcaagcgtaaggctaagcatgagctagctcatccgtatggtcaagaaaaaaaaaatattcacagcagctgcactctgttgcaaggaatagatgcaacagagggactgacctactcatccaccatcagaactgggtcagcaaacaccaagatcaccggtaccgccaccagggccagaacaaagtgctgcaacacgtacgtcgtcgatcgcgcgtggcgtgcagggaagaagccgcacgcacgcaatggtgtggttgtggcaactcgcacatgccgcgttagacgcaagcgccgggtttggtcgaggaggagatcgccaagctgcgagggaaggatcagaggccaccgagtaatttccaatgcctccatgcctacaatcctagctagaggggatcggatcggagagctcgatcgttgtcacgtcgatttcttgggtcaaaaacgtgagccgtgcacaccggtccatataagtagccgtgtgtacatgtgagtgtggtaatagtgggattaagttcttttcagctaatttactactccttgcatgtcttcttctatcccaaaattctgaataatctagacaattaaaattggtgcgctccacctctttaaatttggctaccatttaaattagcgcgcgagtcctcttagaaagtagtgctaatgacttttagtaaccacatttcaactttcaaagaccacgtttgatgtcggtaattcgattttcaccactaaactctaatatcggttactttacaccctaaactttttacaccaggagttttccataccgtggaagaagttcaggtgtaaagtaaccggtatttacaaaatatgtgcggcagctatttcaccagatcagtccgatctacaaatgaagaaaacaattatttataaaatatccttggtcccacacgtcatcctctggtaattaccatcttcatctcgcacctctcggtgccatcccaaatcaccttcatcctcagcttgtggatgcagaggcctttggtcaggacggcgcgctacagtgcgctctgcagcggccgacaagttcaccatcggcaagttcgtcgaggcctccctctcagccaatgacctcgccctatccatgaagaagtgatcgatcgccctccccgatgcttccagttcctagatgtgttacatccacgggtgagtttggggagatatgattagagaacaatgcttctgctttgtctaattatttgagcaacaagcagatagctttgtattaccctttgttactgttactagttatacgtagttacctgttgcaattcattacatagtaacatagctacataattcagcccttctatatatattttgctagcctatctttttctactaccttttatgacaagctagagcgctacataatgtatggtgtcttgtgtgccataatacaacaacaactatttattaatggttacggctaacttgaaggaaaacatgaatgaagtaagcaacaaaacattgcgaaggctagaataacttacattattaaaaaaaagagcaacaacatataatttaaacataaaacatatgcttttacttatagcggtccaaaagccaagtctaagaaatagaagaaaaacaaaaaggtccctaaattaaatataaaattaaatggtgaaattaaaaattatgtcgcggttcacagaccatataactcaatgcttggctatgttgcaagaagaaacaccaaactttcgttaaaagggaaagagaagaccaaatgagcatgaaaataaacgatgttacaaattaaatattaaaatattaaaataaattcccccccggctcaacgtgacaatacaagaaacgaggagcttcatgggcttttatagttctgataatacctgctttcacctttttggaaaatacaaacaaaaccaaacaatacttagttctatcgataatatccatctcatgaattcctggcaggcttccttcacggctggttggggacgaattagctatcctagtgttaaactcactacgtatatacgtacttggctcggccctgcatgccgattgacctctacgcggatcaatcaataatcaggggcgagggtgaatccaccggggaacatgaagctgctgctgctcccggatgcagagggcggcaagcagaacactgcaggtttgtccatagagatatcttgcgctgcttctggatgactttgcgtttgcaaggaaggccagcgtggacgcaatcgtgtcctcagtgcctcccatgcctgtttgcctaagctagagctctggacacgtcttgatcattgcaaagcttttgtttctaatgctgttctttaccactgccacctccatttaaatttgggtaccatttacatatactcctacgtggtatgaaatatcagccaaaactacactctttaaattggacccttttttcgtacgagtgaggatatctgcaattattggaaccatcaaaataataataagaggccttttacagtccttgaggggaggaggtaccaaatcttggtcgtccattccattctatgtaacggcttggaaaggctcggtacctggcgctatggcatctagcaggtaccaaatgttgttgatggtaggagagcaaatttgtactttcgcatgcaggtgggagtggagcgccatctatcctcaaatcgagcgagaaccgtagaggtaattcacacgggcacacaacaacaagcttgacttggccgatacaacgtttacctcgagcttgagggaggtgatttgatggtggacgccggtgtcgttcctcccatggcgttgttcctcctccccagtccgctcccgtcgccaatccccacccccacccccacgctgctctagtttgttttcttatcctcccaccaacactacctcctctccgctagctctctctcgtcctctcaggctgtctctccttccgctgtcactgacactctcgcaaaacggcaacctctgctttagcacttctcccctcatcgataatacaccgctgcagccgcggttcagaccgagctgggacctaccacccccttttatgctctggacacctccaaagtcatgcgttgccatgtcagctgtcctggttgtgcaataaagaggagggggacgccacccagcatccatcagttatgaagccgaggccagcagcaactgcgaattcagtgccctctctgcttggggtcaactcctagtcttggtggcaccaagaaccatgcgaaccagaggtgcatgagctatattgtctggaaatttagtgctttcatgtacctaaagaagttgatccacaatgatagagccgagtatttgaaaattctagttgagataacattggattaatgaccaggaatatgtttttctggttattagcttgatccgaactgttagatagtctatcaccattgaagacgtacaggagtacaggacatggtgctcaaacagcaaaaatgcccaatcctcatcatcacaatggaaggaatccaccattctccttcccgaattcaggcgagcccttctttccattttttacttgctctttcttttgttcatccttttccattccactagctgaatcattggcgagctccgtctgtccatgtttgctgcctctcctcttcaccagcaaaccaccccctcagaggtgtcggtggcacatgaactcacctcacgagcgtcgcctgccctcccactattcccatcctgatgaggccccaaaactggatcctggattgtagcctcctctataaccattggcggtgtgcttcaggtctcaacagtgtgtcgcggagctatagagtgggacggaattgtttgggactacaagatgtggaaggagaagaagatgtagaagagacgatgccaggtgtaggactagatgattatcacaagctattccgatcataccctttgtgaatggacggacagatggagtttttacctcctagtacctggtggtaccttctcaggtatggtaaaattcttaaaataaaattgtacttgagaaaagggtcatttagctaccagatcatcgtaaaagttgtcgctcaaattaatttcccttaattcgttttatttgtttttctccttttagtttctcgctttttttttactccattgtgtgtaagccttaacagagaaacattgcaacaatacagtcaggatacaaccaaagatagaacaaccatcgatcagatcagtccaattgtcccaacgcatggccagaccatccagcatctcttgagagacccgtacgtactcatccagaatcgacgacgtggaagaactagacgaaccgtcagcacgcagcaagcagtgctctgcgtgttgtaccagagcaggtatgccgtgtggcaccaacaaggaagtagtggacaacgcacacgctacaccgtatctgtggatgcaccgtgctccaggcagggcaatgccaaagctgcatagaatcccatcggaggcaactgaattcccgacgtttaccatgcccatcaatctaggaaattaagtcactcatgcccatgatttctgtgccccaaaaacaccaaccattgtggctgcggctgtttgttagagccaggacaatagtagagctcacttcctaatattagcctattttaaagccaacatatatagtggattagctataaggttggctataattttctcctcatctctctatctctcacctatacatttaatgtatttacttaggagtttatgttaagctagcttttgcatgagagccagcattcttgatttttttgttatctctctcctccacgtaagcttatagtaagcttataactcactattatacttgctcttactagtacgattaacctagctagctccacagttaatggagcgtcggcatcggcggtgacggtgccggcgttggggttcagctagctaagcaccagccattttaaacactacagcaagtaattaaattaattttcttttgcaagacaatacgacttttttttaagtagatgcaattggtgtattggttttactatgtaataaatagagttccaacaatctgaagtaggacaaatgacccacggtcttaattagttcattatatgaacgcaagattaaaaattgttctcatgctttaaaacaagtagtacaaacgaatttaaaatcatagtatagtaatagatttactggagatgccgattctaatgtaatagattaattaggggtcggaaaacaacagggtgcatagcctttgttgtgagtcatgaccgtctatatcatagtattgtagataatatacttcgtgttagaaatactatttaatttttagtgttagcttttccatccaaaataaaatgtttctaacactctgaattaataatacgaagaaatttagtactttagtaacttaattttaaaaaagcaattcacaaatatcatgtagtatttgatatgctcttctttcaatcattgtaattttaaaatactataattcaaataatgtcctatgaatttaatatatgaccaaaattatcacatttataatagatatatgatagtaacccgtgcaacgcacgggttgacgactagtatacaaagcctgttatggaagattactaaatacttatcctaattgaactacaacaagattaactctatctctactattataaaaattgaagatgtttttaccgagattttgatacgtcatccgtgtttgagttggttttataaagatatagatttattgatggtattacgaaacactctatttgtatttatatttaactcgaacagatgaagctagctgcaaggtttcttcacgtttgtcacgagaacgtgcatgcatacaagtctgattgtgttcccgtctgggagagaaaaagaaagatgtactgctgatggaaaccgagtcagtctcagtgtcaacacatatgcacgcataattcactctagattgcaattacagaacactttgacgaaagccgagtcagtcttggtgtcaacacatatacatgcatacttacatattgcgaggagtaatttttcagttgctgccaaaaagttctctctatttaaataaaaaaaatatttgagcgtgttatttattttagatcgcaattaaaaaaacttctttgtgctaaaatataacaaacttttggatttcaaattttgttccaaatattgctaaaaaccaacatgttcactctagagactaggaattattataccacattaatcaaaaaaaagaagaaaaaaatatgcaccattagtagcactcttcccattttaatttatctatgtcaaacataaaaattgaagatgtttctgctgatattttggtatgtcatctatatttaagtcggttttcaggttcgtttgttttcagaaatacataaggattgatataagaaatccctttaaaaactcgcatgttaacttaggagaagagtcagactcctaattgcttcaaaactcttgccaaatcataagaaagcaacgtacaagatatgaccatcatcccaataaaagtttcaaactagatatcaatactatcaaaatgtataacgccgttgtcttttccaacaacgtttgaccattcgtcttatttaaaatattaatataaatatgtaaaagtatatgttaatattatattttatttgacgataacaagtcacaacaaaataaatgatatttatactaattttttaataagatgaatggttaaacgttgtgcgaaaagccaatggcgtcataattttgaaatggaggatgtactttttagaaaaatcttaacaataatatgattaaaatagcattcacccgtcgcaacacacaggcattttttctagtcaagatataaatgacaaacttttctttttctaagcaaactaaaactgcgtataacaagtaggacactcaacttacttaaactacatgacacaaacctcggccccatatgtatctatatacaatcttgccagcataaacaaatgtgccacggactccttaatcaaatacttattccaactaaactatagctagcttaactcttccaagaatgtgtccgctgtccacatactacatgccgcagaattacgccatgtgttctgtttgctcgcgttgccgtgataggcgctagaattagcgtccgacagacgaaccatgactgctttgcagtgctcaggacgacctaccagattgaacctccatgagcaatcatggtgagtgaaggtttcaagacaagcacgcagtcagggcacccgttgccaacgtgacgacacaatgccaccaccaaacgctccggcctccgagacatgatcccacgttgacgcagttgggtccctgaaacctcccatgcccagccttaccagagagtccatgttgctttgttgcacatctctggttggcagagactattcctttcctaatatttactatccattttaaccagctaggtaagttagctctgagctgttcttgtgcgggtgactctcctctctcttttctgtggttcgtgttactctagtgcacagtggagtggtttttcggtggtctctactggtataacaataccaatcttatttattatatcggtaagaaatgatgtaactaatatttatttgcaaggtttactactaacagaaaaaagttgttttgtttatcaatagtgttaaggtggcagcgtagatacaaatggcccattcataacaaaagatgtaaaagtatacaatgcttgtaccttccatacagactacggtataatgttaccatgccaaagttcattgtgctttgcttctctattttttccctttcagaaactgccaccagttaggcaccgtttgaataatattttgagatggagtggtttgacaaattcatttggccctactgcatctttttcctagtccctgcatcacctggcgatggtctacgtgtattattatattgaaatgatctaatcgtttagattcaatcttttcaaccaggacacatcagattggcaccgcaaaagataccaagcctgggcctctcgacggcatccatgatggtgtgctcttcgtagcaacagggaatgatcaagtatggagggtgttgcaatgtcgatcgcacatcccacactagtagagcggagcaaacagctagcgatcgaccaacggagaggtggctgaccttatagtctacaaggtggctgagtaattctagatgcctctcgtgcctaggaatctcgtggaggttcattacttggtcgatttaatttgcctcaagaaattaagagagacgggccgctagagctgcacgctatatgtacatatgtgcactccacctttatagttgacttagccatctatctgtcacacatcatgcaaatatgaacgatgtactattatatagatggcacgccatttcgaccagccttagatggggtagtttagcttgaaaggttgctatcatctcacatgtgaatatgtgaatagttgaatagtatctctatgtcttctgccggtaaagacatacatcggtactatattttactgagtcccacacatgtgagagtgttaatttacttatctataaactgccatcgtttgtcctccagctaataagtcgttgtaaaaaaataaattttagaacttaattgtttaagatgattttgagacttctatcgtaatttacttttttttattgatcttttacacatatatacatacatatgtattgtgagtataactgaaaaatacttggagccttaattagaaacaaagcaaacaactgactcatagagccattgttagaactgtttagcacgatgtttaacccgtatctccacgacaaaccaaccttctacgctgagatgttgcagccattaattaattcatcacctgacgacctgtagatgtttcacccaaatttccctcagttcaacgggacaatttgtacttcaaacacctgaccgatcgacaggccagggccaaccagcaggctgcaggggcgttgttgctcgtgagtgagtgaggaagccgcaggcatatgcaaaccgcacatgccgcactggtggcaagcaggggaacgcttggattcgaggcaaccttgggtcttaacagagatcgaatagctgaaaaatcgattaattgtgagtgacaaaagaattgttgggatttcaccagaatcgaataacacaagtgaaaactagaacgaaaaacaatacataacttttctggcgagacacaactatcaccgttttctttttcgcaactcatgtaccacaattacatatacataaatgtataggtttgctaagcaaactcaaactaagtataacaagtactccctccgtccaaaaaaacctaatctaatttaggatgggacataatctaatctagtacgacaaatatagataaccatctgttcagacttattttactaaattatgtcacatcctcaaataggttgagttttttgggatagaagaagtaggattcaacttactaaaactacatgactcaatccttggcccatacatatctgtatacaatctggccagcataaataaatgtataccacaaacaccttaatcaaatagctgtcctaattaaactacaactagcttaacactaccaactaatgtgtccgctgtccatatacgcaccgcagaattgcgtcatgtattctatttggccgcgttgcggtgatatggcgctggaattagcgtctggcaaaggaacctcgactactttgcggtgc

SEQ ID NO: 48224 - DNA, 9096 bp, Oryza sativa
acaattctaaccttatttattatcatcaagaaagtgatgtaagctagtatttatttatcagttttactactaacggaaaaaattgttttatttatcaatagttaaggtggcagcgtaaatacatggcaaattcaataagaaaatattgaagtctacagtgcttgtaccttccatagagactacggcaaaacatttccttgccaaagttagtcacggatttttgagcaaccgggactattgtgtttttttgggtaactgaccaaagatggtttctccaatagtggttcattgtattttgcttctatgttgtttcccctttcagaaacggccaccagtcaggcactgtttgaataattagatacatgtaacagaagccttttttgagatggagtggtttgtcaaattcatttatccctactgcatcttttttcctagtccctgcatcatctggcgatggtctacgtgtattattatattgaaatgatctacggtgtgctctttgtagcaacagggaaagatagcaagcccgggccactcgacggcatccatgatggtatgctcttcgtagcaacagggaatgatccgcgcattgtacaaaaggcttcagctcgtaaaagccttaagaactggaaaagtagggagggcgttgcagtggcaatcgcacatcccacactagttgagtggagcgaacagctagcgatcgagcagcagagaggtggctgagtaactcctgatgcctctcgcacctacgagccttgtggaggttcattacttggtcgatttaatttgccacaagaaattaacagagaccagccactagagctgcaagccctacgtatgtatgtgcactccacctttatagttgacttagccatctatctatcacgcatcatgcgaatatgaacgatggcacgccatttggaccagcctttgatggggtagtttagcttgaaaggtagctatcacctcacatgtgaatagttgaatagtatctctatatgtcttctgcctgtaaagatatcattactattttactcggtcccacacatatgagagggttaatttacttgtctaaaaagtccaatcattttacatactgctaataagtcactgtaaaaaaactaaattttataacttaattgtttaagatgattttgagacctctatcgttatttactttttatattaatttttaaatcaccgagaatatgtatgataatttgccatacacacacatatacatacatatatattatacgatttttttttcattgacaatcgtaaggctacaatccattaggcaaccgctggtgatctaaactagctagcttcacactaaactaaaccatggaaggtaagcaaaatttaaattgaccatatatacttttttttacagaagatagtgcattagctttcagtccttataaacaaagcaaacaactgattcatagagctaatatgaatagcagtgcggcacaattccaagttgctcttgtgtgcatagtaataaaataaaaaataaagcgagaatgtaacgctggtttgaagaaggcaaaaatgagccagaatggacatgttagctttgccagtacctttttcaaaaaataaaaatgtatactattgaaaaaggtattattttacgccgagatccgaatcatcgtaaatgttgcattgtcgcttaaaataatagagcatttgcaaacttgccaccggttttttttaatattgtaaggatgccattcgaatgatatccgcctccctccccctgtactcgatacattcctccctcctctcccccctttctcctccccttcttttcttcctactacagtaaaccatacaatttttgttaaaaaaacaaaaagttagaaaaatttatgtatagaaatactatatataaaaaatttgaattcaaattcaaatttgaatcgggtatgtaaacttttgacttataaactttgggtctacaaactttaggtgtataaactttagatgtatagaaatactatatatagaaaatatttgaatttaaattcaaatttgaatcggatataattcaaatttaaatttgaatcgggtatgtaaacttttgacttataaactttaggtctataaactttaggtgtataaactttagatgcataaaaatactatatatagaattcaaattcaaatttaaatcagatataattcaaattcaaatttgaatcgggtatgtaaacttttgacttataaactttgggtctataaactttatgtctataaactttagatgtatagaaatactatatataaaaaatattgaattcaaattcaaatttgaatcggatatataaacttttgttctctaaactttagatgtgtaaactttgggtctctaaactttatatgtgtaaactttgggtctttaaactttatatgtgtaaacttgaggtgtataaactttaggtgcataaatttacgaaaataagaaagtaatgcggtgccaaaaaaggaaaccagtggagggagggagggggaggggaattgatcgctacccccatcccaggcgatcgatcgccgattaggatttccagtctgtgagtatctatggggttatttggttgaggatggtaactatttgactaaataagccacttaccataggatttgttaccctgctttctacaagtagtatgaccaataaaattttggccacgcatatatatatatgagttgtcacactttgttaaatcttttgtggcaaagtaccgtcatccaaacagcccccaagtcctgtgtttgagttgggctgtttcagcgggttagatgggttgaacacttggtttaggctttgcatcaactatatatgtagccgccattgttgtcgtctaaaaacagtaagcagcagacaccattgccggttgtctccctccattttgaaaagattgatcttgtgatcatcgcattaattaagcgcacacgacggtatacaccatatttatatccaccaatcgtaatcatgtctcatttaatttcatctacctctttaatcttaataaaaaaaaacaacttcagaagggtacggaatgtatatgtcttcagtgtcatcgtgtaacattttccttctcataattcagcactctcatgctattgtgtgatgggaatgggatatgtccacacacatatgagaacgaataaataaatttagctaacgtattcgttcccaccctgctttgaatgtggtaagttctcctgcgaaaatcgttccgattcagtgccacaccgtaaacataacgtgggtcttaacagagatataaatttcactactggagactgtaaggctctcgtgtgctcaaaacctacggtaacaggccaaaaacacacggtaacgacgttaccgggtgctagtgcatgggaacagatactcggcggcttcatcagtttaccgtgcgcacttcccgggtgttttacaattatgcgcatgggaaggccaaaacacataccgtgtgtgctgaatcacacggtaaggctgccgtgcgtagctggactcttgtgtaacggagcttctaacggaacggtggcttaccgagtgtccttcacacacggtaacatttggtgtgttaccgtgtttcattcacacccggtaacatgtggtgcgttaccgtgtttgaagcacccggtaagagaacgtgttaataaaaaaatatgctatttgcaatttgtttactatatccatcaaagcttatttccatcacaatataaaccaccaacaagcacacaagagcacaacacattccaacataaatatatatttcagtaaagaggttacaattaataattagcatacaagcaattcatggttcatgtcagttaaagcaataaccaaagttacaatagctaggaacatattattcggttgatcaatcaataatagaaagatgatataaatggatggtacagatcctgaagttgatgcttgaatgtataattatacctgcaattgtgataagcttgtaagaaactggaagatcaatatagctagaaactgaattaatatcaagattggactatattacatgctaaacccaaacatagtacaattaatgggaaataagaccaaatgctcaattatatagatggaaataagaacatgagcatatttggatcaacctagcaaaaatataggactggatcttcaggaacagaggccaccatttagtgcacaaacaactactgcatcacaaaaggtactagtgaaattgtgcaggtagtttaccatgagcaatttttgtcgctaggtacttttaccagtagcaatgctctaatataagccaaattaagccacacattactatatatctctgatttctcattatctcaatatggtcaagaacagtcaacaatgtaacttgagcaactttttagaatgtcaataaaaaaggcacaatgacactgaaaagagcataaatgaaaaaggaaaagtaaatactttaggcttgagattgcaaagaagtttgtatagcaatcattaccagcacagatgcttcactcctattcatggatgttctgaaaaacacaatgtttgaacctaaaatcaggaaataagattattttctcactgaaaatatgacaacttcaaacaatatttttaaatactaaatgatttcaactgaaaaagtcatcaacaacaaagttgtataactcatcaatatctataacttttattttggtcatttttctatataacatttttttgaacagtttgaatttgaatttaaaaatatgacaacttcaaacaacattttcaaatactaaatgatttcaactgaaaaagtcatcaacaacaaagtcgtataactcaccaagatctataacttttatttttatcatttcttcatccgataaagtgttaataacattgttcacaagattcacaaatctgtgttatagtttataaaaccagatgagggatatgtgattttgtgaacaatgttagtatcactttgtcggatgaagaaatgaccaaaataaaagttatagatattgatgagttatacaactttatttttgatttgttgatgacattttcagtcgaaagcatttagtatttgaaaatgttgtttgaagttgtcatattttcaaattcaaattcaaactattcaaaaaaatattatatagaaaaatgaccaaaataaaagttatagatattgatgatttatacaactttgttgttgatgattttttcagttgaaattatttaatatttgaaaatactgtttgaagttttcatatttttaaattcaaattcaaactgttcagaaaatgttatatagaaaaaagaccaaagtaaaagttatagatcttgatgagttatacaactttattgttgacaactttttcatttgaaatcatttactaccaaaaaaaatttgaatttcttatattttaacaaatctttaaatttttctgcaaaattatagttctcatatagctctctattttaacatagaacatgtattcatcggagatcattttgaaaactcaaaacataatttcaaaaatagatctgagagaaaaaataaatatttgaacccataaacaatcttaaatgaaaaacctttcatctaaaaagttctagatctcattaagggctacaattttcatataaaatttatctcgatccgacttcgtatgaaggtgttacgatttttcactccattaccaacgaaatatagttggttgtgcaaaaaaaaaagaaatctggtcggcggcattagaagcaccgtgggcgccaaccacgaaattcgggcgcgccaacggaagcacagggcgcgaaaacggaagttggatggatttctggttcagtagcaacgttaccgtgtgcaacatgttcacgcacggtatattcccttgttaccgtgttcctgcgaagcgcacggtaacttaccgtgtgtttcgtaaaacacacggttacatttggcaacacacgggagctttcccatctccagtagtaatagctgaaaattcgattaattctgagtaacaaaagaattgttgggatttcaccagaatcgaataacacacgtgaaaactagaaccaaaaacataggaacttttctggcgagacacaactatcgccattttctttttctcaactcacgtaccacaattacatagcctgtcatggtcttatataggtttgctaattaaacaaactgaaactacataaaacaagtaggactcaacttagtaaagctacatacgactcaaactccggcccttacgtatctgtatgtacaatctggccagcgtaaacaatgtataccacgaactccttaatcaaatacttatcctaattaaactacaactaacttaacactaccaacaatgtgtccgctgcccacatacgcaccgcagaactgtgctctgtgttatgtttttccgcgttgccatgatagggcgctggaattagcgtcagacaaaggagcaccgactgctttgcagagctcaggacgtcctaccaggttgaacctccacgagcaatcctagtgagcgaaggtcgctggtgaagacgagcacacaggcagggcacccgttcccgacatgacggcacaaggccaccatcaaacgcgccggcctccgagacatgatcccacggtgacgcggttgtgtgcctgaaacctcccatgcccagccctgcctctgcataaccaaagagtccatgttgcttttctcgcgcgctctctggttggcagaggctattcctttccttctctttactatccattttaaccagctaggtaagctagctctgagcggttcttgtgtgggtgactctcctagctttctgttttatgttggttcatgttgcttttgtgcttagctaagtggtttttggtggtctctacttgtacaacaatactaaacttatttattataagtaaaaagtgatgtaagctagtatttatttgtgatttttgctactaacataaaaaagttgttttatttatcaagagttaaggtggcagcgtacatacaaatggcccattcaataagaaaacatgtaaagtctacgttgcttgtaccatccatagagactacggcaaaacgttaccttgccaaagttcattgtgctttgcttctctgttttcctccctttcagaaacggccaccagttaggcaccgtttgaataattaggttgagtgagatggagtggtttgtcaaattcatttgatcgtactgcatcttttttctagtcccttcatcaactgacgatggtttgcatgtattattatattgaaataatctaatcgtttaaatccaatcttttcaaagccgagattctatgtattgtttccaaattttatccaagagtaggcttaagctcggcagtgtaattaacctcgaccatgaaacaatccactcagaaattaaaaaaagaaattcacaacacctagactccgggtgatacatcaggacacatcagatcaacactgcaaaagatagaaagcccgggccactcgacggcatccaggatgctgtgctcttcgtaacaacggagaatgatcagaggattgcacgaaggctgcagctcatgaaagccttaaaaactgaagaggtagagagggcattgaattgacgatcatacatccccgactagtcgagaggagcaaacagctagcgatcgaccagcggagagctggctgaccttgtcgacctcaaggtggctgagtaattgcagatgcctctcgtgcctaggagccctgtggaggttcattacttggtcaatttaatttgcctcaagaaattaacagagagcggccactagagctgcagacgctatgtacgtatgtgcacaccacctttatagttgattaagccatctacctgtcatgcatcatgtaaatatacacgatgtactattatattatatagatgacacgtctcatttcgacctgactcagatggggtagattagcttgaaatgttgctatcatctcacatgtgaatagttgaatagtacatctatgtcttctacctgtaaagacatcagtactattttactcagttccacacatgtgagagtgttaatttacttgcctaaaaactctaatcattttccctacaactaataagtcgctgtaaaaaaatttttagaacttaattgtttaagatgattttgagacttctatcgtaatttacttttcataattgatttttaaatcagtgaaaatatgtatcataattttcatacacacatatattgttcgatcttttttcattcatagtcgtaaggctacaatccatattaggcaaccgctggtgacctatagctagcttcacactaaactaaaccatggaaggtaacataaacgtaaattgaccagccttttttttttaacagaagatactgcattagctttcagtcgttagaaacaaagcaaacaactgatcattcatagagccattgttagaactgtttagcacgatgtttaacccgtatctccacgaacgaaccttctacgctgagatggtagcaaaccactcatcacctgacgatgacttgtggatgtttcactacccaaatttccctcggttcaacgggacaatttgtcaatttatacttcaaacaccagaccaatcgaccccagggccaaccagctggctgcagttgttcgtgagtgagtgaggaagccgcaggcatatgcaaaccgcacttgccgcccagctgcgagcgcttggatttggagcaacccatgccgactcctcccatgcctggaatcctagggagagtccgtcgggtcgattttcgctaaaaagagagagagagccgctaatgctatgtgtgcacaccgatccttacaagtagttcctctattttgtattacaggtcatttaacttttttcttggtcaaactttttaagcttcatcaaatttatgaaaaaagttagtaatatctataacataaaaaaaactttataaatctaatggtaaatatattttggtaacatgtttgctttgtgttaaaaatattacaaactgttaaacggtgcgtttcgttttgtgcgaaaactttctatatgaaagttgctctaaaatatcagatgaatct

SEQ ID NO: 48225 - DNA, 10484 bp, Oryza sativa
ttaaatcagtgacaatatttgggtagtaatctgttaatttcaactacaccagtcactgctgtttgtgagaagagaacaccaatttatctcactcatgccacataaactaaaatttactcttgtaaacaagctagctagctccatgctaacagcaagtactaaggcaaaagaggtactcttcgctgtgtcaacaaaaataaccgttggagacagaaacacaatgcgcttttgggattccgtgtggatagatgggcgcagatcaaaggacctcatgccactagtctgtgcaatctcgaagaaaaaaagacaagtccctacgacagggaaaagaaaatgatgcttggatcaacaacttagactttgaagctaacccagcaatctcggtggaccttattgaacaactagtctctttatggattgtcgtgagagacattcacttaaacaataagcagttagaccaaattgtgtggaaattcacaaaccatggagaatactcagcaatcagcattgtcggcttagcaggcacaatgcttcagcatgacatccatgaactttcattcgctcatctggagagtttgggcgccagggaagtgtaaattccacgcttggctagtcatttaaaactgggtttggacctccaatcgagtcgcgactagagtatggcaaaacaatgggctctgcccactctgctgcagagaaggcgaaacagtcccatatcttcttgtcagttgcagatacacgaaaggaatatggagcatggtagtcgactaggtggcttaccagcagctcgaccctaggcattgggagacgacccaaactatcaaagattggtgggagacactagctaacacggcaggtgttcctaagagaggtttgtgcaccctcgtcctcctcatagtttgggagatatggaaggaaaggaatcaacgacagcacaagaatgccatatcatctttcctgttcgcccagatcaaggaagaggcgtggacttgggcgatggaggagcaaagcgtttgcgggaccttctacccctccatgtataatatttaaagtgtacaacatttttcacttttcttgcccctaggagctgttttttctaccgctatattcaatgaaaaggcacaatctagtgttgttttcccttaaaaaaaactaaggcgggagaggtaagacgaacgcgacagtgtggtacatgcatgacagacactggaaaacaaccctggactagggttgaattgttgatatctggtggtcacttgcttcggagatcacggtaaccaaaatgagttgggagaaacatagctccagatgcctctcaggcctataatgcgcacgtgcatgttgcatttttgcccatgttagtttcagcaaatttccatatggctgcttggttaatttatcaggttattccattgcatgcctttgtggttcatgatccaaattataagccatgtgtttggccaattggccacattgccatgatagggcgctggaattagcgtttgattgatgaatcacaactgctctgtggtgctcccaacgtcctaccaggttgaacctccacgagcgctcagggtgagcgaaggtgatctatggtgaagacaagcatgcaggcagggcacacattgccaatgtgacagcataaggccacgacgaatcgatccggcctcaaagacatgatctcacagtgacgctgttgtgtccctgagacctcccatgccggccctccctctgcctaacctgagagttcatgttgctttgttgcacgtctctgggtagcaaaggctattccacccccttgtctttactatccattttaactagctaggtaagctagctctgagctgttcttgtgtgggtgacactcctctctctctctctatctctctctttggttcatgctgctcttgtgtacagttgagtactgtttttccagtgatctctactagtacaaggatattacccttatttataatcagtataggtgatgtagctatttatttacaaaagttctactactagtagaaaaaaatgttttatttatcaatagttcacgtgacagcacaaatataagtgacccatccaataagaaaagatataaagtctagattggttctactatcggtagagaagtagtgagtaccgtagaaaaatatcttcccaaaaattcattcacgtattgcatctcggttctactttccccttttagaaacgggcacctatttaagcgtcatttgattcgaaattacaaaacaaactatcgtcgtggattatcgatatgattataggcctaaacaaatattttgagaaataaacttaacaggtagcttaaaataagtcggattgtagagcaaatgatctattggaataatccggtaaataagcagtgatgctggaggactttgtactgtgatgcaataattattgtgccactcctgcatttaattaatctacttcttttattcaattttatattaagtataagatgaagcttgagctcatccatgtacgtaattaattaatctcgacaacgaaacaaaacaacatgtccaagaagaaaaattcacagcagctgcactctattccaaatctacatgaacgggggttcagcaaaacaccaggccgatcgacgccggggccaacagcaagctgcagggcgttgttgctcgtttgcgtgagtgaggaagccgcaggcatatgcaaaggggcagtggtggcaaccacatatgccgcagtttgtggcaggtgccctgttagtcaagcaggggagagcccagctgtgagcggttggattcaaggcaacccacttatttccgactcctcccatgcctactagaatcctaaggcgagtttcttcgggtcgattttcggctaaagaaaaaacgagagccgctccaggcgactgcatgcacaccgatccttacaggtagttctgccgttttatattataagtcagctaagttcgcaacttctaaaacattttttcattaaatttaatattgaatatattttgataatatatttgttttgtgttaaaaatattatttcgcttttatgtaaatttgatcaaacttagacaagtttgactatgagaaaaattaaagcgtcaaataatataaaacgaatgtggggtactaataggaataataaatcggttcttttaagctactatatatactatattattaccacttggttttttttaaataataaaattcgtggcacggattttttcctctgcatctttattttttcttcaataaaactactgtctatagctgtaagatatgtgttttgtttatttcttaaaaaatttaattcatcccataatcaagtattaaatcagtgagaacaatatggcaataatctgttactttcaaacaacaccaggcctgctgtttgtgaggagagaacaccaatttatcttactcatgccacatacactaaatcttacaccggtaaacaagctagctggttccacgctaacaggaagtactaaggcaggagaggtaacacatgaacgtgacggtgtggtacacaaaagacaccggaaaacaaccctggactggggttgaattgtcgatatctggtggtcacttgcttcagggatcacggtaacaagaatataatgaggtggctgaaacagagctctagatgcctctcaagcctataatgcgcatgttgcattgttgcccatgttagtttgctcaacaaaattccataaggctgcttggttaatttgtcaggttattccattgcatgtctttatggtttatggtccaatttataagttgtagctctaagatgctgtcacaccccaatctgataccgccgtacaacggcacctgataggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaaacaccaacagcagcagcagcggaaccaacggtctaacacccaacaccacaggcgacggctgggaaccaggacgaaaccctaatcttcacttcacttcatcatctcttcagggcggaggaactatatatatgtttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgactttaagagatgtttttcaacagctcatttggtaatgtaccgacctcccgggtcagatcattacttctcggctctcagagccattccacttgattaatcagctcccagagcctttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcagcgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggtgttcccaacaattggcatacgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattatcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaaatagtgcgactactgggtaggtccgccggtttggcacgcaaactgaggccaagcaagttaagtgtgattctaataatgcaagttgtaaacaaaataataatgacttttcaattataggggcaattgatcaaagggtgacttgccttgctcaaggtcttcacgaagcttcacgaatcatcgagaaaacccgcgatcgacgaaaatccgataaccgcaactatacgcaaacaattgaaaacctaaacaaaggaccaaaagaaagatcctatttagactaattagtagtgccaataaatagatctcaattttacggaattattggaagtggaacggagtcgatcggagctacggatcaagggatatgaattttggaggtctaaatggattttctggacaaggaaatgttttgtcggaatttatggaaataatattctcaagaatattattgacagtcacttaccaaggaaaatgattcatggaattttggaataaggaattgatttctgaaagagggaaaaatgatttattgaatttatagaaaagagaaatatttgtggagtattggaaaagatattctcaagaatatctttgactcattgacaagtggggccaacaagaagtgagagtgagagaggatagatgggctgcggtccaataggtggcggatgtggtagggggaggacgagggagcaaagttagactttgttccacggcagctggtttggaagagggaggcaacatagactttgttccaaggagcgaggagagaggtgaggcccatcggctagcgagagagagagagagagagaggagatgggccgactcgggttgggcggcccacggccgggtgggcgaggccgagccgagccaggcctgcgcgcgcgggcgacgctgaccggtcgctgcttgacctggtcaaacggggccggcgggccagggtggcggccacgtggtcggccacgcgggcaggggcgaaaggggaggaggaggaggaggaggcgcccgggatcggacggccgacgacgcgcgaggcgttccggcgagcggcggcgcaccggagcgagcggccaccgccggcagctagaggaggtcaggggggatccgtttaacggcacggatttgagaggggaggtacgacggtggctggcggcggcgaccaagctcgccggcacgccgacgtggccgcgcgcgagaagagcgaagggtgcgcgggctcgggcttagccgaaccggtatggtgttgcgacgcacacgcggtgacgcgggacccgatggtcaccggcggcgcacgcacggcggcgttaggcggcggcggaagcggcgacacggcgcggagacaaaggagaaggccgacggccttagggcagccagggggaggtcatggggatccccgggagcgtggcggcgagaggaatcgacgcgagaggagccgacgacggtggattgcggcggcggcaatcaccggagatcaaaaagggggaaaacacgacgagatgacgagggttcgattcaaagggatgggagcatctccggggttcaaggaatccgtttccggcgtcggattgggcggagcggcaccgaggttggctggcgacgagagacggcctccgggacagagcatggcggccggcgagctatggcgagcggcagcgggcacggcgcatcgcatggcaggaggaggattatggtggggagctcaccaatcgaagaggaggcagtgttggcggcgcggtcagtgtcgcggcgaggtgttcgcgacgccgaggcggcacagcaccgagagggagcggccggggaagaagggagggagaggtggtgcccggagctcctcgtcacgcgtccacgcacgcaccggctcctccggtgctttggcaacggacggcaacggcgagagcgggacgagcaacaacaaggcggcgacggtggttcggcggcaatggcgcggtgggtgtgaggactgaggcgagtgaaaacgagagaggaggggtttggggtggcttggttttatagtggagggatgtcggtttgggaggggggaccgacatagagcggtcgagcgttcggccggcggtcacgggcgatgcaagagcggcggacgccgaggatgcaaggagcggcgaaggcgatggatcgggcggctaaaaccgaaccgctggagcgcaggctggcgcggtcaaggtggggggcggcgagctggcggtcgcgcccgtggcccaggcggtggcaggcggtgacgccgatggtggtcgggcaaaaggaaaaaggaagagggaaaggagcttggtcccttgccaaaacaagaaaaggaggagggagagtgaggaggaggaggaggagagcagctgcttctcccactcttggatgggtgcggcgtggagcggcggggggccatggatgacgtcgacgatgacggcggcggtcggtttggcatggagcgggggcaaggcggcagcgcgtggcgtcggcggtgcaagggctgatggtggcggcgaccgggcggcgagcgcgcgcgcgggaagggcgaccggcgaattcaaacggcagcggcgggaatcggcgtcgaggagaggagttcgacgagagagagaggaagaagacgagagagcgagagaaacacagagagagcgagcacacacgcgcaacgcacgtgcgagggggaggaggaggagcggctgagaggagatgggccgaggagaaaacggcccacaaaaatccgagggaggcaaaatagactttttcggaggagattgattcgaagagaatttgaacttggaatttgacttagatttcggaattgggatctggatgagaggaaggagtagacggaggattcaagatggggttttggatattttggatctagggaagtatttggcgatgattcaaagagagggatagaatttcagagtttgatttggagacttgagtcggaagaggaatttcgaggaggcaatttttgatggtgacgagagggatcaaggacggatttgaattgagatcttggcacgacttagactcgcacacaaaggacggaaattttcgcatataagattttgccgaattagtttttaacgcctcacgaaaagcggagcgttacatatgctctctctatccttattctgatgagactctcttatgttgctttgtgttgatctttgcacatccccgctaatctgtttcatcggcttccccctccttttttcttggcttgtccaaagctattaagtgccagttcttatcggcaaccagcaactatatattgttacatgtatcggttgtataactggcatcgatgacagttggaaaacccgacacctatgaacggttttcaatcggcactgaagtgcctttttgtcatagtagtgttcgcagcaacaaccaacaggatcacatgattacacgatgatcgcggctcgtgtctagcaagtgacggttggtcgagttagtaggagctgtatgtgggctagaaaccaaacataagcactggacaactagagaggctagcagtggcgatcacacataccccactagtccagcagagcaacagcgagcattggagaggttgctgagcatgttggccgtaaggtggctgagtatttcctgatgcctctcatgcctaggagcctatggaggcctggagagtcattacttcgtcgatttaatgtgcctcaagaaacagagattggccgccagcctagctgaacgcgcaacctacgtacgtgcacaccatctttatagctaactcagctatctatctgtcacgcaccatgcgagtatgaacaatgtacataccagcctcagatggggtagattagtttgcaggtggtcatttgatttgtacataaacatgtctcggcctctcagatgtgactatatactagtagatactatctctctgtcctactctgcctataaagacaccggtattttagtcttttccacatatgtgagagggttaatttacttggctaaacttcatctcctttgccctacagctataagccgctataaaaaagaaattttagtactttactttttaggttgattttgagaaattttttatcgtagtttatttttagtagagctctactccggtactctctactggtattagaaaacaatctgaaccattgatcttatttatcaaaggattcaaatctatttatactaccaccttagttagtgctagtagaaacgtggaggggtattattatctaagaaaatatgtgtggagaggtataattgtcatttaacagtgaataaacatttgttctctttttttttagttttttgcgacggaatatgaacaataccagcacattggatgaccacagatcgacctagccagaaaaaaaataaagttatctgtaattattatattagtaaattattactaatgtacccttaataacaaaccgtccagattatttctactagtagtataatataaccagtggagaacaccgaagtatcgccctagtaaaaaatgtgtatgtttcatttttagtgttttatatatactttttttaagagagaaagagagggtgaccgtctccggccagcccaattctaggcaaaacaaagtgcagcattataggcatgaaattgcaacaaattcagggctattcgatggtgccatatcccaacatccaagcctcacgttagctcagttttatatagtaaaacgaaataagttcacaatgacattaaataagctacggcctcaacctgaaatctcttattgtttatgcccataactgctcgatgctgaaaacctgctaatgagtaatgaaccatattaccataacactttctggtacactggtactcagtctcttgccttagctctcggcgacgtgggctattaggagacactagaaggcggccctggttgtgttcatgtgctttccggagcttagatgtttccatgatcacaggaacagaacgagcaggataaaatggagctcccattgatcctcaggcttaattaacttgtatatgcgtattgctgctcgtgttaatttgaggagatttgctgcggtcaaaaaaaaatacctcgagttactagtctctcacagtaccaactcgtttccgatcgttgtatcta

SEQ ID NO: 48226 - DNA, 4645 bp, Oryza sativa
tttagtcccggttcaaaagggaaacggacatatttgatctttagtcccggtttgtgttaccaaccgggactaaagatcatctttagtcccggttcgaatgctgtcaggacctgtcaggctaacaccaaccgggactaaagatcttaactttagtcccggttgatattaccaaccgggactaaagatcccggtgatctttagccccggttggtgactaaagatcttaactttagtcccggttggtaataccaaccgagactaatgatcccggtgatctttagccccggttggtgctaccaaccgggactaaagtcccacccctatatatatatgtcttcttcctcctccagctgcccgagcaagcttcaaaattacttcaaaaaagaggggaggtcatgccaaaatttctattgaatttattttggtgtttacatacaaatcggaggtgcctaaaaggtttgcaacttcatcctccaatgtttttttttgtcatactacatttgcacctatgttttgcacactttttgttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaaaaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaatggaagaagatgaagtggaagacgacaatattccggactttgctcagtacgttggatttgaaggaaatcaaacgggcgaggaggaaatagctgctgatggtaacgacgttgcggatgatcttagtcagatgttcctttgttattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatttaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacatacaaataaattcaaatttcattacgtagcgatttcttgtttaattactaatcaatttcatacattcatatagtttattcgcattactatattcgcatgagggataacctgaccacacacaaggaatttatcacggcggttcaagaacaactcatgggattcatcaacgaagaaatccttgatcccaagggtgaattctactacgacggaaacacaatttaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatatatatatatatataaaccatgcagcaacaggggcatgcaaaaaaaaaggtcagctcgatctttagtcccggattggtactcccggtttggaaaccgggactaaaggggggttacgaaccgggactacaaagggtttcttcaccagtgtaccgtgaagtaccgatacctcgagttattttttgttggatcggagcaaatctctaatttgagaagtttattgttggcgtcttctcgtggtactgtggattgggcagagtctattttacatgtcttttctgagttctgatccactttaagcttcaagcttcaagatacttctgtttcacgtcgtttcatattacatataggcagcacgattgcaaatggacatgttcgaaggaatacggttctatactccttaggagtagataattttaccattctttaaaaattaccatgaggtactacgtacactttatactataaaattggtacctccaaatactaattatcttgagatataaaaaatttagaataaaatttagaaaccttgaggtacttttttaaagactataaaatttctcctaggagtaggtacacccgtacacctgatctcatccaacatccatcaaacccaagcccgatcaaacggtgtttatattacccgtttagattttgtacaggaaaaacctgaccgcatgtaccggccgagtgcatgcatgcagaaatttgaaaataaaggaatgtcattttcttcctgtcctttcagtccaaactatttattagtatcaactaacggatatccaataagaaggggagtacgtatacatggtagtacaaaatggccatccttcgacatccttgttggaattgtgctagagaaaagcttgattttttacttccaaataaccataaaattattgctcaattttccttttattttctccgttgtgtaatatcaatacgaaacaaatgcagccagaatacaaccacagaatacgagcaattgaccaaaagatagaacagctgacagctcagtccaatatcgccaagtagtaggactaggctccttaacatctatacagagactgagagacccatacttggttggaatcgtggacatggaacaagatgaccatttgcatcacaactagcagtgctctgcgtgtggcacactagcagataagatgcagaacaccaacctctaagctgtagaagttgtggacggtgcgccgtcagtggatccacggtgctccaagccgatcaatgccaagcagcatggcatccgatcgaaggcaactacattcccagcgtctcacatgcccccaggagtctaggaaattcatcatcctgctcatcattatttatgcgcgacgaaaacacaccttcctaaagaacccagctagctcttatcaccaagtcatcgcccaacatttggattgagcatttttttcactttctgtaacctctggttttctagctagatgtgttactacttgtatgaatgagttctacttgtatgaagagagatgatgttctacttgtggagttctgtcatggcacttatctcgctttgttcttttgttactttgctaggtagttctccacttcatcacttagctagataaacccattcttctttatctttttgctggcccatcattttctactgccttttatggccacggtatagcacaacatatgtagtgttgtctgccatcaaacaacatttacttatattattggacaactttaatgattgtggcggatgaacctgtttaattggtttatttgaggtttacgcttgccaacttttgtcaatggcaacaattctctattgccaaaattttagtcaagttgcatgtttggatattgctacaaaagaaaaattggcaagaaaggttaggctattatttggtttgctccgcaagagtgttactatgtgcttgacaaaatcagctaaaccaaaaatattggcaataccttttttcttattggcaacatcaatgttttggtacgcttgagtttggcaaagaaacaaacacacccttatatatcaaatatacttgactgaaacaaagaaatataattttagcctagacgttcataattttactgttagcagtccaaattaaatgtcaatgttgaaattttaagaaaaggtaaaaaagaaccaaacataattcgcataattgtatgctaaacttaaaaaataagatgcaactcacacagacagtcttaaatcaatgaatggttatctttacatggcagtatagtactagttggatggataaaacgataataaaaacgtaggatcgaatagcaagaactaaaccaaccagagggggtgaatggttggtatacccaaaaaccgaaaacttttagcggaaataaaagttaccctcgaaatcgacggatcacggtctgaccgaagttgttgcgccggtctgaccacctggaacacgtcggtctgaccgatgtagatcgattggtcgaaccgccgagatgcctgccgcgcctgtcgccgccgccggtcagaccgcccgtatgccgccggtcggaccgccgcgtgccgccggtctaactgccgataatagtcggttagaccgccgaaacccgatgaaacacaaa

SEQ ID NO: 48227 - DNA, 1167 bp, Oryza sativa
  unsure (1)..(1167): unsure at all n locations
tgtgggtaaagtgtaccccctctgcagaggtcaacaaactgttcgaacagccatgcccacggtcatgggtggatgtgaggtgattcctaacgtagatatgtttgactactgtcttgggaaattgctgtcgtggaaaggagatcgacgttgggaaaatctgacactgatgggatcagttaggcccgggttgtctatataaatccgttggccgggtgccaagcttgatctattttaaagattgatacattgcacatactccgaccggacgagacgcactgtcttaaccgtgtcgtttgataagcactcacttagttgattttttttaaaagagttcaaataaaataaattgcaaaaacaacagtccttcccttgaagcctgcattaaacactatttcccatggcttgctgagtactcctgtactcacccttgctctatataaataatcccccccagttgctgaagaagatgaagcggatctcgctgacgaggagtttttccaggagcaagccggctacgatgagttttagggtttcggcctagttcccaagtcgcgcctgtgttgtttggcccaagtcttggcttccgcttcccttttataatgcagttgtgagcttgggatctgtccgcagcccaacatgactgtactcctactctataataaagagacctctgttgttgtgatattccgtcttcctgtgataccagcactgtttcctgggactggtatcgattaacaggttaatttagagcgtcacgggctagttccggtcggtactagttcggggcgtgacaaagaacgagagggaaaaaaaaaagaaagaacagacaatctccgcgatttgggtatggtactagctagcaagattagattgtggggaagaaagagtaccagcacgtagcagcaacaaaccgattcgatctgctttgcggtaaatccagggagcgtccggcctgctgcaggataaagatggtatcacaacttcacaagttgtgcaaatatcaaagatgaacaacgagaaaatgaagaataaattggctttccaacggagaggataaagatacaatcagatgtagcagcagcggacctggggcgctcggttggaaggggcacggcgtanctccccagtgcccggccggagaaggagatggggatggatttctaggtc

SEQ ID NO: 48228 - DNA, 14846 bp, Oryza sativa
  unsure (1)..(14846): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccaatgtaaacaaagaaaaaaaaatcgaacgggatgctcatcagccgggataacaccagataaaatatgacatgctcacagccatcaagaaagaatgttgatggcagcggcatgcatgccaggagatacttaacgatcttctccaccaagaaatagcacaacccatgtcataattaacatgcaacatggatctggctaggtgtcacgccccgaactaatcccgaccggaaatagcccgtgacgctccaaattaacctgttaatcgataccagtcccaggaaacagtgttggtatcatagggagatagaatgtcacagcaacagaggtctctttattatagagtagaggtacagtcatgttgggctgcggacagatcccgagctcacaactgcattacaaaagggaaacggaagccaggacttggaccaatcaacacaggcgcgacttgggaactaagccgaaaccctaaaactcatcgtagccggcttgctcctggaagaactccttatcagcgggttccgcttcatcttcttcagcaactggggggattatttatatagagcaagggtgagtacgggagtactcaacaagccatgggaaataagtgtttaatgcaggcttcaaggaaaggttgttgtttttgcaattgattttatttgaactcttttctaaaaacaactaagtgagtgcttctcaaacgacacggatgagacagtgcgtctcgtccggtcggagtatgtgcaatgtatcaatctttaaaatagatcaagattggcacccggccaacagctttcaaacggccacccgggccaacaactttcaaacggccacccgggcctagctgatcccatcagctgcagattttccaaacatcgatctcctttccaccacagcaatttcacaaacagtaggcaaacaaaactacgctaggaatcacctcacatccgcccatgaccgtgggcacggctgttcgaacagttagttaacctctgcagaaggggtacactttacccacacgacattactaacccggatcacccagcccgtggggatcggccacgttgggagacctccaagctttcatgacaaggcatttcgaaagccgacacaggtttaccatatgccgacgagaggggtcccagaccaacaacaagttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagagggaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcaactagatggttacaaggggacatgatataacaattaacaaaggaaggatcaaatgcaacgaattaggtaggtctgccaatctgccttgcagacgggacaacagattaagtgcgatcctatcaatgcataatatttttcaagcaacataattaaattcaaatataggctcaagatgttcaaaggtggcttgccttgctcgagatctggagcttgatccttgaaatcctcgcactgctggtcttcgggctccgaaactatacgcaaaacgggacaactcaacaaacggcgaaaataaagccctattaatgacctctaagcatgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggagggaaattagacttccctcgggtggctagggcgcggcccgagagaaaaggggcggctcggccgagcttaatgggccggccggcccaaaaggcggcccagagcgcgcgtgggaggggaggagagagggagccggtggaccgggctcacctcgcgtggtcccgggtgggacccgcttgtcagcggctcggctcaccatgcggagggagtatgcggcgtgcgctagggtttggggaagagacgcggtgcacgcgcgcggttcgcggaggacgcggatgcggcgggcccacgcgcagcctcacggctcgcggtggatcgcgcccgcgagcggggccggagggagtggctgaccggggtcggctcgacccggtcttggccgagctggcgccgacgtggcgcctacgtggctgccacgcgggccggcgggaggtagacgacgatgccggccggaacaggcgaaagcgagcacaccgggtggttgcacgagacgaggggagacgagccaacggctcggattcgccggaggaagcttgacggcggtgaattgcggcggcggcaaccggtggcggaagaagggggaaacggcgacgaggtcacgaggggccgattcccggcagcgagagcatctacgcggctacgggaatccgtccctagcgtcggattaggaggaaacgcatcgagggaggccagcgacgagaggcgctttcgagctcgggcggcgacggcggcgagcacgtggcgagcggcggcaacggtcggggcggcgccggctagctacggggaggctactcgtgctactacccgagtctaaggggaggagatggaacgaggaggaagaacggagggaggcactaccgtgcgggcgggcgcagtgacgagagccgacggcgcgaaacgtgatcgtctcggcctcgggccgaggaagaggaggaagagggcgcggccgaagtccccttccgcgtccttgctcgtgtcggctcttccgacacgcgcaacgacgaacggcgacagcgaacagggcgacagtggcggcgagagacgaaaacgagggagatttggagggggaggagcttgggtttataggagcagcaatgtcggtttgggagaggggaaccgacattggacggtcaagccgacgagctggtgctccggctagcggccaaaacggcgacaggaggtgacgccggcgagagggaaaaagggagaaaaggggggagagaaagggggcttgtcccttgcctcttgggaaaaggaggaggggagcgggggcgacgcggcagagggaggaggagctctgcctccgtcccttggaggctagcgcgtggagtggcgggggccaggcgatgacgacagcgatgatggcggggcggtttggagcggggcgacgacacgggcggcaggcgcgggcaggcgcggcagaggctgacggcggcggcgaccaggcggtcggccaccacggcacgcgcgcgcgagaaacaatgggcggcgcggtggtttgagcggcgcggctcgggcacgcgcgctggctcacggggccgagcggctgcgcggcagggcagcggggccgggcggcgcagacggcgcaggcgcggcacgggcggcgaccacgcggctctcgcgcacgcgcgggcggagtgagggaggagggggagggctcggctcggcgcggctcacgcgcacgcgcgcgcggcgcgcgggcagagcgggggagggagggagagagagagagagagagagagagcgccggggagggagggggagatgggccgagagaaattcggcccatcgaacccgggggaggcaaattagacttttgcggaggaattgatttgggaaggatttggattcgggattgaactcggcgatagatcggggatttgagatctgagatggcacggacactagagaacaagcaaagaaacaaatttcgcaattagggtttttaagagataaatttcccgctaggcgccacgacggaacgggcgctacactaggccattgaatgaagagtaccctgagctaaatcttagcaagagggaaatatattaggtacgaataaaggttttatcctaatgaaattatgttgctaggctatcgagaaaaataaattgtatttaactatttaccattagcttccaggtgttgataatccatcaatatatgcatatttccatccaaatagttccttttttaatatcttctgttgtttattgatatcttccactaaattgatgcaagaggaaatactaatagtgattctcataggtaaattaaaaacatcttattacattgcactaactttacttgacaactcatatgtttttaatatgcagagctagctaatgatgatgccgacgacaccgccggtgacttgcagcagcgggcgcgcgcctctccacactccagagagcgtggtggtgggcgcgcctgcaaccaccgccatcatctcgtccaacccctcaaccatactgaggtccgcattcccatcctccattccaatggctccgaagcagcggcagcaacggagggtgatgatcgaagagctcagtccgacgataacgacggctgcccagatgatcgggatttgagggaggtcatggtttatggaggggggcggtggcgcgatggagagagagaggagcgggcggagcgagggacggcacaatacggagggaggacaactggagaagaaggcgcgggttgggcgggatgggaaggcggcgcgtcggtggggtgaggaggcggcgcgccgaggaggaaggatggggggctggggagtgcgatgcggaattacggatcggagagacagggagcgcgatgcggatcggggagatgagaaggggtgcgacgggtggatcgtgggagaaaatctcatccgctgatgcctgtgagaggatccttcgatgaatgttaacccttcgatcgttcaggactcaccaccatcactacgaattttttaagtagtaaagatacagatgaagctacacacatgttgcatgcaatttaactgcaatgtagttatatacgtgcatgagtaacctatactcccatgtcctgacgtatagttcactagtacagggtacagaatcactgcctggctcataaccattactgccagttttcgaacagccagtgggcaatgagcggacagtgatactttggttcacacaagtttggatgggaaaactaaaggaattctatactatgttacagaagaaaaactttacatgatcgaaacaaattgagcccaaaaagctcagtaagcccgtgtgtagttcccatacaaagcacaactcgtgcaaagctaattcctaatgactcacatacctacgaaaattgttgcaagtactgttgacaatcatgacattacattgttgggtctcgacaaacatcgtctagctgttcgatcaggtatggtatatgtaggtagaaaccatatttatttgagccacaaataaatacatggttaatgttatccttgatttataaaacatgggttattttgatatataatggtttcacatgatattgtttttccagaaaggaggggggacaggagccctagtcaaagggggtattattaatgtatggtcctcatgatgtatggtagggtaacataccagatgcactagaaataacattaggtggtatctgttagagtttgtatcgaatatatatacaaagttggttaccattttttagttagagttgtaatatgtgttatgatatagttatagttagagtcagagtccgactctctctctcttaaatatatgtagagatacatccgttgtaaatgcatgacaacaatagcataggagagggttgactggctgacgacttagctggtcaatgatcgtgaatacactaatacactatggctgcgttcgtttaagggtgttcccaacccctgtccctcgttttccacgcacgcacttttcaaactgctaaatggtgtgtttttttttgcaaaaaatatctatacgaaagttgcttaaaaaatcaaattaatatttttttttaaaatagctaatacttaattaatcacgcgctaatggaccgctctattttccgtgcggaggagatgggttaccaatctcatgtatcaaacacaacctataattatattagattggggaggaacaccaataattagtgtcttgagatataggcttcggctaaacctcgttaacaaatatcttgccttgccttagtgttgtcatcaaatttgcatattctataactttttttttgtgttcagatctcgatgtgctattggcggaagttttataacaatatcgatcaatagtacccctcttgccacacgatgacatcaatgtgtgcacagcgtggaggttttcttacatgcatccgtcgttgccatgttacactgaactagtatgtccgtgaattatatagaagtaatccattttatttcctacttgatagggttgagcaataattctatggagtaatgcagttttaatccaattgatcgaaggctcttttggcacattttagtttgcctctgttgtcttggcaacacaaatttccgacatatagtgtagctccaaagcaacatagaattgccgacacatagtgtatcctactatacagaattgctgaaatatagtacgccaataacctttactggcatatagttcatcagtgatgtttttttttaaaaaaattttaccaacatatgcctgttggtacatactttggtgtcatggtgtagtgagatctgaagtcaaagtgcaggcatgcattctgcattggctgtaatatagggctggaaactggaaagctgtaaatggattcaagatacattatgaatgtcatagaacttgttcttttttacgtacgttcatgttcctatccgatttggtgctaaatgatcaaacgggctggtggcagagcatgaagtcaaaaatcctaatgaattcttttgctaatttttttctataaacttagtcaaacttaaagaattttaacttaaaaaaaatcaaacgacttataatatgaaaaaaaggagtaggatcagcaagaaaataaaaggctgatcagaaatcgtccgcaaatgctatggaacctgcagctttctcctaggctagcagagctcaacggaagccggaagtactacaatcggtgaagtacatgcacctcacagttgttttctttggccggagaactactgtgaggtgcatgacatatatagggggcaaatatttccctggacatcttgagattgccttcgattgcacatatatacactgccaaagcaagcccaacaaccatcactgattctgcatccttctgttgggtgccatccacttttcaattgttcagtagtttatatattcctgacacctaccaagtttatggcatactatctccatgcagctcaaacttaatttggcataacccttttttttttatttcgaaaaggaagcaagtaaaatatctttgaaattgcctcgctatgactgtttggcactatgtatagcttcttatactggcatactgctcgatcttcgataaaccaatcttttaaggccatttttatcaatgtttttgttcatgaactcatcaaaatggtagtatatatatgctacttgctacaatcgctcaggagagagtatagaccaaactagatatgtatcaacatgtatgtgtgcatctatttggatacacatgtgtgcattttctgtataggtcgtatggatatcaggtacctatattctctacacctctgttacaacacagtccttctcctagcatggagcacgtaaatagaaaaatgttaataatgtctatcatgcagcggtagttactatagtgatgcagaggggttgaacccaagtagaaggacatgggtgtggtcaccctctagcattctgacactcctgctcataacatacaacttttgtttcttttgatctccgtccaacactatcatagggattaaaactttcatgttcaatcatgcattatctcttcactcaatttgcgtcttgtatttcttcccacaggccacagggagataggtcgacctagataaattcctgaaacctttcaatcccacatatctcgtgttgtaagggcaaatatattgttgccaggataataggatattgaactattgaccgtatgtaactgatcatttcctttccttgccgccgtcgctcgagctgtctgatgcactcatggtcgagttctcttcaagctagctgaagctactaactgtggctctacatatgcatgtgtatatactggccgcttgcaataactcaaaccctacggaacaaaagtttgtgtactgtatgcaataacattatgatttttagctcaaatgcaaagaatctgagattattctgtttttggttttcccccaaaacaaagtttgacatgtttcttcattatattgctagctcatagttacttggtactccttgtacaatcccaactcattatctaaaaaaatgtaattctagtgatttgcattactgaatgtgacatgtatctaatattcagtatcacatcatgtgcaggtttgggagtttcagttctctgaaactgaaattttctactttatgaagagtacttctactctttagaccatagggcggttttttctctctttagatctccttgctagtacttctgctgttttaaccattgctaggtaaataaaattattttcacaaagataggacgatgaactctgagttccactcgacactcaaggctattgttggcccgatctttcggtgagttgagataactacgatttgggagaaacgttgacgatccgactacaaccgtacaagacgttgtgttgcgcctttgcgatcgatacacctctccgtgggttgttgatcttgccggtgcagatcaaccttattcctgtaagcaaatcgaagaaacaagcaagaacaagataaaagtaatctgaattgcaaataggaatgaatacacacgataagttggggtttcgaatacaagcagacggatggtctagccgacacgcgcgctgcaaggaagtagcaatggctaaactttcatctaaacaaaacccaataaaccctgaaggggtacctagctatatataggggtgggaggatgacctagggatgcctaggggcgtgctccacctggttggggcgcaccccacatgggccccacctgggccggggtcccaaatgaagttacaagcccataggcccattataggtgacgcagcaccttgtgcctgtgattccggccacacgagatggaattcggggatgaggctggatccgttggaaagagggctctgagagctttccatcaagtactcacgggccgaaaacggaggtcgtatgcagattcggtggccgtttgaagtcagcagtgtagtaggtggccgaatcagattccagcacttggagtacttgatctcgatatcttcttgttcatccatgatgtgagcaatggttgcatacgtggtagccatggtcacatcatcctccccttctttacggaaaaccgtcctcggtttttccatatagtgctctttgcgtagtccatttacaacaacctgtttcttccaatcaaaacaaggcaaactcgagacaatttggttagcaataacattttctctagcttgcatgttttatccacatgtacaggatgttctaaatctgagcagatgtaaactctatgcacagaatatattccaagatcattataatcgccaaagatgtgaaatataacattacgaggacttggctaatcagaatgagcaaatattttgtccttcaaacaattgagctcacaagaatcatcaaacataacatagcccaatgtatttaaagaagattgcaattgaagttcatcattctcgctggacgtgtgaataacatacttaaattcagtacatggagaatcaagattaaaagtagcatgttcattcactagttgtggaatggatataagtgaagtactatcgcacaactcttctttatcacaaggaacagaatgcaaatcaacttgtgacaaaggcaattcagaagtaggttccactaaagtttgctctagatcagcatggaaagtggaaaaatgtaattcatcagaagcatactcatcttgagtaatttctgcaccatttaatttaccttttatgccctcttcagataatgtaggtgcattagccttctcctcattcgcgagtgaaggaagtgacatctcaaacatatcgttcttctcattttggggactgttctgaacttcctgcaaaacatcagtgataggaggcacaagcatagcttgttgctcgttgggttctccaaaattttgcgctcaacattgcaagcaagcatgaacaattggcctatatgattatatgtcacattaacaagcccagcctgaatattggaattaagtcatctgaaaaatctagtcattgtgttctcattagattcttgtaaatcactataagtgataccaattttaaaatcatgaaagtactccctaacagttttgtcaccttattttagatgttcaaatttctcaaggagagcacgtctatagtatgaaaacacaaatctttttctcatcagtattttgcattcatcctaagtttcaagcttatttcccacagtatgccaccaaaaagacacagaaccggtacacttattactagcagccttaatcatttgagcattagaaaaatcatactcatcaaattgtttttctactgctagttcccaattaacataagcggcggaatcatacttaccatcaaaaccaggcaatttagattctacccttgtaagatcattatcatgtacctcatatgtgatgcgtgaagaagtcgctatatctcgttgatggtgaagatgttgacgttgagcatgaccatctcgtttccgcgggcacaatcctgccatggttagtagcaaacaagaaacatacacaaaaatatgcgcgttcctattaactactagatagtggcagctcaaaaatcacacaaactcaagcttttaactaagctcttacaagatcttaccaaggcaagcggaatggtgacatacaccgactcaatcaagcaccccaatagaggttggatgtatcgatgccttggcaaacacttgctgtacggctgcaatcaaatctgtggagctctaggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtatttttgtgaaagcaaactcaaagatacaactgatttttctcttttctttctttctttttctatctttttctttctttcttttctttttttctttttttttggtgcggcttttgttttctttatttttagcacctttctgcattttttttctttttttttaatttttttttcagcaaaaaccaactcaaggaccttaatgcaagattacaaggactcaactataaatatacaaattacagggactcaaatgcaaaagtgcaaacccaaaaatttggactatacaaaaatggaatgcgctcatcccataggttctgtttttgcaaacagatctcgaaaccgacactaaacaaaaattcaccaatgtgtttaacacaactcggaaccgaggaaccacgtgagagagggagggagtcggactcacaggatggcgaagatagagtggttcagtcctctgtgatatggaaggccggacttgtgtaggataaaaacagaaacttatttttaaacgatccaatctactatttccttcctgatcaatcttgcatatttccaaaaccgattcctccccacaagcacgatagaactacagactcacggccaaactacaaactcaagcaaaatctagatgcaacttcaaaactgaccgacagaaacttctagaaactacaaaaatagaaccgtggcagcgagccgattccattttcgtaggtcccgacaacaacagagacacggtggcagcgacgactgtggtacaaaacgtgaccagaacttgaaactctaaacgaactagacgctaagaccagcaacacgacgtgacgatgcaacacaaaattcaacaaagcaaaaattgaaaagaacaatgcaatggcacaatatggttaggtaaatgatacgaatttttttgtatggctattttctggttataggaagatgaagactcaccgagcaacgaaagctctgataccacctgatgaaccctgagttccactcggcactcaagactgttgttggcccgatctttcggtgagttgagataactatgatttgggagaaacattgacgatccgactacaaccgtacaagacgttgtgttcgcctttgcgatcgatacacctctccgtgggttgttgatcttgccggtgcagatcaaccttattcctacaagtaaatcgaagaaacaagcaagaacaagataaaagcaatctgaattgcaaataggaatgaatacacacgataagttggggtttcgaatacaagcagacggacggtctagccgacacgcgcgctgcaaggaagtagcaatggctaaactttcatctaaacaaaacccaataaaccctgaaggggtacctagctatatataggggtgggaggatgacctaggggtgcctaggggcgtgcttcacctggttggggcgcaccccacatgggccccacctgagctggggtcccaaatgaagttacaagcccataggcccattataggtgatgcagcaccttgtgcctgtgattccggccacacgagatggaattcggggatgaggctggatccgttggaaagaggctccgagagctttccatcaagtactcacgggctgaaaacggaggtcgtatgcagattcggtggccgtttgaagtcagcagtgtagtaggtggccgaatcagattccagcacttggagtacttgatctcgatatcttcttgttcatccatgatgtgagcaatggttgcatccatggtagccatggtcacatcataggaaatatgaaactggagggagtagtttacaacttccacgatatagcactcttgtaccgcctttaatatggttgaattcatggttttcgccatttattgcgagtaatattcaaatgccgtggttctgttcactttggattgtgtttcatcaagtagtaattttttttcaggtaaaattatgcctgcaaaagaaagaaacttttctcaaaggtttatatgtgccactgcaaaacacatgttacaaccaaattaaccattgcatgtagaagcagtcgtaacactgctacaacgcatgcaactgacaaattaaaaaaagcaatgaaacgagatcaaacgcttaaactaaaactaaaaagcacatcatcatttggatccctcctaatctggatgtcactcgggttgtagaacacatacgattgaaggcaaacagagttaacatgaccaacactgcaattacatagacatatgagcgtttagtcatatgtgccaccaacactgtcgggtttgcctggtcagagagggaaagtagcagaatgctttccccgtttcccgggttgcgagaattgggattggatgaggccgcgaagttcccaacacctcccacgcctggatattatcacaaattctcgcaatggaaatgcatgctatatatcatataggttcttttttatttcttcggctaacattcttaattagtttgcgagagaaatttccacatgtataagagtcacctagcatgcagtccacttgttcctaagctaacatggacaatttgacatgttgcaagtccttggctacctcttgtagtcttgtaaacaagctagtgaaaaggttcattctaacatatgtttatagcggtagtcaaaccaaacaattccaaaacaaaaattaccagttattacatgaaatagagggagcagttaagggaaattaaaattgcggccatcaaatacaataggacacgacttagaatcgggcgcccgatggggaggggggaaaaatcaggcgctgacgtcagcaagacgcattcgtgcaaatcactttaaactattttttctcttaaattatttatccaaatcatgatccgattgcaccattaaatttgttgcaattaaatctttaaaacaagaccacacatggatatattccgacgaaatttttttagcttattaattattgaattatttttaaatgttgcacgatattccaccaagtatattggaattgtttcactaagtagatcgaaaatgtttcaatcgtttaaatcgggcgttgtttcatcttatataaaaacaatgtttcagcaaatagcaaaaagaatgtttctgttcactacaaccttagatctatatatagtaaaacattgtgagtacactaggtgaaacatttttggtggaacaaaaaaaaacgaattatcttaatagagggtttccaaaatatgtgggtgatttgttgtaaaagaatgtttcaattcactgcaacattatatctatacatagtgaaacattgtgagtacactaggtgaaacattttttgtggagatacatggtggggccctaggggagcacatgcgcatgggggggggga

SEQ ID NO: 48229 - DNA, 3097 bp, Oryza sativa
cgtcgtctcggctcattcgtcttcttgccgtttctgatcactgtgttgtttcatggattacatggatcgattaagatcttgcacgaccaactccgacgaggatgacatggtgatcgatctatggatcggaaaacaataataccccttcgcgaattatttttcctggacaaaaacacccctccacatttctacttccactaattctggtaggagtagaactagatcttaaccctacaattaaatatgatcaagggcctagattactttctactccgagtagaaagtaccggagtaggactcctgtaagtatatattgcaagtatagtgtaacgtaaaagtcctaaggtcttatagaaagacaagtcaccacttccatcatctctcacaaaggtttgattatgttgagcaagacgagagattataaccatgtgggctgtgcttataataaaaatggaaacagaagatttaatcagtggtcgtgtatgcgcgttggaatcaagtatcgaaaactttgttgagaagaaggttgaccttgttagtgaaccgaaagtgggtctttcattcgactctctacaggaagcgtacgatctctacaatttgcattcctaggaggttggttttggcatcaagtatctaaagtagtgatccaacaaaatagatataagtatgtaaagtctaattttgatagtacattgcactactatagattttttagaccattaaagacaagttattcttcaaagatcagaactgttcgcaataagaaatgcatcttcaatggttgccatggattttgttaatgagtaatccctccgtcccaaaatatacgtattttggacttcgacccagtcttcgagatgctaatttaacaaataatatctataaaattaagatgttttaaataaaaaagttgcatattatgatagtttgtttaatgataaatctagtaacatcaattttacatgattgatctttttctttttgctattcatttttttgctatcatagttaaaattaaaaatgtttgacataactatgctaaattttataatttttttgggacataaggagtaataactattggtgagaaaaagtatgctggtgtgcatcgttgcaggtatggaagaagtgtaaagtatggtgggacagataaatcagtccaggatctgccatgtgcttgtgcggtcagtaaaatatacttaaaattgattgatgctttgaaattactatgttttcgacaagtgatatgcaccagtcgatgacaggtatgcaccaatcttatgtagggtaacatcgaaaacagattgcaaggctcttattaggctgtaccagtgtaccgtcggcaggacaatggatggtacattagcgaaaacagatcatagcataaccatccgttgtcagaaacatgtggtgagagcaagcactggagctcccataagcacatagacatacacaccaaagagctcgtgagacatctcagaagcattaataatgtgaacctgtcaaaggtgtactgcataactgcaagtttttttgtttcaatgcgtgacgttccattcactaagagatctctgaagactctttgcgatcaaatatatatcaaaggaacaatcaaatgatatgatgtgcaagaaaacattagagttgttccagaagttgaagaaagaggaccctgacttgaagtacactcttgaagcggatagtgatagcaggattcaattgattggcgattagctttaactgccaatgcccgcaggaccagcatcgatcgacgaagccggccgattcgactactgcaacacacactgctggctgggcactcggccgggttggcccaagtagagtgtcgatggttctccgtaggctttgtgctagagctgtgagagcatttccccgattaggcgtgccgtgccttggcgatcgtagtggttttccactgaagtgccatggatgagcactatgagtacccacacgtaaattccctatgcctcctactccctatttctctataccccaaaacacaagatcatggtacagtgatcagccatgtatgtatatcctgttagtagctataaactctcatttatttgtatgggcagtgaaaatcattaaggatgtctagcatctacacctgaacgactagcatgtctatactacccgatcatttctcttgcttatataatgctagctagctcatacgtgagttgggatgaggaagaaaaaaccaagtctcaacaaccatgaacgaaacttaatgacatgatcagtaccggttatttcggcttccagtttaatttctggctttgacctattgtgaacaggccgaaagcaccatgaatctgaagtatcgcactccatccgtgggctgcaatccaatccacctattttttattactgttttttgactgagctgattgtctaagaactcagcttcctgtgatacactaatacaatttgggcactaattgcatgatttgattcatctaaaaagtttgtcgccacagcaagggaggatttgctaccaatgcaatggctaaacattccaatttattataccatatgcaaaacaagcgtagtttaaacctcacgaacacctttcaagtttttactctatggtcttcccttgttcactaatgatggcaatctgttttgaggaagcgacccgttaagtctatgtaaaatcatgggcggcaaaattaacacctaatagatgctcacagcttgggaaaaaaaaaagatgcagatacataattattagaaccggaccggaccggcagttggaccggaaaaaaccagaaccaaagcctccgccggtctggtctagttaaaagaccgtctatgcaattgggttggtataaaccggttgggccacccggttttgtaggaaaaccgccaagaaaatcggagatgaaccgcccggactgccttgtgcaaggtggtcacgtgcgtacgggggcagttggagagagtaaaatgtgagaaaaaggtgcgctagtgggatacgaacccagtaggggtgggcgttcggtcagaccgaaaaattcggtctcggtcttcggttttttggtcagtttggtctttgaaaacttaggaccga

SEQ ID NO: 48230 - DNA, 1098 bp, Oryza sativa
aacaacttgccttcctggcgaggggaccgtctggatcgatcgcgacattccaggggtatgagatcaatgggtacacattctacacgagagctcaagacatgatgagcatgaaccaaaacagtgctgttcgtgtcaatgccatgggacacgatggaacaactggcacgtattaaggtgccatctaggacatatgagaacttgactatggtcctctcaaggtccctctgttccggtgccaatgggttaggttgactggtggaggcataatgattgatgacagtgggatgacaacggttgaccttaacaaggttggatactcggacgaaccttttgtccttgccaatgatgtaacgcaagtctttttcgtgaaggacatgtctagcaaaggaaagaagggcagagggcctgacgagcctaagcgtcacgtggttctcccaggcaaaagaaaaatcatcggagttgaggacaagactgacgaggattacgatcagttggatgggcaaccccctttcacggtgacgattgaccctagcatcctcctatcaaataaagacacccctcactcacatagcgatcacaaggagggaacaatagtgaggagaaagtatgtgcggtcaaccgtcaccgccgatgtattgccgtaattattgtgtacacgatgtgaactgttttggatgtattgattatccatataaatcaattgatgtatggcatatgttaattacgcacgattattagaggttttaacaagtttaatcatgtgtatgctagttatatgcgatacttacaatttttaaaagttttaaatcacgcaggtggcaatttcatatgttaattagagtttttaacatttaatttactatcattctgtagcgcccgttccgttgtggcgcctagcgggaaaactattcctaaaaaccctatttgcgaaatctgtttctttgcttgctgtctagtgtccgtgccatctcagatctcaaatccacaatctatcgtcgagttcaatcctgaatccaaatccttcccaaatcaatccctccgcaaaagtctatttgcctccctcgggttcgatgggccgaatccctctcggcccatctt

SEQ ID NO: 48231 - DNA, 986 bp, Oryza sativa
cgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcataatttaatttactatctttcatatgctacttatatatgactattcgaatttttaaaaggttaaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagccaaaaataatttttcgaagtaattgtcattaatctttgtactttaaataatgttaatgcattaacttctattttataaacacatatgtaagcgaaaatcatatgcagtgctgtaatctttagtcccggttcttaaccctaaccgggtttaaaaagaattttgaaatagcgggaaaagatatttactcccggttgttgagaacaaccgggagtaaagatccgggggtatatatattcccggt

SEQ ID NO: 48232 - DNA, 1874 bp, Oryza sativa
atcaagtttaagttggtgcaggtgcctaagtttacactgagagaggtgcacacatggtgaagatatgtgaagtatagcttaaaaaatttttttgaccagattcctggtaacccccttacatactctacctccgcccgagtcataggcaggtgcatatatatatgccattgagcaacagccacatatgctgattgtgattgcttaattacaggataataacagaaattactgtgttttcaaagcagaacatggctgttctttgatttaaaagtgtaccatatatataaagaaattcccccgttacaatatgcaggttaaaaaggtcgatgctgctgatcttctagcattacagatactagtaaacgtgaacgtgcaaggcacgtttcccacatcatgtcacactaatcatgtaaaatcacccgaagattattgcttttttccacaatatatatcacacccaacatgtgaacaaccaaagttcaaaaattacatatatattgtagtgtaaattgcaatatcttaataactctttgcaggcactttttgtaaataccaaaggtcaaattagcttcaggtaagactatacaacacatacattcatcctacaacattctctagtttgtcaaaagtcatggacgtgacatgctttcaattaaatatactgtacattcttgcatgtatcaatagagttattcaaggtagctgctcgtcctgccacccagtatgaagggtcagtttttactgttggtgtgtgttggtgtgtgatccagctccttctgtagcatcttgttacattttctatttataaaacatttagtcaaataatgaaatggatttcctatggttaacatcaatgaaacagattggatagaaagagaatgcttaatggtatggttaaactcatgaattagcctgcgaaaatgcatgaaagagaataactcaatgaacaatgtacttgaccatgcaaaataggactgaaagttacccatatcaagaccaaataatggatcaatgaaaaattgatccagccaacattcctgcgtcttgccatgttttttacatgatgacatggttctcctagaactgcaactgtatatgctgcttcacgcccatggatagccgcaatcaaattagttaccaaaccatgtgaaatgtgcaccaatagtgattcttcttcataagaagtatatgttgattcaattatctgcaacacacattcttctctttaaaagaaagcacattcaaacattatttatttgtggttcccattaaaaaaaaatgtaactcatgaaaaactatgtttaatagaggataacccggcacagattgtgtcataacaccatctagaactacatactgaaagaacctagctagatctacatactaaaaagcacctttgtgctaatatatatatatatatatatatatatatatatatatatatatatatatatatatataacagacttaatctctttatattttgctaagagagtaacttccagcatttgaaaaaaaaaagtatatatatatatatatatatataacagacttaatctctttatattttgctaagagagtaacttccagcatttgaaaaaaaaaagtatcttgcctggcaaaataaatctgtagataatataatgtaaaaggattaaatctggtaaccatttgatcataccacattacatagtagtagtatttcatagacaacacaaaaaaattcagctacaatccttatgggtttcatccttgtcaaacttagtgtcctatactttttacaaaaatcattatcctattgctgcctctagcaaactcaaagtcttgtactatatatgctgctgatgaccgaacaaattcttgagaatgtcaag

SEQ ID NO: 48233 - DNA, 718 bp, Oryza sativa
ggtgtgaggcctgtatgtgctcgtgtgtggagcctggtcagggctaagggcaccaatgtgtgacgggagagattgttgggaatagtcccacattgaaagtttagggggagtggcaccaacttaaaaacgggaggggtccctcacctcatgagctagcttttggggtgtagaaaggctttctcccggttttgagccaacaatgctcgccgtggggtacttggcatgcttccggcgctgagcagagcaacggctggtcggagcaccaccaccgcagcggccacccccgacatgacggagcccatcacggtgaccgtggcgaggacggacagcgagacaaggacgtcgccgtcaagcagtcagcagtcgcactcgctggcgatgatgacaggcgaaggcaacaagctggtgttcctcgacagcgtgccggagcggccgtacgacctggacacgctgctgcgcgcgtcggtcgaggtgatgcttgcgcgggtggtcgattacgaggagtgcggcggcggcggcggcagcagcgaggtggtggtttgctctggtggtggagagaggtaggaggggagtgacctgatagtgggccccaccgacttttttaaatgaattgatgactggactgccacgcatataccacgtaggaccgaaaccactccggattgagttaagagggttatttgtccggttttaatagttgagggtctaaaaggtctgg

SEQ ID NO: 48234 - DNA, 1121 bp, Oryza sativa
atcggcggggtgtctcagcatcccgtcatgttgacgctcttcagcgtgccatcgcaacattctagcattccccttgttcctgaacaaacaccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccacgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactctagagtggtatccaactttttgtgcccctgctcgcaacctgggtacaacgaagttctgtggtcctccaacatcttgtccaatttatgggcctccttttcactttcgcagtctccctggcgtcctgcaacatctgaccaagatcatccgcaacgtcgttaccatcagcagctatttcctcctcgcccgtttgatttccttcaaatccaacaaactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcatttt

SEQ ID NO: 48235 - DNA, 17445 bp, Oryza sativa
  unsure (1)..(17445): unsure at all n locations
atcatgcgctgtttttcgtcaatatgtatacagtaatgtatttgcatctttctgtaccggtctaggtcgtctatatatggtgtatatctccttgttcacacatgatataacactagtagaaataaatagggactgcatcactttctaagaacccacaaaatataaatatctccaactccagcaatatagagacttgctatttatttctcctgtatttctacttatactatgtctacgtatagtttaacaccttaagaattcaaatatgaatatttctaatgttagatttcaaccatattcaaattcaaacgtcataatagttaaagttcgaatccttaaaggctcaaacatgggaaaatgggaatgagaaatcctgcgtactaccaagtatccaagaactatagtcaatagataaagttaactctctatacacttttccaatacaatctatctgagaaatttttttttaaaaaaaaagctccttcaaattaatcctggaaaataccctgaagttataaatcacaatttgagacaaaattaagaacaagactgaagaatcattccaattaattccccctctacctcataaacttcagcgcatgcagtgtcaattttagaaggtcaaaagccaatacatggccccgtttagataacacccaaccatcttcaaataatgaagcgtacgtatgtcttgctgcaggaattgaacaaattaacatcgatgattcgaaagctctgaacggagctaaaacaacatctctcatcaagtttaaatgttctgataggacttaactgagcagtccagtttctcgaaccacttcctcctcctaaaatgttacggagtagcatattttaggtggacacacgtattaagaacgtagatgaaaataattggttgaagattgtgattggttaagatgagaaagtcgataaagaaaattaaatgaaaaataattgtgattgattgggagaagatgataggcaaagaaatacctttattttgggacagacattcacttacaaaacaccttatatgtaccggatcataggtaccggtttattcaaaaccgacacctattaccatttcccacctctttaggatgaaaattttagataaaaactggcacctataggtgctagtttgttaaaaaaaactagacctatgcttatattataggatttggttatagctagataaaaaccaacacttatagtagtactacttttttttaaaaaaaaatcagcacctataataaactacaggtgcagccgaaccggcgctccaccacgagccgcccctcttctccaaaccctatccactccccttgcccacccccatcgccccatctctctctctctctctcactcactttgggccttgaataataatcggcatcatgatgtacttttgcttcatgcacaaccaagggggaaggttgtaaacacatagggtcacaggccaagcagtggcggatccagaaaatcgattcattggtgtaataacgtgtctattggtgtcatagtatgctaattatgcttagatcatagcgttataatatatggatgaacagttttgctataggttttgctgaaagtcgccggtgtagcctgacactggcccttatactgtagatctgccgctgaggctaagtgctacgaccgctactcatctctccaaatggattcatgcgattcgtactaaaaccgaaccttatattccttgcatcattaccgaagtcctcaaatattttgtcgatctttcgccactatgacccgtcgacagggtgtctcaacatcccgtcttgtttacgttcttctacgtgccacgcatcattaagcatgcgctttagtcttgtacaaatgtctcagacgtggtattatagggaaataccacatcaccttagcaggaactctcttctttgaaggttgtcggttaacttcatcggggtcatctcgtctaatcttgtatcgtgatgcattacaaaccgggcatgcttcgaggttctcgaactactcaccgcgatagaggatataatcgttcggacatgcatgtatcttctagatttctagtcctagagggcagactaccttttaagcttcatacgttgtttccgacaattcgtttccctccagaagaatattctttacgagtttcaataacttgccaaatgccttgtcagtaacgccattattttgccttccattgcagcaattccagcgtggtacccaaccttttgtgccccctgttcgtaacctgtgtacaataacgttttgtggtccactaacatacgctccaatttttggacctccttttcactttcgcagtctttctttacgtcgcacaatatctgacctagatcatccgcaccgttgttttcttcaacagctccacccccatcgcctgttgtatctgcaaatccaccgtattgagcccagtctggaacgttgtcattttcttcatcatcttcttccattgcaatcccaaagtctctatgcaaggtccaacaattatagctaggtatgaattctgattgcaataagtgggtatgaagagtccttgatgcaaaatactctttctagttttgtactttttgcatggacaatatataaaaccttaggcctgtgggcattggccacataaaaaataatgtacaccatcaacaaactccttcgatcgtctatccgcggtatgccggtatacatccattgccaattcatctacatcaaataaacaaatgttaaggaaatccacgaaagtgaaaataattaaataatcatataatatttaaaacatcataattaaactcacaactgaagtcacaaatctctctgactatttctttaagaaaattgtaaatatgcttttccatgtattatccttttaaaaaaacattttacaagtttttaaaaaaatgaaaacatatttttaatgattttttcttatttctaactattttaatgtgttaaaaatggacttagttttctattttttttcttcattttctacaattttcctttgttttatttttttaaaacatttttatcaaatgtgtcttattttctccaaatatttttctctccctctttttccatatacttttttgagagataatgacatataaaaacatagctagaaatgtaatatgctaatcatacatcaatacagaataaaattgctaacctttcatatcccttcgatttgtgtaatatcaccaaattattttcacgaaaaattttggcaacacctcctttccttctccaacctcttggcagcaatgacacgggccgaaggaggaagaaggcatataatttttagtactggttggtgttaccaaccgataataaagatcatatagtatcagttggtaacaaaagagcccagggtgcttaacatggtagtactgacaaagttcaaccgggactaaaaacaatctttagtatcggttggtgttactaaccagtactaaagattgtattgtgtcgtgagggttattaaatagtactaaagacggcatctttagtctcgattggtaatagaatcgagagatttgtatttttgggaaccacaataaaagatcagttctccggtagggaatgcgggacacaggcactatgcaaacgccaccacgtggcaaagcatatgacatgatatatagaaacattaattaccctctattgatacatgtactctctccatttcatattataagattttctagcattgcccacattcatatatatgtcaatgctagaacactactacatgaaagattttcttggacactagacccttttgtttccaggcggaccataagtgcaaccgcacatgaaaatgagggaagggcgtcgggccatcgcccacacaggaaaatcatttttcgtgtgcggatcacttaacagacccgcacaggaagataagcctattttcgcgtgcggttgttaagtcaaccacacaggaaaatagcccaccccaagtgctgcccatcatcccatcttcctcttatcctcctctccatcctcccatcacgcgcgcgcctcactcatttatggtcctccccatcctacctatcctcactgtccctctcctcctccccatcctcccatctccctctccctgtccctctcctccccggcaacggcggtgccctcggttagggcggcgaaggtggtggcatcggcgggcgtggaggcggcggcatcggctacggtgttggcggcggagcggatctgtctccggccgccgcgtaaaggccagatccgttgccagccgccgcgggaaggcaagatccgtggcccgccgccgctgggaggccggatccgtggcctgccaccacggggatgtcggatccgtcgcctgccaccacgaggaggctggatccgttgccggcgaccgcggggacgacggcggcaggcctcaggcaaggtggcgatgacgatgacaggcctcgggcaaggcaacgatgatggtggtggccgtggtattgacggcggctaggttagggcttgcgggtggattttgattttttttgtttcagttttttatttttcccatgcgggcggccaaagcgcccacacgcgaaaatcgatttccgtgtgcgggggcgtcacccgcacaaaaaccaggatttttgcaaacgttgccttccagacgggtggaagctccacatgtgaaaatcaattccacccgcacggaaaaatctttcatgtagtagtggaaagtcttataatatgaaacggaggaagtacctatcatgtgtttacatgattcacgtccattaattaccctctattgatatatgtacctgtcatgcgttacatgattcacgtgtgtatgaacacgggagaccaaattaagttggcagtttgtcctttttacatcatctgctgctcccagttaaatgcaaaatagttcgtttgaaaaccgcttgagattgaaatatctgtaatggcatacatttatatcttttagataatgacatacatcctctcttactataaagttacaattaatccactaaatcctaaagcttaccatataaaaatgtcacattattatccactaacaatatgccaaatcaccatccactaataattactctctcggttccatatataaggcacaactattttttttggatgttccataatataaggcatatatgcatgtataaaattaatcaggacctcttctccattaaattattactttttaaatcctccaccctcaagatctctaattctattggatgcatgcattatatttattagggtgattcaaactaggatatgataataattattttttggtctttgcgttaaaggtggtcgtgccttatattttggaacggagggtgtattatatttaaacatcatacaagcatgctatattatctatagttttatattttattaaattttagagcttttaaaatgcaaacatgctaaatcgttattccacataattcacataatattttaatatatatatttattattttttataatatcatatatacctgtatagttcattctcacttagttaatgttgtttctctcttctcttattaagcaatattacattaattgtttttagtccttagatgattaattaatctatgatccaaattatatatcttcttttttctctcattaagccatatcacctcaattgtttatagctgttagatgattaatctatatggtccaaactatctccttcgttttgttctcataaagccacatcactttacttttatatttatatttgaatcattattctatatactatttaaatttaaattatcataaaccacatcaacttacataagcttatattatcttgctatcttatatattatttttacttattgttattatactaaaattttataacaacacgcggagtttcacctaatttatatagattcggaatatgtgttcacatagataaacggcatgcatgccattgatcatcttttattaatatttatgcgggtgacactgggtagaaagcagtgcccaacataattattcagagatttatataccatcaaggtattctatcttacctaggatattttaaccactacttcatataccacacactactacaaaacatcacaacagtgccgccaatcactgcaggttagttaaaaaccgacgctctctataaatcaatgactgttaattagactgtaaaaaaaacacagggatcaaatgagagagacatagacttaaaggaaaattttcaagagataaaatgcacgagaacacatgcatgtttcctagtttttaagaaaattgacgcaaagttacttttgcgaaagctgaatgcttcaaaaaaaaccaaacggccaggttaatatagttaatttaggaaaaatgatgccatattaatgacttaaaatgaccagtaaaccttttattgtaacagcagttgcttcctaacaaaccaatcatacagcacagccacgccagtagacccagccaacattgaagagcttgccgatgatcctcccaagaacaccagtggtggcagtgggaccagcgtgttatcccgacgagctaccttgacagtgacctatggctgtgtttagttgagggggaagtttggattttggttaaaattgaagatgatgtgactgaaaagttgtatgtgtatgatgggttgatgtgacggaaaaggactgaagtttaaagtttagatccaaattttgaatctaaacacagcctatatatcattggaaggcgttggtcagcacaacataggtcacctcagctgggccataccatgtgatgaccgtctcgactatggcactgttgtagtcggtgaagtcacaggtgcaggtattgcagaatatctccccaacgttatcttcctcatcgtcatcttcttcttcttggctaccgtcatggagattgatcaggtcaatgccgacatacaccgagatggcaaaagatgggccagttagcacgaggttcccctgttttgagagaaaacataacccaattaaaagtggtttaagcattcttcgaaagcataaaatttacataattttcacaaaaattatattgaatcccatgaaaatattttcgagagttaatttcagtttggacccttcttatcgaggtttaacattggaccttatttactccataatttcaccttggacacctttattttacccttagtttttcctctgtactcccttttattcatactcaagatttgtctcagtgtgctacaattatctgcaccttggtcatacttcacactcatcttgtctcgttacgtccggaaaaatacaaccatttttttaaacgcttattgtattaatccctgtcccatgaacacgccaaattcctcgctgttctactgctgcctttctttgtttcctctgtttcttctcatcttcttactctccaagtcttccaaatcgccgtcgttgcggcagagctcctcggtgcactagctctaattttgattgcctccggttagttttatggtgatgattcactcggcttcttctttatggactgctcgttgctgctgattgatctacagtgctgcttgatcaccatcgatactgtaagtatcatgtattcaacatgttcttctactaatctccaggcatgagttgcatcgatctagttaattagtgattattgcattttctataatttagtatatgtgcaaaagctatgcagggtactgttcatgtagattatatataatatcattgcaggagcctaattatcgactcacttccaattatgtccgatgttctatgcattgcatgcaacgcaattgtttaccaactagtgggaagctctgcagtattttcattcatggattcttctattgactacttttgttattgcagcagtagattacgttcttaattttgttaaggtcattcgcgatgatattaattcatgagctccgtttgatgcgtgtatggcatgtttgattcgatcatttcaataagctgcttaaaaattgattttttttagacacaccccctttattttttttcaaacgggccgaaaaaagacccatacgtacaaagattttcgaggtggccagcaaatacctgtatgtgaaaattaattttcgtgtgcgaaccttgtgatatgttcgcatgcacaaataggtaaattgctttatttgtgtagacaggcctgttaagaggcgtgcctagtaaaaaatcaaccgctcaatcctctccccctcttcttttctctcctctctttaaaaaaaaaaatctaattccccacttctctcctctcatctcctcctttttcaccagccccctcctccaccggctggccacgggagcagcaacaacggtcgtgatgaaggcagcgacaagagcggccacgacgcccggagggacaacgatgtgagccgcggaacaggcttgagctggcataaatggacccacgatggccggatccaacggcggtggccttgccacagttggatccagcggagatggcctaggatgacaacctcaacaatgacgatgaccccgactgtttgcgcgtaatggtagcgggagcagccaccgagcgccttggcagctcctcctccactaccactggcaggcttgcaaaggccggatccggcgctggcgggctcgcgacagccggatcctgagaaggtggccccgggtcgatgattccgattgctagcagcggtggtggctagggtttcttgaccggagggcatggatcgatggcggcatcccctagatctagtgagaggggaaggaagcagtggagagggcttcggatccaacggtggggtcgtcgtgttcaccccgatgaaccctgtttgacagtgacccatccttcgacgacgttggtcagcactgcgtaggtcacctaagcggggccatatagcctcgattatggccatgttgtagtcagtgaagagaccgttgcatgtattgcagattatctccacctcgttctcatcattatcttcattttgttcgctaccgtcatggagacaatgggtacagataacaggggcatatgccaaggtggcaaacaatggactggttagcatgatgctgccctgttttgagagagaaaaaataatccaattgaacctagaatatgcattatttgaaagcatcaattttacaagatttttaaaaaatatatcaaatcccacaaaaataattttaagagtgaaaattcagtctggactccttactgaagttccatgttacaccccctttagcccatactagaaaattggctgccggttggctcgccttgtagctagcccgtccatatggctttaaaaaaatcatttaatcaatatagcctcttatattgctacatcgatttctattttgttgtaacctatagcaggtagtatttttccttgtcatatgctaatcaccatctattacatatatgcaggtaattttcagggcaacgcactggctccggttttaggcaagctacaaagatgtgagtatgatggggagttcctaaaggttgcatgccgcaggttggagtcaatgcttatgtaactatttgctaattatgggtgaaggttaacaaatagacttcaataaatgtgttcttcttaaatgtgttcttcttattttggctaggttacctttgtttactcgtttctggggtgctactttgtaataattggatgtaactctttttaagcaaatgctgggatgatatattctattatcttaaaaaaatgcatattggctctgcgctagcttgttgcaacccgcagggaatggggttagaccggctgtgctgtgctcgggtggagcatgctaaggtatagctttgtaaaaaaagaaaaaaaaaagtacgaattacccaattacagtactagactattttaaccctaaattttttaaactggataaattacctcctataactcagctcgaagcggttttaatcttagtctcgaagcggttttaatcccacaggcacacaagtggcagtctaatcgataaaaataataaaaaatagtgggccccgcttatcagcatcttctctcttttgctttcttccacctccttcccctcccatccatctctctctccagtcaccaaggagcactgagtaatggcagcaacggcatcaccaacgcgggaggagaggagcagcaggtagcgtgcgtcttgcagcctcaacggcacgcgctaggggtggcggaggacggcgcgacagtctaggcgagggcggcggcagcattcccggcggcaggcggcaatggtgtgcgagacgagggcggcgaaacgggatgcggcctcggcttccatcaacacgcgggagctagggcgagctccggcgctgaacctctccggtaaccggctcaccggcgagttactggaggggttcttctcgctggcgctgctcgagaaggtggatctctccgggatgccggcgagcgccttcctcggcacgacgctctgcggcgccctgctcgccccgtgcgccaaccccgcgctgctgccgtcatcgctcgggaacagcaagggcggaggaagctcacccgtggcgcggtcatcggcatcatcctagacgtcgtggctgtgctcatcgtcatgcttgttgggaatagtcccacgttgaaagtttagggggagtgacaccaacttaaaaacgggaggggtccctcacctcatgagctagcttttggggtgtagaaaggctttctcccggttttgagccaacaatgctcgccgtggggtacttggcatgcttccggcgctgagcagagcaacggctggtcggagcaccaccaccgcagcggccacccccgacatgacggagcccatcacggtgaccgtggcgaggacggacagcgagacaaggacgtcgccgtcaagcagtcagcagtcgcactcgctggcgatgatgacaggcgaaggcaacaagctggtgttcctcgacagcgtgccggagcggccgtacgacctggacacgctgctgcgcgcgtcggtcgaggtgatgcttgcgcgggtggtcgattacgaggagtgcggcggcggcggcggcagcagcgaggtggtggtttgctctggtggtggagagaggtaggaggggagtgacctgatagtgggccccaccgacttttttaaatgaattgatgactggactgccacgcatataccacgtaggaccgaaaccactccggattgagttaagagggttatttgtccggttttaatagttgagggtctaaaaggtctggttttcgagttcgagggggtaattcagtcgtctacgatagttcaagaggtaattcgtactttttcctaaaaatacaacgctatgtttgtacattgacttagcataatatcgttgcacgcatcatggtattgataggatcatcacttcaaatgagttcacgcgcgatttgaaattattaccttcccatatatatgattgatgtagcattattatttaactttactttttctccattttcttttttactatagcccttttgtgccttcagtatttttgagttagtttataattttctttggagatagcagtgctgttattttattggtgtttcaaagtttggtagggtaataaacctttgttacatagttgtacaatgtatgtatttgattttttttttagaaagtggctaagtccataccagtttgtttattagattatatatgctcagatttttgtaataaaaaatagtcgtgacatccttttaaatataaaattttataattttacacttagctttctttacaacatgtaggagtgaaatagagcaagaaaagaataataaggaagatagagggaaaaaaaaagaaaggggggggggggcaaggcaggcccaagacaaacaggcccagcacccgtctcctacctgttgggccaggcgagctgaagcccacgccccagcagcagccagtttggctctagtgcgggcgtagcgcgagcgtttgatgaagcggtagcacgcgttgcgcaactattggtgccacgtggcgcataattttgcaagagaacccgtcaattttagaatattagatttttatttttgttttttatacattttttttgtttcactttgaactcctttttacctaatcctcaatgttactctccgtgtgacaacgtaaactgcactctggtgctcatctcgaccatgccgttgcattgatgtcctttgcatacccaaagacggcagggttcaggaaaatgggactaaagtgaatcaagaagatgtttaaaaagggtgtccaaagtgaaaatatgctaaaccaaatcgaaacttgggttaaatactaaagttaatctatttctttcttgattaatatgaatgctagttgcaaatatacgagttcaaaatttttgagtttttcatttgcactataataagaaaaaaagcaatgtacttgtatgtagcaccaataattattggtccggaacaaattaaggagctacacaaatcctgaattgctcattcgccattactagtcacgggaatattaggccctgttcatattatagccaaaataaaacttaccaaattttagcaatgccaaaattttgacaagatggtaatattgttaaaattttggcaggatttcttatgtatttaacaaatttagcgacaacctaaacatagatatttttttgacagcttaaaaaaaaagggtatggttgaaaatggcattaaagtgaacaggcccttagtcttgagactcttgtgtaggtttagactctgttgtacagttttagctaaggcccagtttagtttccacaaaaaaaacttttcaccatgttaaatcgaatgtttgcaactcttgtgtaggtttatcttgtgtaggtttagactctgttgtacagttttggctaaaacccaatttagttcccacgcaaaaattttcaccatgtcaaatcgaatgtttggacacatgcatagagtattaaatatagacaataaaaaataattacaaagatttgcgtgtaaaattgcgagacgaatcttttaagcctaattgctccatgatttgataatgtggtgctagagtaaacatttgctaatgacagattaattaggcttaataaattcgtctcgcagtttacaggcggaatctgtaatttgttttgttattagtctatgtttaatacttcaaatgtgtatccgtatattcgatgtgacacgccaaaacttttcgtctcacgatctaaacacagcctaaattcagagtatgaaacaaagtctgatggtttacgcaggaaagctgatttatgagtcagattctagaattgtggaatacgatgggagtcttacacaggggcggaacccaatggaccaagggggtgcccagaacccggcccaaaatctaaaataccttgttaccctcgtacctagggaaaagtacacccaaggccccttaacttgtcatcgagatacaaaatcgtcccccaatcataaaaccagataccgggcgtctctcaactaacaaaaccattcgctttaggtttctcggtggttttgacccggttttatcccacgtggcggctgagtcagcgtgggacccacgtgggtcccacatgtcaggctatccatgtcagcctcctctctctctctttcccatccttccccttcctcatctctctctctcatttttctcctcttgtccgacggagcaagcgagccatcgctcggcggcgacgatgcgggagaaggggagtgcgttaccgatgcagtgggcacggcaggcccggcgggggaggagcgcggcggtggctcctggaaaacacggcctcgagctcactcccacgcgcttcaaccgcgcgtgccggtcccaggaggctgtcgtctccgatgatggcgacaacggcgacgatggagacgcgctaccaccgccgacaacgacggagccgctccgacgatctaccaccgacagcaacgacggagccgcgcccgcgcgctcctgattcctaaaggcggtgcctgcttccgcgcttcgtcgcccgtcannnnnnnnnnnnnnnnnnnnnnnnggcgacggcagccgtgcagcagctggccgcggacggtgaaggtgacggcgtaggcgcccacgccacgggcccgcgcgtagccgtcggcggcgtaaccggcgttgagctcgttgcagcagccaacgatgtggaggccgggctcggcgatgaggtggttgagaatcgtgaggttcaagtccccgggcacggcgaagacgtcgctgacgcccacctgcacgaggcggtgtgccaagtggcggccgagtgtggtgtcgccggaggcagcggacggcaccaccgcctccttaggagatcctcctccgccggtggtctccattgtccttgttatcgatcgatcttaattactccgcatgcgggcgtatatatatgcatgatgaagagatgatgtgcgtggtggctgttgtaaatatgtggttgtcgatcgatcttaattactttgcatgcgggatttttcgccgccgctgtcctcatccgctcccgctgctcctttgatggtgcccgcgatgacggtaccggccctaggaggttgtcgccgacggcggtggcggcaacgacgacgaagacgcaccaacgcgctacatccgctgtcgccgctgacgaagccgctcctgggcagacgtgctaccgccgccgccgccgacgcgcggacgcgctactgccgctgctgccgatgcgctacagtcgtcgccgccgacggaaccgctcctgggcagacgcgcttccgccaccgccgtcgacagagccgacgactcatctgggtgtgtgtaggagagaggaagagaggaggaagggagaggaggctaacatggatagtttgacatgtagggcccacgtgggtcctacgctgactcagccgccacgtcagacaaaaccaggatcaaaaccaccgagagacctaaagtgaacggttttatcagttgagggacgcccggtatcagattttgcgtttggaggatgattttatatctcgatgacaagttgagggaccttggatgcactttttcctcatacctacagcatagaggcaccacaccctcctctcgtccggcccaaatttgaaaggcccaaccagaagaaagccccaaaaccaaaacgattttgctatatctcactcggaagattttttcttatctctcactcgattttctcacttaaatttacagtgcattttcttgtaagttacagtgtaatttatgaaacttacactgtaacttttgtaagttacactgtaatttttgaatcttcacatgtaaattttaaattttgtattggatttggtctttttctcgaggatatggtaatttaatgttcattatggtgtttcttaattgctttttgctttttattatatctatcggattttaatacaaatattaaaaatctgtgtgatacgattataaaaatcttttgaaagatgtataggtactcccaaaccaaaaattaagcagtgggagaaactgaaacgtccaacgacgcttcccctcgaagcctcgcgtgataccgaagcggtagtttcgattttctcgcctgagtcgcctcaacgcccaatctctctcctcgcattcgtctgacctgtcacctctccccgggaggtcgcccttttctcgccgcctcaccggggacccagcccggcagccccaatcgaagaaatttctcatgtgtaaagcactaaagcctttccctggtaggtttgcctcccttttccaaaattttgcactgattaggctagcttagggcttgcaactatagaggcatatagagatagatgacgggggcaggaggaggatgactggaggaggacggcggcaagctgcaagctagcaacggccaatagctggagcttgccggctggccgctcaccctagcttatcgatctactctgagccccacaaaaattgcagccagcagcactagctgagagcaactgaataagtgaactctttctctcaatttttcttatccttagtttgtagttttgtgccaaaataaacttgaaaatttttatttggtcttaatagattgctatatagcactggatagtacgaacaatatgaagaaatttgttttaatttgtaccaaatcatttcataacttattctcggttgaaaattaaactatattttcaaggtcattatcctatggaggaatgaagacggtgacattcgcatgatatattcatattattagttgatttcttcattatggtacgtattttttatttttttatgtatttcttgtggtatattcccttcaaatgaagaaataatgcttatatttatttattggtatgcaactatttagtataatatcgctctataattatagatgttagtattacataaataaaggtaggaatccctcgtcttttctctagctccgcccctagtcttacatgggtgtcgcagggcggtgggtaggtggagtcgtcagtacggctgcggctgtagatgacgtcgttgcagaagctgatggtgccgcagggcggcggcgcccgcgaagatctccgcagttggtcgtacgcggccagatcgtcgccggtcggggcgtcgctgtaccccgtcgccgccgccatgaatgagagatcgaatactctcgtcgatcgatcggcacccgcccaccgattaccgaatgtatcggggacagtctgcactgagcgaatagtatcaaatcagtgggtagagaaagacgcaaacggaaatcaaaaccagaaggagaagaatcaaggaggaggaagctggagtggaggaggagatcgatcgtcgaaccttgcggcgccggagcaccgatcaccgctgtcgggcgtggagtagcactctaggagagaactagacaaaaaggaaggagagaagatcgaacgactactcgacgaggattgccgggatgcggcgggccggggagcagcgtggaggctggatccgggcatgacgacgacctctctctaggccgcaccgccgtgtgcgtgtgcccctcctccccgagccgccccggccccgccgcgtgcctccgccacgatggaaaatttttaatgtgttttttctacttttgtatttttcaaaagaatttctcaaggaaatagtccaaatatcaccttagactttggacgaaattccatctagaatcatgagttttaaaacccgatatctaaccccctaaattttatattaccctctaagatgattttggatggtggtttttcatattttgaaagcttacataacaactttgaataactaatataatatatttgcataccatcaattgtaagtcaccaatttatactcatacagtgatactatattattattatacactggttcttatttataaatgtgagctaacgagtgataaaaagaaagatttaattaagtggagattttaatatatatatgtccaatggggtgcagg

SEQ ID NO: 48236 - DNA, 5052 bp, Oryza sativa
  unsure (1)..(5052): unsure at all n locations
cgctgctgctcccaccggcgtcgtggaagccgctcccaccggcgtcgccgctagccgctcccgctgccagacctgggcgggaggaggccgtgcgcccgccgtcgaccgctattgccacctcctcctcctcctcgtcgacggttgcagcatcggggggaatggagccggtcgccttctcgtcgttgtcggcggcggcggtgagttggggatggcggttgcgccgccgcccactcactggatccgccgcctccgttgcgcgcctgccgtagccatagccggagctggccctcctgagggtggcgccgccggatgcgctgtccgtcgacgccatcgccgcccagcctgctcctggccgccagcgcccactctcggagagggagagggagaggatagaagaaagagagagagaggagaggagagaaagagagaggggagagtaaaataatagaggggtagagagaggaaatgagttagaaaaaaattgaagtggtgagagggaaaagagagtggagggatatgaaaaaaataggggtggcatttttgcatacgggtatcttaagtggtccgcaattttacatgcggacaacttaagcgttcgcatgcaaaaatcatgcggctttctaaacttcgaatcgaattttataatactaaatgaactcatgtgaaaaaattgtcaaaaataaagctgcaaaactcattgagatctgccaatttgcttttggtcatttctccatccgaatttgattgcactatataaaatttgaattttaaaatataagaaattcaaataatttttcagctagtaaatgatttcaaacggaaaaattgtcaacaataaagttgtataaagcatcaagatctacaacttttgttttggtcatttttctatatgactttgtttcaataatttgaatttgaattttaaattatgacaacttcaaataatatttcaaatactaaataatttcaactgaaaaagtcatcaacaacaaaaacaacaaagttgtataagtcatcaagacctataacttttattttagtcatttcttcatccgacaaagttataataatattgttcaccaatttaacatatatctcatatggttttataaattataagagagatatgtaaattttttgaacaatgttactatcactttgtcggatgaagaaatggctaaaattaaaattttatatcttgatgagttctacaacttttatgttcatgactttttcagctgaaattatctactacttcaaaatattatttgaagttgtcatctttttaaattcaaaattttaattgataaaacaaagtcacaagaaaaaatggccaaaataatagcattaagaacacaataacatgatagagcatgattttaaaaatatttaggaaaaaaccatccaatttggagttcatatgagtaagataaactagtttcaaaatttcaaattttattttcgcatattttcaaattttattttcgtatatggccccttcaggaaaatcgatttttccatatgggcgtcttaaggagccatatgcgaaaatgccgctcgatttttccagacacggtaagttatggtccgtttgcaaatatcgtgagatctcgtacacaaaaatcgtttgtggactagtgtatagagctgttttaaagcgtcagaacacacgaatttgtactccgtaactcattaagtcataggttaaaaaacactcatttgtagtgttacaaagtactccctttgccctataaaaatccaatcatgtatatgtctatatttaaacgcaggattgggtttttacggaacaagggagtacgttgtaactatattctttacaaatgaaaaaaaataatgcaaaaccatatatgtagcgcaaacttaaatattactgtagattccagaaaagcatgtctgagacttatcaacgtcattatgagtacaacaagtagggatacaatttataaataacataatatcggaataaaaaatattaatttttcagaaaaacacaatccatctagaaacacaatgatgacaaatgacaataaaaaagggagaagcaagagggccgcgaaggagcagggcgacagtggttgatgtgacatctaaaaatataaataaacatcaaatagaatcccaatgatgattaagaggagggacgacagccaggacattaggcatctgttaagccgatggttggcggaacttctataaagtaaaaaataaaccacaatgataatcaccatgatttttaaaatctcaatgacaataaaaaggaagggcaacaagtgtaaaaactataaacaaaactccaaataaaatactagtgatgattaataggagagatgacgggcaactcgttaagcatcacaatcacggtggttggcgagacttttagaaagtaaaaataaaccacaatataatcacatttgattttaaaatattcaatgataattaaaaaaaagtatcgtgcagggtgtagaggacttctagatgacggtttggcaggacttctataaagttaaaagtgaacaccgatactaattatgttcgagtttcaaaatctcaatgacgataaagaaaggaaacggacggacagtagaggagtagagtggcggcatttgacgggacttctaaaaattataaaaatgaaagccaacaagatatttaactctaaaatttataaggtgcaattttaaatttccaaggaggacgaatagaagccgtaatagatcgagcatgcaaataaatgggtgacaaaggagtaagaggtagtgataggtgtgacttttaaaaactacaaaattagaaatatggagatgataaggttcagtcttttaaagtccgaaaataatgagataaccatttaacaaattttaagtgaactcatatgtaaataattttgtatggatacttgtcgtgcgattgcgtgggccacctagctagttcttattttatcttatagtaattatcaggtttatactacatattttcccacaaagaattcatttaacacttgatatgtgtgtatacacctatagtaaacaaccagtgaataatacagaactgtaggcaaataatacaaataatttgtaaaattatgattgttttgtccctatcataatttgttactaaaaccagacatagtggttaagtgactagacacaggaccactaccaaaaaaaaaaaaacctcatcggtactgcccaagaagacccatcagggctggttccctgcctggcacaaccatttgggcaccaatgacgccgttcggggtattttgtatgttaagatgccattcggactgataaccgcagggaatattttccagcgcacggtccaggggnanttaactaccagctcggcagcaatgtcgaggcatacgtcgacgacatcgttgtcaagaccaagacaagcgactaattgattgacgatctgcgggaaacgttcgacaacctccgacgatatcgcctcatgctcaatccagagaagtgcacgttcggagtaccgtcgggcaagctgctcggtttccttgtctctagcagaggaatagaagcaaatcccgagaagatcaaggcaatcgagaacatgaagtcgcccacaagactcaaggaagtcaaaaactaaccggatgcatggcagcactaagcaggtttgttgccaggatgggagaacgaggacaacccttcttcactctgctgaagaagcaagacaaatttgtatggacacaggaagccgaagaggcattcgttgcactcaagcgctacctatcaaacccccctgtacttgttgctccccaacctaatgaagaattattcctctatattgccgccacgtcatattccgttagcaccgtcattgttgtcgagagagagaaagtacaacgaccagtctattacgtcagcgaagctctccacgacgcaaagacaagatatccacagatccaaaagctgctttacgctgtaatcatgacatcaaggaagctacaccactactttcaagcccacatagtcacagttgtctcctccttccctctcagtgaagttgtgagaaacaaagacgttgtcggccgcattgcgaaatgggtagtcgagctgaaacaacttctgacgtgtcattcagcctcaatcggccaactcatagattcccctccacctcagcacatttggttgcttcaccaagcacggaaagccaaaatatgatacctgttcctcatcaaaactattactctaggctcacacaatttcgtgtcccgtgccctccgggaagagagaaaggaccaaaggaggagaggcatccacaccaccgagctcgtcgaaaagagagagaaagaggaccgggctagcgctggcgacacagccaccgcggacaagaaccggaaggggtgaagaagggaggagggggaaaggggagctcgacgtcgatccacgccgccgcttaagcctcaccgccgccgccattgttgggggtggaggagagggcgccgacgaagacaggaggggggagagggagaggagctctcggtcaacccgtggtgccggtggaagaggaggaggggaggcgcggcagccggatgaggaggggaggcacagcggaggtggtgctccacccccgacggcgccggctaacctcgtcgtccaacgctactgtgccgccgagctccggtgaggaggaggggggtggtgtgccggcgagcactaggccccaccgcctggctctctatggtagggaaaactgggaaaggaagaggggagagagggggaggggaaaagtgaaaagtaaagtagtagtggtgggacccactataaacatcttgcattgtagaacatgtggctaacattgtttttggtctaggtggcatgcgaagtccaccaaagcttcgtgacacactatgaaagcccttagtaccggtttagaaattggcattgatgcgcatgtacgagcaaaaaagaatatgaagcggcggctccaagaatcggctctagccgattcttcgagcccgcccccatgatccacgttttcaaattcatatcccttaatcaatcccct

SEQ ID NO: 48237 - DNA, 11085 bp, Oryza sativa
ttcgatgaggagaagcagatttgtgtgctatactatgatatgtaccgtctataaaatattgtgtgctctgacgttgtgtggcttttcgaagatctatcatataggtgattgtgtatggttgtgaactcataaaacaacaattattgtatccctccaatagttttgtgttaattacaagtatgtgactattgctggtcaaaattactatttaatttgtgtatagtgcaaaattatagttatgggtcgcaaagagcatggccaaacaatccaatatgctgattatacaatggaaccccggaaacgccaactcacatttcaaatttcaaacgttattgtattgaactttggcaaagagaagcaacattagatccacggttgcaagaggttaaccacacccgaccccatctgtctgatgctcacctccaaatgcctttctgtcggaagaaaatgtgccacacacagatgagcaatggaaaagtatgcaaccaggtagctcatgttgctgcacaatcatgaaatggtatagaattaaaattatcaagtccatttgtcaaataaaagcattggagaacatgagcacagcttgaatagaaccaaatcaaatcagatggtagaacgaagcaaaacggatcgaagagacagagagaaaaaaaaatcatagacaacaaggaacgagggggggttcaagaggtcaaaaaacttaaccatgcttgttgccaaatcccatgatgaagcgtagcttctctgcagtggcatgctaggaaatgcgctaccgtgagctgaatgcttcttctgatttgtgcgacacctaattaatactgcaaaagcattaacatagtggctttggtgttaggctcaactacaaaagtgtgataaagacatcaagctaataaatgatacatgtcgtaaacttgagtcaacggtcatgtaaatttttgccaacttcggatgaaggttcactaatagaattcaataattgtgggtctttcgtcttgtgttggtgcttattagtttgtttcttttctttttaggtaaatgttgctacatgatacccaaattttgtgtaatttgcttatagacattgaaaaacatgtcatggttaaaagacatcctaaaaaacttgtaatttgctatatgaatttttcgacttaattgaaaagataaattgttaagaaagacaagaatgcccctagatcacgtgcttcaaacacaacgttagagtaaaaatttagaaattatgcaactttaaatttagcatcacccttagtacatcactagtaaatattatatttcatctttactctagtctcagctcaaaaacttttgaccatagtttttctagattataaaaaggtaaccacaaatagtcttagactctcctaaacggcttatatataaagctaggcgacattgccgatcttaggtcttaaagaaacattaaagcccaaaaagacatttgaaaacttttgtatctatacggtgaaagcagcaagctttcttacacgagaatgtgtcacatcatcacaaatatattagccgtcggataaagagtttggataaacaatggccattggattaaaagggtatatgtatttaaaaaacacaaatgggctaaacatatggaaatttctggaggtttctggcacctcctcctagacacatgataaaaaagagagttaaaagagagaagaaacacaagacttctagtgattgctcttataaacatataatacaacttagttaaatctataattggctagcgaaatcaatacttatatcaaaacatttttaaaagcttaccttaactaatagaacatatagaaaagttcttaaacaggattaaaagtcgcgcaacgcgcgactatgtggctagtcttccagaaggaaattcgcctccaaacaggttgggctttaaaagcccaaaaccagacctccctcccgtaaggccggcctggacaaaattctggcatgggccctaatctctgaaaaattccaaactataataataaccagattattgaatcttcccatggctgacaagtgggcccttatacagagagacgctgacgccagcatgacgctgcggtgacgcccaaaatttcggggaatgggaccaaatggcacgcagacgcagcagcaggtgagaggcgacatgcatgcgccggccggttctcacctcttccatttcagcaacagctggaaaaagcgccaagaaacaaacacctcatcatcaagccaatgcaattcaaccccacaaaaaggccttccgaatgatacagctcacatcatcacaccagccacacatctgcacaaggtctctgtaactgctactgctgatgatgaatcattgttcatcaggatgatatatgattcacatgaagaacagaagtgagcacaacagaagaagctcctctccatttcagaagtgagcacatcttgtgaacaaaaagctcatggaaaggagggcactgattataatgtgaacacgtggcagatgaaccagcagggaagccattataatgttgtcactaattggagaaatactttaggttacagaggatacaggacagtgactggatgatgatgatggaaactcaatatacattttcagaggaaaaggaggagatgatcactataattgaggatcatcagatcttttcttccaaccttgtgcttcttctgcacatcattattgaccttttgccacaactgtgagaaaatgcatctcaaactagtgggttttttaggtacatcagaagctgaatttttcctctattggttatgtacaagatagcaaacactctcaggagtttcagttgtgagttgtgacatgcagaagcattcactagttcaaaacaagtggaaatgttcacttgttcaggcctgagttttggtgtcagggacaactacaagtccagaaccatgaaaaagattgcacagaagactgaaatattagggtcaagtacatcaaccaaagtagaaatattatacaggagtacatctaaccaagctgaactacaaagccgacatgcacctattcagtgaatcaggttattgtttattaacatatgacaagatctgcactagtatcttttccatcctaattttataatagtttggtagcagcactaatacagtttgacctgatcttttatgtcagatagaattatgcaggagataagaagatcacctagatatagattattgacaatatcacacagacaatcttgcaggggtcttatcattattggcactagaatttaactcataagtgtgtgtaatgtgaaatctgttactccgcactctatccatgttgatctcctaatctaattcttaatatattatattttctgctggcaagaagccttcaaataaattggacaacagaactgatccatcacaaactgcaatccacaatgaggaactcttaaaaagattcccatattgaatataaaaccaaattaaggatttcacagaaccatatgtagaactgaaaggatggaaaaagtctacaccgctacagcagtacttcataatgtcaaacattgctgaattttgcacgcatgatagtttcaagatttgaccttttgattaaaccatccaaatatcaggaccaaacatgaattatgacacaacacaatcgaactaaaccacagtagatttttttttcttgtttaatttttttgtcgacattctcgacaacaggccacatttcatagcgacctcacagatttttcaactataagttactcccagaattagccgcgcacacatggaggactaacaaaaatgccatgatatacaccaaatgcagcatcaaaacatgggaagaaggaatcatctttacataaagatggttcctttcctttccccccttcctttacagaacggcacacattttataattactactagaccaccacaagtgaggaaaaaaacaaagaacaggagagctacctataaccaccacatttgcgcgatcaaatccaaattctcgacggttcgatcggcattacctatcaccaccacattgcgcgatcaaatgtgaattctccatgtttcaatcggcgttgagcatcggcgaatcgagcccctccatgcggctgcgaacaatgcggtggaacacctccctgacctgcctttcgagaggctcaaggccggccctcatggcggcgcacacggcagccagctcggcggcggcctcccgtacctcggcctcgcgctcaccggagagcgggacgggtgcggcgtcgatcgcctcggcgagccgctgcgtgcatttctccagcgcgtggatttccttgaggaggccgcaggagttgcgcctgtccttgcgcttcccctcctcggtgaggcgctcctggagcgcgagcagcggcggcgcccatgggaacgcggcgcgcggcggcgcggcggggaggtggtgcgcctggagcgcggcggcgcggtccgggcacggcacggcggcgacgagggcccacgcggcgaggtggagcaggcagcccatggagtacaccggcgccacgagtcccccctcgtgcgcgcgcggcgccgccaggccggacccgatggcctgcagctgcctagccgccgaccagttgcgggagacgctccacgagagcgagcggaagtgggaggaggaggaggacgacgacgaggaggatgaggaggaggcgagcgtcgcggagcgggagggcgacgcgcgggcgcggccgaaggagcggttgcggtgggaggagaggaaggaggcgacgccgccgccacccgcggcggccgcggcgtcgtcgatgaggagcaccgagaggtcggagagcgccttccgcgcgcggcggagctggccctcgtggatctcccctggggcgagcagcacggacgccgcgatgccggcgagccgctcccaccgcctgacctggtcgacgccgtcgcgtgcggcgttgcacacgtcgagcgccttcaccgcgcgctcgtagaaatcccccaccatcttctccgccgccgccgacagcgccccgcggcggcgcgccagcgccaccaccacccggaactcctcctggcacagcaggaacgcctcgagcagccgccggatccactcgatggacaggagctcgtcctccccgcccctgagatcggcgaggtgcgccgccacgtgccgctggaacgcctccaggtcggcctcctcgccggacgccatggccggggacgcgccggcggcggcggcggggctgtcgcggcggagcgagaggagggagcggccgaacgaggagaagggcgacgggtgggagtgggtcgaggaggagccctggtagtcggtcgccggcatggtcgccggcgagatcgccggagaggaaaccgaagcggatcttggagagagagcttagcgggttaacgggtgagatggatggagatggtgaggtggtgatgtgtggatggatggatggatgggtgtatatatgtatgggattgtgattagggaggggattagtttaatgatattttggggtttagggggaagtggtcttagctaatcatgattgtttggatttgtttaatctttggtttgtaaatgatttctttctgtgggtgcaaatattcttctggaactgagaatgtttctagtttttgtttagctttctctctcagggggttttggtaggaggggctctaaaagggttgtaattactcctgggtccttacaaagttaaaatgaaatattgtcatcttttgcatagaatgaggtacgagcattttactatagtggaatacttgaagagcccttcttgtttgagccgcgatttctaagttgttgctaattttacgtcgtaattttagaattaattcaatggtttatttgccgaccttttaactttggaactgctaagagtagaagtacaaaattgttatcctatttttttattgttatgatcatgtattattggtttatatatcgcaaccatagaaataccttccaaatcggccggtctcctcttatcattgttaaaaatgtattgccttgaatacgttaacgagcatgcttgtttgagctacgacttataagctgtagctaaattcagaccctaattctagaattagtctaatgggttttctcaaccttgaactttttgactgccaagagtacaatcatatagtttttatcctaaaattatctttcattccttcagtcgtcgcgtattttggttttatatatcgtagccatagaaataccttccaaataggccaggcccctcttgtggatatgaaaaatatcagcaaagattgttgtttgtgtattcatcttcttctcactgtgctactacagtgatcagctgactatactgacaatctgacatgatgcacaataattggccatacttcatgttgatgcatggccaatttgaggcagacacaaaaaccatcaatcctggagggcttttctgcaaaagggcaggatcagcagccagattaattggcgaggtttagcttaaccaaatcgcaaaactaaacaaatccgatcaaactccggtgaccagtcgccatttgcagaggggatcattagatcaattcattatcatcaaatcaaaagagaaaagtaaaccaaaccgagttaagcccctcgagccgagacgaatcaatcagcaaaaagctagtgctacgcggggaggggagtggtacacgcggcccgagagtccctgccatgtgggcccgacacgcgtaacccgcccctcccacgcggggcccgtgcgttcacacctccacccccacgattttacctttctaccccccgcactccagtgctcgcgccggcgaccgacccgggggcagtttgggaataggactaccgcggcgcacgcggggcgtgggcgcggccggtgggcgggtgccacgcggccaccggtgaggcgcggcgcggggcccgacgaggtggggcccaggtggcagtgggaaacggtcaagcggccgcacgggcgcgggtcggaaacggttgggatgaggtgagggtggcggagccggagtgtggtgcggcgcgtgcgggtggttgtacggacggaccggacctggccgttgttggtgccggtgaaacggggtgaggtgtacaaaagcctatcagggactggagtcgtgtgcgtgacatggtgagctggcacgtagtagaggctgctggttatggttggagttttgtgatatgctcttttatattgcaggattttatttttaaaaaaaatcagtaaactcagtcatttcaattttagagagatgaattagaggagttgagaagaaatagtttcacattataataggtgtggaataaatctctttcaaatcttctcaatcctctcctggactaagggaaatttttcatactctgaagttctgtcctagctaaattctcagtggtgtttatgtacagtgagatgttattgtattgtttaaatggaatctgattgtttgcttgttgacttataagctgaaattcaaattttcaatcttagtttctgttgtctcactttttttttacggcttatcagctgaagccaaccaataaaaccataaatatgtaaacaatttctcttaccatggaaatatagttgttcaattttaagtcctaaatttaagatgggtgctcgtatttactgctaattatatttttagtggtaggtgatttatatccatcgatagtgagatgtttgtaatgacgcaatcaatttaagacgcactggtttagtccctcggaaagtggatgtggtcatagtgtcatgttgtgtgtgctcgactgttcgtttatacaaataagtgtgcatatatttgtacggatttctgtacaatatttttgttggaattaatacgtgggctactaaggctcatatggagattaatttttttgaaaaatcaataaaggtcccctcttggaaccttcgtccttcgacattctgtatcgggagaagacgataattagctttttggaaacggctcgcgtgactgcttgctggtctttcacgacggctcgtcttcctctacactctagggacatccagcaccgccgttgttcctgcagtgcgcgctgctcctcatcaatctaatccacaacaaaccagagctttcgttatgtgttcaccatgtatcatctattcgatgtgctcagggtttactgtttagtatatatgtctagatcgtatatcgtggttatgttagtatacatagtcaataacgtgatttatttatgaaataaattaaatctacgtgtgcttatattaccgttaatgttttgcatcggaatgttctgaagttcttggccgctttgtaacccgtactaatcgaagcaacagtgggcgaagtggtcgcaatcatgcatcaatcttcggggatccacactacttgtgcctaacgtttggtaggccgtcaaattacaaaaaaatcggcgatgctttttggccactcgatcttgtacgacttttgtcattctccaagccacactatcagcaaatgtttcaccgatggtggcattcgatattagccggtgtggatttttttttctttctttctttcttaaaaaaaaacagcatatataagtacttctattatgaaaatgtcaccgggaacatctattgtctaataataattgggatcgagcaattcatatactcccagatatgtctccttttttcaagacaggattcaataatcaacgtattaagctatggaactttattttagatcttgttcggttaatacatctcttaaagtattgaagctgtggaattaatttggagaattcctttatcacagattaactacacaaatcatgagaagagagttgacttaaaaataagaggtgatgcaagaaataaaaaaacactaggtacgataaatcaaaaaaagcaaaggtggggcattgaaaatgctactacaatgacgtggagaagtggtggccagaacccaaaacgcataaaaaatggctcgttaacaaacatggtactagtctcgtattaatcgagggtttaccttatcgtttccagatgaactcatctactctccctcgattcaccgatcaaaaaccgagcaaattaaaatcggtctgtgcaccaatacattaaattttaggtgtacaaataccctgcaaatatttatgattggtaaaaaaacatattaaattgttctagaagaagaaaagtcacaaaaccattgcttgcaatttgcaaatactccagtgtaaaggggagtactccaagaaaacaattctgccagtgggcccaggtggcgtggccggacacgtaaaccagcgaatgagagggatgcatagccaagggttggttttccggggaacacacggccggcagccgttgttgttgtgacttgtgagggaaggcaaatccaagcctgccttgctgttgccatcgtatgggaagaggacttgttgcttgtcttgtctcttgcatgctcagtgctgcatgcctagctagccggcatgttctaattggacaaactcactactgtttgttcatccattccgatggattatgacatggacatgtggtcttctatgcagggtctcccaaaccactgtggccggggttaccgcgtcccggcggtaagcacggttaccactgtataaaaccgtgtaaaatttatcaaaaatttaaattgttttttaaacttatttgaatttaaggaggttaccgcggtatttatattaccgtaccccgtgataagcccggtaaccgcagtaaccgcgcagttatcggcggtaaggtaacccctgcttccatggctatgtttcgagtagattttaactttttttcttcaaacttctaactttttcgtcacatcaaatgtttgaacacatgtatggagcatcaaatgtggacgaaaaaaaaaccaattgcacagtccgattgtaaattgcgagacgaatcttttgagcctaattacaccattatttgataatgtgatgctatagtaaacatttgctaatgacggattaattaggcttaataaattcatctcgcagtttacaagaggaatctgtaatttgttttgttattaatctacgtttaatacttcaaatgtgtgtttgtatactttaaaaaaaaattggcacacgaactaaacacagtctatgtacattgtttagtgtcccttctaccggccaattttgacatgcttagagcaaggtcaataacatagcccgctgttggcttcaaaaaaatagccatgacatctatagtaagcagtgtagctaatgtctacaatagaaatactataacacgaatattttattgttttgtgggacccaccatcttctcctacctcacattctctttctccctcctatccccttagttcatgtcttcatgtcttcttctttcttgagctagcttcgattcgctgtcaccgacaacggaagacggcagtggcagacgcaggagatggcagtggaggtggaagacggcggtggccgtgcggcgggcgtcgaagatagcggtggccgggccgcgctgcagaggcggaagacggcggcaaccgtgcaggcgagggatgacgggggccgtgcagcggatgtgggagacagcggcggctgtgcgtcggcacctgtgagtctaagggcagcggtctggtggccgcgggagttggcaacggaggcaggccaacgcaaggcatggccgatgcttctccatctaggtaggccccacaaactcctcaagcggcgcatgcagcccgacaacaaattagtcgttgtctctatctctctctctctcttcccctctctcctccagatcatcacaaaatcctacgtggaactactactgcccattattaattgtatctgctcttattaaacataggttaaattatggagtaaaatgcaccagcggtccttaaacttgtcaggaggttttacttatgtccacgaatttgcaaagcgcacatcgaggtccctaaacttggtttattgtatcatcccggtccaaagccgtgtttgaccgtggtcttgcctacgtggcatgccacgtggacgatgacatgaattttttatatttttttctcccttcttccttcttttttctcttttatgaaaaaacgatgacatgg

SEQ ID NO: 48238 - DNA, 7753 bp, Oryza sativa
attcctgcagccctggtcttgcctacgtggcatgccacgtaggcaagaccacggtcaaacacggctttggaccgagatgatacaataaaccaagtttagggacctcgatgtgcgctttgcaagttcgtggacctaagtgaaacctcttgacaagtttaaggaccgctggtgcattttactcttaaattatgcaatagtttgttaccatatattactttagcattaacatatactatctccgtcctaaaattaaccttaactacacttcttcacgaaaaccttaaacctgttgaacacaggatcataaaatagcctatggatctgtctggttacatgtcacatattgccaaaccaaatactattagactagttgtagtttgttaggttagtgtttggttggttgttgaaattgtggcaagtcacattttactactttatagacccacatatcatagatacaatttatagccaaacattaccatacttgtgatgaacaaattattggccatatgcccaaattttgtatggcaaagccccatacttatgacaaatttagctgtggaaagctaggcacaaccaatagaagccaaactaaccaatagaagccaaacaactagaggtacatttccatatatcccatcatggaagttatgcttttttacataattctacttgttgtgtgtgaaaataattttttttatcgtaatgtacgggcaactaactagtcatgtgttaaaaatagagttttgacaagggggattttaaatttcgtcactcaagtaggaatttaattattcactataaaattaataatgtaaacatagtaatggattcgaagaaaaatatctgatactcttaatacgtgaaaataaaagggaacgtacagatggacctggtctcatgaaccggtcaaaattccagctgaagtgttgaccatgcgataccagtagcggtggtagttgttcgttgaacaagttcagaccataagctaatttcaaccagagaaaaaagttcagacttgaagcctgaccacacacacacttggcacttgtatataggcagagacacatgcactgaacctgagtactaagagtatcagataaaatacctacagtacctggtactgagtactgacacgtcgtcatttcatttgcttgggaatcaagaagaattcaggatacatcaagtttgcattcattagggagcatctgctggttccctttctttcttttttctctcctaaagtggatggatgcttcatggcctcactcacacaaccctatcgtttcgcctaagcttataagtcaaattttgtattttaaaaactaattttgaaatcaattttatgcttttttcaccatagttttattttacaggatttgcttttgaactggtagggacacctgtacaaaagttgtgttcataaattattatttgttttctaataagccataaagataagaatttaagcataagcgaaagaatgaggcggtcagtaatctcagttatcagaatggttcgctctcagtgataggaatatatactatctgaattgatgtttttggtcccaattctttagtatttcttgggctgcaggaaatgtgttcatgcttgccaagttgatcgattacatttgacagttcagtcactgctactagatacctcctgatctaaacaagatatatttcaccttaattcagggtaaagccaccttttttttttataccggtaaaagttgattgtaatagaagcagatgttgtatcctctactgtccctttctggccacctaactctagaaagagaagcactgtatctaaaataggaagtcactttcgaatctttatttggatggagatgcaggcttacatggattgtacaagatcggtttattttagtgcctgccgtgataagatctgcatgatttgggttgcaaaagcctaactattggtcactcttggaagcaaacatagtatgcgctttctgatggtgacactggactacttgagcctaatacaaggtacaattatccacctcacaactgaaatcatgtggacttgaatcaccaaattattagctttctcagttaataaatcactggagaacagtcaaatgaattctgcgaaaattatccgatgcacatacagaatacctgttatagagagagctatgggtcaaaaagaaataaagataacattcaattacaaagcaaaatcagaataaataagctaaatgctaaaataacaatttgccttttgttgcttgggtgtttctgagttaacacatcatcagtaacatacaacagaacggcgtcccaggctaaacttggggatggtcagctccatccaggggcatgccctcagggcgtcaaataagaagcatccatgatgtttctggcctgcctggaagttctattcgcaggccagcttggtgtcgaaactactcagggagatagcaaatgcctggaaggctgagagcgggtagtggtaatccatggtgaacatgtccttggcaaccttcccgaattgcagtatgaccttatcatgctctggtgggggtggtggaacaggctgtgatggagttggggctcccgcagcaggctgcgtggctgcgatgagctggaagttcttgacagaagcaacagttacccggccccggaagtttaagcaccagcactgtagctgctcatgccatcttggagccttgttttggagaatcaaaggtgtctccttgcactcctcatcatcgctcaatacccggcccccaatccttgggccatctccaattgagatgtcagagaactgagcactgctgaaatgcatggaatggtccataacggacgatttcgaaaaggagacactcctaaaggaggattcattgagggaatgggcaaggatgctatccggctggctaggaacagtcccaccagcctcaagagatgaggcagggatggagtgcattaaacagcacatccgcctaggaccccgagttccaaagacgtttagctcatatgagatgtttgctatgctatatgtgctgcagggatgctttgctgttcccttgttggagaatcttcggcttgttttccctgactgtgaatcactagttgcattgtacggagtgtgggtatcatatattacaaactttgtgccaaggaagtttgacctacaattcaaaatggagacatattagcagcagcaataatttttagattaaaatggggtaagttctgaaataaggttgtagtttcttcgggttaatacctcaattttccaatgtttgtgttggtagacctagataaattgttagcattcatagatatcacatattctgtacatgttgcatgccagtttctttttgctgatagaaggaatttgccattgtcaacaagcacagctgcagaaaagggaaatcaaaacatctaaaattagtaaatgctggtactgaaatactaaaagtattccagcaaggaaacaaaacatatatgtgcaccagtgacggagcacgcgcaaaaattaggtgggtcagacacacaagacatactgaagtaaaagaatgacaatgcttgcatattaaaacggtacaactcataagacgattaaaaataacaaacaaacaacggtttccaccatataatattaattcgttgtgcataaaaatattatgagaagttaagaacatatgccgacatcaaagcagctcaaatatgtcttgcatttacacacataaaattagtaaatgtctttccatacatctcatcccgagattccctcctattttgtttcgtcgtcatttcctaatatatctagtcggcaattagctaagctcacttgatgttactagcaggcggacgcaaggcaacagaagaggattgagttcgcacaacagggctcaaagggctagcagtggtcgactttgaggcccgtgccggccgatggcagagcttgtgcagctaggagctcaatgcaagcacgctgagctcatcgcctcattctcacgatgcatgcgtgcacaacagtatagccttgaggccctttgtatctgatgtgcactatgttacctataattggaaaccaacaatgacagatgcacacccacatggacacagcaaacagatagcatgcaattccaatcaagcaaaggacacagcagctcaaattacaattgcacagaaccagtcccacttgtgaatatactcgcaccatatgggtgtcattgaactattgaagtggttcgaatgcaaacaatctcaagagaacaacctacttgtgcataacaacgggaatatattttattagtgtactgttgcttaattgacattatcatggatcaggtcaactttttttccagattgtcaagtcaagtagtaaataccaagtggtataggtcaggtaaaacagtagaacaagtgcatgacagaggtatacaatactaaaaaatagcacttaattatacataacaactattgtgtgctgtatcctattattttggttacaaaaatgagacaacttattacagaattgtagttataaagaacctaacttaactgtatgaaagccaaggaatgctgaatgatctgttcacaagttcgcttgtgcatgattgtggaagatagacaatgacaaataaggaataatatgtttctagcatattcatgtcaaatgataaacatggcaccaattaccatcccaaggcaccatctaccctatgcaagggctataagaaagaacagctcttcatttgctatgcaatacaagcatagttttggcagaatatatgcactcattcagcagctcacaagtatatacaactacatatgaatcttcttatgcagaagcaaatatgggctctggtacataggcgcatacaacataaagcatatgagatgtaacaagtaacataccagagccaagagagaggtacaaatagtaggtctgcgtagacttatccctcctaatgaaacactgcatagttccatctcgtggcccaggctgtacatagaagcggaataacatgaacttattagcatataagcaaacggtaatcctgcaatatgtgggtgttctttctatttttgtgtttcgaaattccaacaatatgttgaaggacaagcacctaacatggacgaactgatattgcttgtaaaggatataaaactaaaaacaacacaatttgcatgatcacctgcctcagagaaatagggaaggtgatcttcccacacaactctggattcttgacgatctctttacacatctccctccatgttctgcagacacccgcacaagcaaccacatgcttcctagaaggccatgtagcctcactttcttccaacctctcaatgatatcacgaagcaattccggaggcaagctagcccagcagctgctctggattacaggcaccgggtcatgcaactcatggacagcaccatgagacttccccctgcgatgccccagaatcctgacctcaaatcccctcctcgataggctcccaaatccatccctcacatcgcgcacgatgctgcgaaacgacatctactctctgaaaaaattgagatctctcctcagctaccaaaagggatctatacttttcgccaatgataacatcccagagtaattccagaccaactcaaattctcctcattattgttgaccccgcaaaaagaacctgcagcacaaatgaattgaattggtcaagattaatcttcgatattctttcttgaaaaagatgggagactagacgacggtgccgcgcacgatggcgacgttgcccctgccctgcgggaatgcaggtcacaatgcccccaattatctctctccacaccgattgcagcagcagtagcagggcggaagctacgagggggcacgcgaaaatgctggattcggcaagcctacctaccaacctactccccggtctcccgcgccgaagatgcccaatcgataaacacgaaacaaaattctctgctactgcaaaccttgtcgtgctcgcgcgaagagggtagacgcatcgtggaagagagcgcccactgctccgccggatcgagcccgccccccgtcgccgcccgcgtcgagccccgcgcgcgcgctgcccgcaccggatcgagcgagcgagcccttccgcgcgtagggtttggtcggggcaaccaattgggcggaagggggagaggggaagaggaggaggtggtggtggttgccggcggcggagatggccggagacggcgggatcggcggaggtggggatgcgatgcgaggcgtgtggtgtgagaggagacgaggcgagagtgtttgggatttctttttatttattttaacgtgtcgtggtccctacttcatacggtgcggtggtgtgtatattcattcccaccaatataaatgtgaaaaattctagaatgacttatatcgtgatacagatgaagtatttgatttgtttaaactttatgttaagatataatcatttctctattattccctccgtcataaaataacataacttcccccacccatttatcgccgcaaagactttattttgaaacaatcaaatatattagaatttaataaagttagatacatacatcgagatgtgataaagcgaagattattgtaggcattgttttagatcccatcccaaaactttacatcatgtcacatcaaatgtttgaacacatacatgaagtattaaatataggctaaaaaataactaattgctcatattgcgactaatttacgagacaaatcttttaatcctaattgctgcatgatttgataatgtgatgctacaataaacatttgctaatgatggattaattagacttaataaattcgtcttgcggtttactgacagattctgaaattagtttttttagtagtgcccgaacaccccatgcgataccctatataatacgcgatatgagacaccaaaactttatacacctggatctaaacacccccttagtcttttaaacattgtatttgtaggtgtaacaccgtcacctcttatatcaactaaggtaattatttatctggatactgccaataataaaggataatctagttttttatcttcgtgaaaaacttcaaagatattatcccaaaatacctttggatacttcggagtattttaattttaagagtattcacaattaaaacttgactgttgattttctttcaaaatatgcttttagtagttataaaatcagagtctgaaagcatttttagtattgaatgttacaattgttatacggtaaatatatttgcagtattgacctactgttgatttaaacctataaatttcaaagtattactatctaataaaaacgacataagaaaacgacatgaataatatgataatcatttttgctccaatacaacaggacatatatgttgattaaattatcggagtcatcatttggcttatatttatgcatatttgtattacttattagcaaccaaataataatttatagatgaaaagtttatatacgtatttttagcaatttaaaaagtaaatactgccaaataaactacaatgataaaaccataaaataaacttcaaatttgaattttaaattttcaaaattggtttataaacatacatagcgaaacaatgggattatctgtgtagtgctgctgatgcattagttgtcagcttctgctattgcatcagcattgcagacgttctgcatccatagcaaaaagatggtggtgtatgtaaaaaaaatcgtttgcaaattgcgagttacggaagcgctgtgttactcc

SEQ ID NO: 48239 - DNA, 3735 bp, Oryza sativa
cgatggctctcatcccgggcccaccaaggcctggtcaaaagtcaaaactaacagccatatacgccaatatgacatgattactgtaaaacgaaggtggtaaaatgtgatattacagcaacaacaagcagcagcaaagatgcccggtccatgcagctaccattcaacatacgagttgaccagtcaacattgaccgagggccccacacacagagacccactgctttcttttcacatcgccatctggctagcaaggccaccacattttgacttgacttcagcattcatggtcaggaagagtacccccttgattgagtaaaacaaagttggatagaaaaaaatgatgaaaactttagaatacagatggagcccagtatcacatggaaattttacaagtagagagaatcaggagatataatgatatataaacaacaagaggagaggatcactgagctagctataaagcattgaaattgttgtcacttgtcagtagtcacagataatctgccacctctaccatcttgcataaacaatctgccacctctaccatcttgcataaacacggtcctgaattgaattgatctgcaacctgaaattaacaatccggggaacgaattgagtttcagacaaccattattcagttctagagagaacttggaattattggaagagcatggaagaaacaaaactcaatgcagaaaataacaggatgctaccctgataaccatctgcaatccattttagaaaaaactataacaatgtaatctgttttagaggcaaacgttcagagttaagtcacatattttcgctaaaattagccataaatttaagatttaaaattcaaattttggctgtggttgataagctaaagagcaaacgatggagttggctaagcataggtgaaccagctaagctagactcatcagttatatacttacgagttttagagtaaactctctgtaataaagcataccatcatatttaaaagcagtgttctacatacagacaaactgtaaacattgttcgtgcaattgaacaaatataagctacttcttgtcaagataacaaacaccataccaattacccattaacaacttatccatacaagagtaagaactaatatctgtttaatcaggggaaaaagaaaaatttggatattgttgactttgaatcatgaagattattggatattgaaactcagcttggaagtgccaatctgacagcacacaagatcaccaaatccgagcagcatcactatttgtatcttggtgatgcagttgcttcccttttgttatcttttattcgctgattatgtttacacccaagtacaccatgtatagaaccacagtcattgcagttgatcttaatactagtcacgaaataactcccagttgatagtacatatctaactgatgccttctttgctgtagaacagtaaaatctccgtcaaaaactgatgccgcctctatctatggatgggactaatttttgtactacaggggtttgggactataaagctgaagtaaacactatcaataggaaacagccccaatgcatgatttccatagttccatatacactagtagcacagtactacctaaaaacttgtcatgaaaaaactcccacaagaagctacccaaattataaacattgagcattttttagtaaaagtaactgaaaatctagtccatttgcttaccatattgcgaaatgaagtgctaacagaacaaagatcatggatgattagcattgccctttatcttaatctcaagttctagctccttgtgtcttaggtcaagctcaaaccgcttattctgaagcatcatttgttcattctccaacgccaacttttccaattccaagtccttgttcttcctgaacatctcccacttgagacgttgctttgcgagttgcacagccttggtttcaatctgcaaacgatgtttttgaatctctgctgctttcagagccaagtctttttgcaccaaagccaaatcacatccatctggaaagggtttgttgatatccaacacgtcatagggatcagacctcccactaccatcattcgagcatgaggtgacaaaacctacatcaccatgatctacaacatgccacatccttttatgcattgaggggccccttatattggtatcaactgctcgatgttcttcctcattctcctcataatctgaatcttcactctgatcatcatctagttcagcatctccacttgcatgcctcatgaaatcattatcctctttacatctaagagcaagctgtagtgactgctgaagtgcgggatcttcaggcagacttatacggttattattatggtaggaacacatctcttcatagaacaagtgtttggagttcagtatcttccttgcatcctctttcatcttctcagaaatatccatgtgatcaagaagtgagtgattctccacaacattacaagcagtaccccttccaaggatatctgttagtcttttgtatctcttattaaggtcattgaacttatcctcacactgctgtggcgacacatggcaacctctctcgcccatgacctttgatattgctttccattttcccttcttttgcatcattgaatagttcctcctcccaccgcctaaatcagctccaggatcctcccctgtgtaggatactgcagtaatcaaaagcttcaccattgaatctgtccacttcatccgatgccatggagagcccttcttgtctttgccatcagcagcatcctcattcatatcgtgctcctcttcatcactcccatggttctttgagtggtgtctgtggtgatggtgatgatgggcaatcttcccatgttgtcctaactgaactccatcagagatgttatcaggctctgtaaccctatccataggaatggtaaaattccctggtatctgaggctggttgaagccctgatttcctgagtttggaggatgcatttgcttggagataccatgcaaatctaaactcccataggaaggtccctgtgtcatattaccaggtgggttgctgccttccatttccccaaagcgatcacccaaacacttcaacttcttgttggtaccatataagatggacacaggagtgcacgaggatgcacatgaatataacctgaaatggcagtttggtatgaatttttggaaatccaacacatgtatattgcacatttctatacatctcaatcttcagaatcaatttgctaaaagaaaaagatcttcagaatcacacaatatatcttaactagagtccatatgtaatcagggccacctaataagaaataactaatgcacaaatttgaagagattttaaatcagtgttacacaataaagggtaatttcagcctcctatagttgtcataattgccaaagcaagataatattggagcactaaaaatcagagtgttctgaagaatctaaactgcatcaaccaacaacctaattaatcagcagcacaaatgacaaatcaaaccatattactccactgggtaatgtgagtggaacaattttaaaacattattgcagtggcaagtggcaaccaatcaaccactagccaaaacaaaaaatgttgcaacctttccatgctactcataactaacgagaagaaaatgcatggggaaaaataaatcaatttgtcacctcacaagaaaaaatagtaaaaacaaagtgtcgtgcgcaaattagctgtccatgtgtaataataatccacggggctgcaggaa

SEQ ID NO: 48240 - DNA, 1657 bp, Oryza sativa
gccaatcgcacgagatggggaatcaatggagatgggggaaccaagcacctcggcagcgcgggaaaactgcccggctgcagtggattgggagcgggaggtattctctactggtggagaacggaaacacgggattagggtctcaaaatttttggaagctggtttggatatctgttggatccattttttttgctcgaaaaaccccaaaatttgaaattgggagtagtaggggaactcttggtgatgctagtaacacacaaaacaagcccaatgtgggtctccaattcaacggcgagaggccaagaagcgagaacgccttcgcctgtcggccgtcgctcgctcgtctcgttgagtccgtccttctccccagcggcgacgccgcgctctgcgccgccggacggcgcgaggtatggcgagccctaccgagtcctccgcacgattaaaccccggcccccaagcgctccgcctccgaccggggtagcccccgagctcgggatggcgtacgtggccgcgacgagcctacgcggagtgctcgtcgccagcgatccgagcggcgagtacccccccccccccacacacacacacacacgcacacacaaaaaactcattgggtttaacgcccccacgcgatgacagcggaagccgctgcgaccaacaaagcgatgcatcgggagggaaaaggagagctgactcacgacggtatccggcgactgaactgaacgccggcgaggagacaatccgcctccgcctccgcctcagcctccgccgaaatattgggcctcgccgagcacgaggtttctctttctcagaagaaaatgccaaagctgaacggaaaggaaggaaagagtacgaaaggtaccataaaaaaaacaaaccaaaaaaaggaaatcgccgaaacgacacgtcggaggcgcgattcctcgtggcacggtatcggctactgtcgcctaccgctgacacgcggggcccaccgacagggggcccaccgaccagggggcccacatgtcatcttcacggtgatggcgtggggacggtgaggcacggcggcgcggttcccacgttccgttccgtttcgcgttacgggggtgggtggggcccgcatcacagcggggccatgacggcagcaaccgaaccccattctctctggttggggggtttattattggttatgggcttgtggcaggatgcagatgacacctgaagaaaagaaaatataaacacacttggtgattaattgttgcatttgcatggagtttaatagtcaaaaagtgatttcactggatgttatgatgcgaaaggagtcgtctaattgcacttgtaatggcgttgtttttgacaaaaatctatttgttgacttttggttatgtcagggtgtccggttgttcataaattctgatggggaatgtcaaaattgtactgcaagggtgaaaaagattgcagagccaggacactcttccgaatcagacgagtgcaatacaccaactgtgtattgtctgctgatctgacgagctcaatcagtagacagaagtttagttcggagcatttggctaacgtgtttcctaaaccatcattgatttgccgaatttagaaaacaattatcacaccaaaatgaactagtatactgaaccatccagagatgccatgcctatctcttgggcat

SEQ ID NO: 48241 - DNA, 2107 bp, Oryza sativa
ggctgtgtggggaaatccctcttcacagtttctcccggtcaaggtgcgttcaattccttttcccctactaattatgttcatgaatttggagggaattcgcggggtagggtttggggaattcaaaacactacatctagggttgagtgtccagtttttgatgggggaaatcctaaggcatggaaactgaaatgtgaaacttattttgggttgtgtggaactcattcagatcactggattggagtggctattcttcagttcacgggtgctgcattgacttggttgcagtccacccatgctcatgaagttagcggtagttgggaagaatttgcagcgtgggtgtgtgggaaatttggtagggaggagttccagcgtttggtgcgctagtttaataggttgagacaaactgaaggggtgatggcgtatgcagagaattttaatgagttgatgcatgggttgcacgcgcatcatccgtcttggaactctgaattttttgttactcaattcctagaagggttaagggctgagattagggctgctattgtgttacatcgacatgccaatttggatactactgtggagttggcttgtttgcaggaggaagtgttggaaactaatctcaaggaaggccgtaagattgactcacatggcagaaatactttgcgtgctacctccactctggcacgtccatttgggggacagtggatgaaaggggaagaacgactgaaggctgaagtgccagctgaagataaagttgctgctcttcgtgcttaccgttgttccaaaggtttatgtcatacttgtggagagaagaggagtcaggagtatcgttgtggaccgacagtgcaattacatgtggtggaggaattgttgcaattatttccctcagaggatgttgttgaatctgacaccaatgatgctactcctgatgaacctaaacagaggaattgctgccatttctagggaagcagttctgggcattgagtctcctaagacaatgcggttgcaagggttaattcagcgccatgaagtcttgatgcctgtagattccggcagcactcatagctttatcagtgaacaattggcaaatcgattgtagggaatatgtgcttctgtatcgccgttgacagttaaaattactgatggaggtttactcaagtgcacaagggagtttcctgattgcaatggtgggttcagggagaatctttcagtactcctctgaaagttttgccgttgggttgttatgaggtaatacttggcatggactggcttgagcggcatagcccaatgcaaattgattggaaactcaaaactttgcagttccagtggcagaatcggcaagtgacattacagggagttatacctgatacaagtgattgtcctccggtgacctgcaatcagcttaagggtttgctgcatcataatgttgtcttgcaggcagtggctctctgtccggtggacacacctgtgaaaccttctcagacaattgtgccagctgatattgaaactttgttgttggaatttgcatcagtttttgatgaaccaactgggttgcctccttctcgtgtgtttgatcacagtattccacttttgccaggggcgtcgccggttaacttgcgcccttaccattacaaccctgcgcaaaagactgaaatcgagaagcaagtgtcagatatactgcagcaaggggtgattcagcgcagtgctagcccgttctcatctcccgtgctcttggtacagaagaaggatggcagttggcgattttgtattgattaccgtcatattaatgcgattactatcaagaatcgttatccgttgccaattattgatgagcttttggatgaattagcgggtacatgttggtttacaagtttggatttacgggccggataccaccaaattcgtatgaagccggaagatgaacataaaacggcattcaaaactcatcatggacattatgagtttaaagtcatggcttatggattgactggggcaccggctactttccaaggggtgatgaacactatatttgaaccattcttgcgaaagggggttctggtttttatcgatgacattcttatttatagccgaactcttgaggatcatatta

SEQ ID NO: 48242 - DNA, 3209 bp, Oryza sativa
cttttggcataggagctatgttgatgcaggatggacatcctcttgcgtttttaagcaaggcattgggaccacgcaatcgaggactgtctacttacgaaaaagaatgtttggccattttattggcagttgatcattggcgctcatatttgcaaggagctgaatttgtgatccgtactttagcggagtttgatacatttgggtgatcagaagttgaccacaccttggcaacagaaggctatgacgaagttattggggttgcagtatcgtttggtctacaaaaagggtactgacaatcgtgcagctgacgctctctctcgccgtgcgcaggatacttcaggggaagttctttccatttcagtctgtgtacccgtatggttggaagaggttcagcgtggctatgctcaggatgatcacgccactcaactgattgccaaacttaccctgcaaccggatgcctgtccacctttttcctttgatgctggcattttgcgttatcagggacgaatctgggtgggagagaatccttctttacagcaccaaatcttgcagaccttacatgctggagtgttccattgcttggtctgggctacggcgttcagttaaatcttttgtcgaaaattgcacagtatgtcaacaagcaaagacagagcgtgtgcgctatccgggttttctccaacctttacccgttcctgagcatgcctggcagatggtatcacttgactttattgagggattaccagtgtcttctaggtttgattgcgtgatggtcgtggtggataagttctccaaatatgctcattttgtggccctggcgcatcccttctcagcttttgatgtggctcaagcttacttgacaaatatttataagttacatggtttgccgcagtctctcatctctgatcgggatcgtatttttactagcacactttggactactctgttcaagctggccgacactcaactccgaatgagtactgcttaccacccgcaatccgacggtcaaacggagcgggttaatcagtgtttggagacctttttgcgttgttttgtacacgcatgtcctaagaaatggtttcattggttggccctggcagaattctgttataacacatcgttccattttgctctcggcacttccccttttgaagctctgtatggccatccacctcgtcactttggagttattgatattgctgaatgtgttgtgcctgatcttcaagatgggcggaaagagcgtgtaacatcccagcccagggcttaataggattaatagaataatcatataaacaagttgcaacttcttttccgaaagccgatctccaaagaactccagggttaagtgtgcttggcctggagcaatttgggatgggtgaccgaccgggaaattcttcccgggtgtgcatgagtgtgcttggcctaaagcaatttgggatgggtgactgaccgggaaattcttcccgggtgtgcatgagtgaggacaaagcgggcccgtcctgggggaaggcgggacgttacaaaatatcagatgtaagcgggcccggcctgagtgggcccgtcctggacaaaatggtatcgtcctgggggaaggcgggactctcacggtttcacgggcgtgtgtgtcgcagttgtgcaggcatggtgcgcatggctggtgtggacccgaagtggtcacacagcatggcacatgcgctggcactggacacacggacgaaggcgggactctcgcggtttcacgggcgcgtggacccggagtggtcacacagcatggcacatgcgctggcactggacacacgaacgaaggcgggactctcgcggtttcacgggcgtgtgtgtcgcagttgtgcaggcatggtgcgcattggctggtgtgggcccggagtggtcacacagcatggcacatgcgctggcactggacacacggacgtggccaagaggggacgttcctggcctggggttgatcgacgggggcgtcaatctctcttaaggggacgttcctggcctggggttgatcgacgggggcgtcaatctctcttaagggggtgagggtgtaacatccccgtcgatctctcttaagggggtgagggtgtaacatcctggcccagggcttaataggattaatagaatactcatataaacaatttgcaacttcttttccggaagacgatctccaaataactccagggttaagcgtgcttggcctggagcaatttaggatgggtgaccgtccgggaaattcttcccgggtgcgcatgagtgaggacaaagtgtggagggcagtctatgacctatgaaagctacgccgatgtaagcgggcccggcctaggggaaggcgggacgttatagagcgcagtatcattacatccttactgcggcaacatttgcatcgagctcgacaacgtatgaagcaccaagctgataagagacgttctgatcgtcaatttgctatcggcgattgggtgttcctcaaagtgcagccgcatgctcagacgtctgttgctgttcgagttaatcacaaattaaggccgggatgttatagaccgcagtatcattacatccttactatggcaacatttgcatcgagctcgacaacggatgaagcaccaagctaataagagacgttctgatcatcaatttgctgtcgacgattgggtgttcctcaaagtgcagccgcatgctcagacgtctgttgctgttcgagttaatcacaaattggctttccgtttctttggtccttttcaggttgctgcacgagttggtaaagtggcatatcgattggtgttgccagcctcgtgtgcaattcatccggtggttcatgtgtctcagttgcggaaggcatctcaacctcaagtacctgatgctccagcactccctcctgtggtcgcggaggttgatccagttccagcacaagtgttggcgcggcggcttgtccgtcgaggagcggccgctgtgcctcaagtcaaggtgtgttggactgggtgttcttcctcggaagcaacttgggaagacttggagcgattgaaggagcgtttctcggatgctccagcttggggacaagctggttctcaagaagaggggaatgttaccgaccctaatcctatcaagacaaggcccaaaggcacaagacaaaggaagcccaatacccgtgtgagtgggccggactgggttgtgtaagggaacatctgagtctataaagatgttacccgagcaag

SEQ ID NO: 48243 - DNA, 2488 bp, Oryza sativa
cgcatgtcatcgataatctcacatatgaaccaaggtcaataatccgacacatcgaggagacatacaagtatactattagctatgccaaggcctggagggccaaacataaaataatagagatgagatttggaacatacgaagcctcgtatgacaatttgccacgcctgcttggtgttatcgagggaagaaaccctgggagctcttacgaagtgaagaaattcccatcaattgaacatcctggcaagagtgtgctgcaaagggcgttcttagctctacatgcatgcaagatggcattcgtgaactgtcgtccagttctctgcattgatgggacattcttgacaggaaagtatcggggccagatattgacagcaataggggtagatgggaacaatcaggtattgcccttggcatttgcttttgttgagagtgagaataccgacagctggtactggttcctgaaatttggttaaaacaaaagttgttggtatgaggccaaatgtgtgcctgatacatgataggcacgctggcattctgcgagtgatagaagagttgcagtttgggagcatggaaccaggataccctggtgtttgggacgatgtacaaagtaggtggtgcatgtgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatctaccgccgttgatgaccctcctcaatctcttggacgtctcccaacggatagtccaactttggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtatcttagggatcggttccaggcagttcttccctctatgccgaacaacagcattttgtttggaactttcatgcagaaaaagctagaggagttgcgtaaaaaggccatgaaacatcgagctctagtgcaaggtacccaacaacacaggtttgagatattatgtcaagataaggcaggcaggggtatctaccgcaagagagtgaagcaggagtgtgttctgaaagccgacggcacatgtcattgctcttgttcaaagccgaagctgctccacaggccatgcacccatgtcattgctgccgcagcggagtgtggcataccagatgcagtatatgtgtcacagtactttagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatctgcaacgatatggacgagtcggaggctggcagggtgaagcattgcagcaaatgcgatgaacgtgggcacacctacaagcattgtcctaaagacaaggagaaaccaagtgcggcggaggcaggactatcaggatgagcagcagatggagctcgccctacgggtgaaggcactacctccactcgaccacgtcctaggtgtcgtcgtgccacgtctggctacgtggtgtagttcttatgttctatgttggcatgtgggtttgcttgtaatttatttcgaacttatcgatgtgtttatgtttcgtcgtgtaatgtcagacttcggcatgtcatttctttaggtctcgtgatgtaacgtcagactaaggcacctagtgtctttaggtatgctgatgtatgtcggacttcgacacgtaatgttatgttatgttatgttatgttatattatcgaactctacatatatgttaaattgcatgtcatcgttatgtaccattagtaacgtttgctttatttaaatagcctgtactgttgttgtacataattattctcatgattttattactatttcataattttgcgagtcatcttttgttttacattactactttttgaattgttctaacacgaaacactatatttttcagagatggcacgtcaggatacacctcagctgttggacccggcgatagatcagcgacaccggtctcaccttactgcggtgcagggggctcagcttgggacgttccgggcacggacgtgcggtgagctactcacggttcacgactcctttgtcgagaggtacgaacagtgtattactataaattagttgcgctgtaatattttttataatgacatattaatttcttattgcaggctgcgtgaggccggcctgctaccgatgtgttctgctggtggagtgctgccgccggccacgtgtacccgg

SEQ ID NO: 48244 - DNA, 4884 bp, Oryza sativa
agtcagctggcgactggcccgccaagttggcgacttttgttgagaactggttgctcgcaaccaaggaggtcgtggaccacgagggagagccacacactgaggaggcgtactaggcctacctacgctggtaccagccacgcacccgtactagggtcaccttcgctcccttggagcaacagccccacattgcgagcactagagacctctacgccaggcaccgcgaccaggacttcgctcgttgtgtgagtacccatgcatcgcaccattcctttatgttttcatgtctttctcatcgtcaaattttacgaatatgtatgaacaaaataaccatgcaggtggacgacatcaaccgggtcgtcgttgacggttcaacgacgagccaacgtttagacgcggggattccggtacccgtagaggaacaccggacgacgtacacgcggatggtggagtcgattctccgagtgctcacctgtcgtgcagacgacgttgctcgggcagacacagctgtacagcggccacccgtaccgactggtccccgtccagctgcgcacgttcctaggccgactccccctccgcacagaggtaagtatttttaaggatttttctgtacatgtctcgcacatatatgtgagccgtttcacttgccgattgattcagggtttcgtgcaccgttcagcaccccgccttcctcggctaggccttctggtgtgccccccacaagtacttaaaaaaacaacattacttcgacaatcaatttacatgcattttatgtcctagcttacaaggtcccgttgtcgatgtgtaggtttcgcccagttcgctatgacgcaggccgcccacttctcccaggctgcagggtcagcgtctcaggcagctgcgtcgacctcgcactcagcgcagttccagcagtacaccgggacttcgtcacaggcagccggcacgtcgagtcagggtccaccactggaccatgctgggacctcgtcggactgcttgctgtcttccaccgtgctcttcgacatcactgacttcgacttcgcttcaggctcggcagaggacgtcatcggcccctcacagctgggaggcgcaccgccggtgcagacgcaggaccaggcgcaggccactcctccgccagacactcgtgctacccgtgctgtgccaccggatcgtttcacctactcccaggaccacgtgcgagcacaggcccggaggaccaagcgtggtcgcggcgcggggcaggggcagtagagcagtcttctctttgtttacttgcttcacttttcagtattgtatgcttgtgtaatgactacgttgttgttatatgtgcacgatatctttcggcgcatgcacgatacctttcggcgcatgcacgactactttctgccgcaccgatgcagcctcctttattcgcgtgcgatacgagtatttgcccgccatttgccgcatacgaccaatgtaactttcggcgccgatcaagcatgcaactttcggcgccaatcaggcgtacccaccatgccccaccacgttcacatgtcaaggatatcactcgatgaattgcgcctatataagtcgccttaacgagtgaggcctcacaatctttcagaactcaatcacattcagtactctcttccccacttcttcattacaaatcctaccggctttcgtcaatggttagacgccggggtgttgaggatccaaactggcgcagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtggggtattttattatctgcatatgctcatttattccgtataggcaatcgctttattcttcgtaacactactctattcggcagacccgcactacggcttgcgcatacatcgagtgggtcgatacagaaaatcccgtcctcgacctaaccacttgtttacaagaaagtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattctggacgacgatttcatggtaagaatattttgattacatgaatccttattttctcacaacatttactaacttagctcgctttacatctattatttcctcctaggaaccaccaatgagatgtcaatacagagaatggatagacaccagaagggttctaactctacctagccgtgttgtgcagcttgaactaccagagcaatacagggttactaaagcgcggtttgagagaggagagggatcctcacgtaggggttagctattatcggacaacttggcatattgaaatttctgctgtcatgcttccttgtcccattactatatcgtcgttgtgttcaactattgcactacctccctcctagttcaaatctaatatcatctatgtaaccgcaatggaaatagttgtatcatgttcaaattgtactactatttcttcatgttacataattctccttgtttaagtccatataatgtttctacgaccgagactgcgataggcctatattaattatccgagtactaatacgtcgaataaggtacaaaataatacctcacttaacatatgaaattgcgcaacaaccaacttcaatacatttttataacaatattaacaagttttaccaacaaatacttctttatttattattaacattgcatagaaaaatcttttggccgtactttttacatctgggtcccttgccgccctctgtataggcggcaagggcctaatcgtaattttggccgacggcggcagacggcgcggtcgacccaccgtctgccacgccagcttgccgccccaatggtgggcggcagggtctatttttgcaattttgttcgccgatagattatttctgtaaatattaaaaaaaatctaaaaacgaaaaaagttcgttcggcgacacgtaactcaaaccaaaacggaatagtagtaaaaaaacaagggatttgctgatttgtggcgacagttttttcaagacaaaacagttcaatgtgtgtcaatatatcatgggttcgtgtcaaaaaaaaatatcatgggctaggacgctgggtttcttgttttatcgtgacaaccatattttggattttacatgcatgtgttctgcgagagtttactatatttcagagaatgtgctattaaaatatggtactacaaggtgattagactaattacattataattaataatgtagttccagaaaaaaattataatatatatatatagttatattgtaattacatcttcgatacattgcaattatatcatagttgcattgtaatttctctacgtacacatctaagttttgttaaattgtattgagatttatgcagagaaaaaaaaataaggttttgctaaatttgtgtcgacatattttagggcaatttacagtcggatgttttaaccgtaagatccgccgatgagattcgtttcaagcacctgcacccatcgtacagcttatgcgaatgaaccaactgcacctaatcaagctccaacctcattagcacttcacctccgtcgtaaaattaataattacatttatactgatttatatagtagttacaccctacttacataccatttacatatgtaattagtacgtaaatttaggatttacatatgtaattttaagacttacatatgtaattttgagacttatattgtaaatacactaaaattacatatgtaatttaggaagttacaatgtaaatacatgccgactattttttcgtgaaaaatatggcgccataaatatagctactcccaaaaaatactcagtagcacacatgtggagaattggatttgtgaccgttaaattgcttagagattcatgccaatcatgcgaagagagaaaaaaaaaattagcactcccaacctcagttggaggctcacgacgtttgcaagtccagcatgaaactaattatactatagatattttttttatataatactccctccatctacttttgatagtcatatttccaaatctgaaaattttatttttgatagtcatatttcaatccaacgacccatcatcttaatgactttctcgaatttaatgcgtgactctccattctaccacacatgattggttacatgggtattgagaaatgtaaatattaatgaatcgcttgtttacgaggaataactagtagcatgtttaaatggatgataagtagaattacttattcttggtctgtgtgtcaaggtgaaatatgactattaaaagtagatggagggagtagttttcataaaaaacaactatcgaatacagggcggagctatgtatagctaggggggtgcccagtaacctgattcaaaaaaaaatttagctacaatttatctattttcactatatatataccccgttagtttaaacttaggcacccgtatcaagctaaatttgattcaaccagactaaaacaagcgagtggaacccctttattttgttctagctccgcccctgattgaatatcatatagttactccttatcaagcaaactcttctaatcaactagatggacatctacttgtctattgcatatcaataaaaaaaaattaaaaacaatgataaaatatatcaatatataagcatgcaagttcaaattcattgtccataagttatactccctccgttccacgttataaaatgttttgactttggt

SEQ ID NO: 48245 - DNA, 5409 bp, Oryza sativa
atatatatatatatatatatatatatatatatatatatatatatatatatatatatatatatatatatatatatatattatgttataaattaatatatcttgtcaacttctaattaaatttttttcatagctctatggatgagacatgtaatgaataagtagacgtctacttgggggactgtctatccatttgtcgggtgatttttaacaagaaatcatccagatttttctacccttagatttacatccaacggactacaaaagaaaattttatatatatatatatacacacacacacacacacacacacacacacatatatatatatatatatatatatatatatatatatatatatatatatatatatatatatatatatatatatatatatatatatacatacatacatacatacatacatacatacatacatacatacatacatacatatatacacacacacacacatatatatatatatatacttacgcaatatttttatcaaaattacagtgcacttacatctcatatcaactgaatttacaaatgtaattttagttatataggactgtaattttatattttaaagaaaataacaaatacatatttactgacacatcattgttatcaaaattacagcgcacttacatatcgtatcaactgaatttacaaatgtaattttagttatataggactgtaattttgtattttatttttattttagtttcaaatgagagagaaggatagagagcagcgcgaaaaaacaacaaatgagagaaaaaaaaatcgcacgtctaatgatcccactggagttgctgcatgcaatgctttatcctggccgtatgggcccccaccccaaccctggagatagtagcggccagaaaaaacgtcaaatatcaggtaaagaatcacccgagtgatgtatagcaaaatcgattgcggaataaccggggcctcatattttagccataatatcacacagaaacccatcctttttcatcaaattgcatgtcttctaacatttggttgaatattgtctagaaattagacaataaaagaaaaaactttacggttaattttatattattaaacacacataagttcaaggcggtgttggtgaagacaacccgaaataataagaatttctatagatgcaaaggttttgtgaaatgtttagagttgtttagttgcttgagactacggcagtgcagccagcaccaacagtgaggcaaggagtggactgcagcagccgcagccataggtttgccagatgaccaatctctttttacgtaacacttagcacgtattattagaaaaaaaaccccaaaattttagaatttcactatggaatgtttttctctgtcgccatgatctagcaagcaaaactacaatacattgagttctctgattgatgaactgattatgattccaacccaattaagctttacttgcttttctttccaggggttgcccacatgtggtcatgatcaacacagctgggggggaggaacaaaattaataaagcgagttgatcaaacagcgcaagaacagcaagcagcttttcaggcacacatgggggtgtactaaaatagcctgaaattcttccatccttccccaaaatcaagatcccatcggatcatatcatcagtcaggcagacgacagcgcaggcaacagctgttcctggctgtgttgctgccatgcctagcttaggttaattgtgctgatcccacttgattagcgcactaatcgcacctttaatccgtattgcccgtgtgtgttaatgtatgtgcaccgttaacgcgataattagttaagagcccggacaccatggttttctttttctatgaagaaatgttcaaatggaaggataatatatccttttgaaaaagcattgattaccaagatttgtttggaaacaaatttatcagcattatgaagaaaatcaattcatgcacgaaatgaagaaaattaatgtgatccaaacgaggcctaacatggtttttcttttcttaaatataaaaaggtgtaaattacacatatatcgttacctcaaatcatactggattatatttaaaaaaatctctcagattatttttaaaaaagcatatggatggatgcatgtagactatatgtacaagtacaatattactactaactcatgtaaaaagaaccgatcatatatattacaaaacactggcatacgacctagctgtcaactaggctaacaatataattatggaagaggagtgagaaaaaacaagtaaaataaggcacaaaggaagaatatagagacacatttttaattttaaattgtgttcttgtaaagaataaatttttgtttgcattataaaactaagttatattagtacattttaagtggtttacttgtatagcaaataagttacatgctctaccatgtcgagatattataggtgatgaaccggttataatcaccttgaggtatgcactagcacccttgacgagcactctactacctgcctacgctcgtgaaaatggtcattgaccaaatatgtggataaagatgacgtcttcttcatcatgcttgtatgaaaattttcataggtgctcctatttcaatccatgctggactgtgaaaagaaatactaccatctagtttgtttttcagctcgacataaccgaagttgatgagagatcgtgttaggagaactcgtaggctcctccttttttttttcttttttttgccaaatgccgtacaacgtattagagaaaaaataatttataggtaaattttttatgtatgtattcttagcgatttaaaattgaatgtaaaagataaacttagatgaaaaagaacctgaaagcaaaccttaaactttaaattttggaagcgggattcagtatagacaaacccatagagccatagagggtcctatttttgttttgggacagacaggcgccaacttctcagttctcagattcagagcgtaaccgtacccaagaagtgaaaaaagaaaaatcagagcgcgcttaattgtgtccaaaaaatgattgtgtggccctagtcgaggaacccccctctcttctcttatctacccctccccctccccccctcgactccgcgtcgactccactctcgcctcctcgcgactcggagttcaccgccgccaccgcctccgccgccgatctccccgtcccgccgcgccgccgccaccgtcctccctcctccggccgcatccccggtgagcatccatctgcgtgtcctcttcctcatctctccctccccacgcacgcacgcacgtactcgtagcttctgttcactgttctagatctggatacttttcgcttcattcgccttattaaaccttgatgctggtagcagtttgtttgtttgtgtttttttccccgcgcgcaaaaaatgtttgtggggggtggaactgaatcacatgctccacgtctagatccgccacctgagtttgccttgcatcacggtttagtgcttgattctttgtgcgcggttgattatcgcgtactctttttgctctacaagttctagatctcggtgtgtcggactatcgatatgtagttttgcatattctgttttgttttctgttcgctgcaagttttgatgtgccaaatattagcagttgatcttttgagattttgatttcctggagggtttgcgtctagtttctgttggaaaatggccatttcgtgacgtgttgcggcgcatgcctgttgttctgtttttgcgtcaggaattcagaaccagtaggaggaaatggctgacggcgaggacatccagccccttgtgtgtgacaatggaactggcatggtcaaggttcgtggtgctcattcgtagtatttctttgtagcagttatccccatgtttatgtgatttaatcgtatactttacttttcttgcgaattgctggcaggctgggtttgctggggacgatgcgcccagggctgttttccctagtatcgtggggcgcccccgtcacaccggtgtgatggttggtatggggcagaaggatgcctatgttggtgatgaggcgcagtccaagagaggtatcctcaccttgaagtacccgatcgagcatggtattgttagcaactgggatgacatggagaagatctggcatcacaccttctacaacgagctccgtgtcgcgcccgaggagcaccctgtgttgctgactgaggccccgctcaaccccaaggctaacagggagaagatgacccagatcatgtttgagactttcaatgtgccagctatgtatgtcgccatccaggccgtgctctccctgtatgccagtggacgtacaactggtaataactcactcacatggttgagagttttaaaaaatattcactttattcatgaactgttgctcttgatgcaggtatcgtgttggactctggtgatggtgtcagccacaccgtgccaatctatgaaggatatgcccttcctcatgccatcctgcgtctggaccttgctgggcgtgacctcactgacagcttgatgaagattcttactgagagaggttactccttcactaccactgctgaacgggaaattgtaagggacatcaaggagaagcttgcatatgtggcccttgactatgagcaggagctggaggctgcaaagagcagctcatctgtggagaagagctatgagctgcctgatggacaggtgatcaccattggggcagagaggttccgatgccctgaggtcctcttccagccctctttcatcggtatggaagctcctggaatccatgagaccacttacaattccatcatgaagtgtgatgtggatatcaggaaggacttgtatggtaacattgttctcagtggtggatcaaccatgttccctggtattgctgaccgtatgagcaaggagatcactgccctcgcaccaagcagcatgaagatcaaggtggtggcaccgcctgagaggaaatacagtgtctggataggagggtccatccttgcctcccttagcaccttccaacaggtaaaccttacgcctacactttatgaggtagcaagaatgcaggtatttctgctttctgttaacatcattcttttggcatctatgctacagatgtggatctcaaagggagagtatgatgagtcgggtccagcaattgttcaccggaagtgcttctaagctctggctttttaatcgcttatctacaaggcagtttcttttcagttttcacaagcccttgtcatgtaagctactctgtttgggattgttggtgtcctatcagaatgttgttggatttgtttcatggctgaatattatgcaccttctgaactctggtatgcatttgtccggtggctgctgtattatacatggcatgcatggtccaacttttgtcatgctaagtttgtggttagtggtaggaccaaaagaa

SEQ ID NO: 48246 - DNA, 1675 bp, Oryza sativa
cgcctggccgtggcgccgggccaccgcgtcgagcagaagatgtcgctcacgctgttcatgaagcacgggctccggatggaggtgcgcccgcgcgacctcgccccgatcgtcgacgagctccgcggcgccggggagtacgccgccgcggcgcgcgccaccgcggcctgcgcttagaagatcccgggcgttggacgaagtcaattggaaatggcaaaaaaatatgtagatagatgagagtccaagatagtaattactaaagggtttgtatggttggtgaggtcatttaaatcacttgcttttacagttcattaccagtcgatagaggaaatgtctaaagaaaactccaaacctaagattcttagatcatgtagtactatgattttggttgtgcagccaccaaaattaaggagcaataattaataattaatctcctgtgtgtaacccaaactggcaagtccaaattcgtctgggcggtttgtgttaatgtgccgccaattgttgttggatggttgcttgttcagagagctgaaacatgtcgatcaattggttaatctctcttaattttgggcattttaattgttgatagctactcgtcaaacacttcattgcatgcatgtagtgggtgttcacggttctagcttcctctctctcgatggaagtctcgatcgatcgaccatgtcgatgaacatgagcagtacagcagtcgctttccatgtaaacactctaaattttttctctaaactttcaacttttccatcacatcaaaactttcctacacacaaacttttaacttttccgtcgcatcgtttcaatttcaacccaacttttaattttgacgttaaacacaccctaaagatcgctcaggactttcttcgatgcatttggcatttcgtcgatctaatcatttttgcaatcggcgtttcaatgctgctgctgtctgcaccgtcttcactggtgagctacctgcaataccaacttgccaagtttcaatgaataaactggctgatcatgaaatctgctgatggcgatgtcgcttgacagctctttctctgcgggtcattttacagtaccttttactagcgatggcagtagggtagtataaatcaaaactgaccgttgatttatacgataatttttactttatcctgtaaattgtaagggtatttctgaccatttatctattagagaaagttatatcgccggtgtagccgccgagaaacccggaagggtcaacctcccatttgtgcgacccgttggacggcgtcggcatcgccgattatgctggccacatttcttgtgtgtgctctgccggcgaattactgccgcatcgaagactggtccagctgccgtctgataatttttggccatcgcggagacgaattgggaccacctatacatttgtcgacaaattttctactaaaaatataacagatgtaattatagtataatcgtagtgtaattacaatgtaacttgtatgtaattacactgtaacttgtatgtaactacagtgtaacttatatgtaagtttcacgtaattttgaatcgttagatctattacaagatttgttctatggaggaagaaaaaaatcacatcacacacatatatgaaagaatttgttcccacgacctctattttactgaaataacatgttaccgagagattcttgaaagtta

SEQ ID NO: 48247 - DNA, 1161 bp, Oryza sativa
gtctttattaagtgtaaatgaatttggatccataactcaacatgcatcgcatttgtactcgaaaaaaaatgagagatcgaaaaagtttagaccaagcatcagggaattctaagaccctctttgtttagtcttataagctaacttataagtcaaaatgtctaaacctaaacaaacaagcggctttttcatttggctttttttaagccataagccactctaacactattaaaccaaaaactaggttggagaagcttttttggcttatgtgaaatagatgcatgactctaccattaaacttagaacattaaatctaccagcttataaatcatataagccaataagctaacttaaaaatctaaaccaataaacctaagcccaaacaaagagggtctaaataacctcttcctaattatcgtggaaatcaaatttattgtttttgtttatttcttgatcgacaaagctcctacctttctctttaaaaagattgattcttatgaatctcctactttccaacataacttaggtggtgtttgaatccagggacttaactttagtctccatatttatacactaatttagagtatcaaatatagactacttacaaaactaattacataaatgaaaactaatttgcgagacaaattttttaagcctaattaatctataattagagaatgtttactgtaggatcacataggctaatcattgattaattaggctcaatagattcgtctcgcgaattagtccaagattatggatgggttttattaatagtctacgtttaatatttataattagtgtccaaacatccgatgtgatagggacttaaaagttttagtcccatataaacaggttcttactgtaacaaataggtggaatggtccatggccaacaaaaaaaaaatctccatgcaaaaacaattgtctcttcactgcggactcaatgaagaaactggtagccaccactgtctcccctacggtcctaccccttcgctcgcaatttctgggcagcaatctcagttcaacaatttgggatgttcgagacctgggccatattccgccgccaacaaccctttcatccaaattttttatataatttagaccttttaaaaaaactagaaaagtagcccgcgcagttacgcggacattttatttaagccat

SEQ ID NO: 48248 - DNA, 1200 bp, Oryza sativa
tcggcaagtcggggctcatcggcttgtcaggccccatcgggaagcccggcgccttcgacgacgacgacgacgacccgttcgtggacgagggcctcgccgccgacctcaagcgcgacacggtcgactgcctcctcatcctggaatgggtcggcctcatcgtcatcatgggcgcgctcgtctgcagcctcagcattcgcagcctcgccaacaagaagctctcgggtctccacctctggaagtgggagctcctggtgttcgtcctcatctgcggccgcctcgtctccggctgggtgatccgcatctgcgtcttcttcgtggagcgcaacttcctgctgcggaagaaggtgctctacttcgtctacggcgtgcgccgcgccgtgcgcaacgtgctctggctcggcctcgcgctcatctcgtggcacctcctcttcgataaggacgccaagcgtgattcccacacgctggtgctcccttacgtcaccaaggtgctctgctgcctcctcgtcgccaccgtgatccgcctcgtcaagacgctgctgctcaaggtgctcgcctcctccttccacgtctccacctacttcgaccggatccagacgcactcttcaaccagtacgtcatcgagacgctctccggcccgccgctggtcgacgagagccgcatgctcgccgaggtgcagaggctgcagagcgccgggatcaacatccccagcgagctcgaagcaacggccatgccgagcaagccgcccatgccggccaagagcgggcgcctcacggtgaacccgtcgaagcgaggaggagcaggaggtggggccaacaagcagctgcagaagcagaaatccgaccgccattgcgacgacgggatcacgatcgaccagcttcacaggcttagccagaagaacatctcagcttggagcatgaagaggttgatgaagattgttcgttacggggcgctgaccaccatggacgagcagatcaagcatgcaaccggagaggacgagctggccacgcagatacacagcgagtacgaggccaaggttgctgccaagaggattttccacaatgtcgccaagcctcactccaagtgagtagcagcgcaccagtgctacacctgtttttcatgtacaaaatcttgttatcaaatttcatggctatatgcctatccattcctgaaatgtcaacgtgttgcaggcacatatacttg

SEQ ID NO: 48249 - DNA, 1351 bp, Oryza sativa
gaattgtgatctggcatttcatatcaccaaaaacaaaatatgtgagaacaatgtgtattacttcttggcaaatgaagtatattttgtcacttgcgattaccttcttatcaaaccataactttatagagaccacatcaatcgtggacagatgaagaagattaacaaattcttgccgagactgtagaaacggactactccatagaagaaattcaatagtcagagaagcactcaaatatatgaaaataagacatgtttcaagtgaagaaaagtgctgttcctcaagcagtacgtatttctatagcaatcttagcttccaagttactgagagtaattagtggtgaaacaggcccaagattcttgcagtgactacctctgtaacttgtatatacctgttcttgatgatatattgtagcgaagagagtccattagccaaaacaaatgcatctgcctcatgtacctcctctccacagacaattccagagatacatgcagtgtccttatttatggccaaacttgttggcactctgtttccatggaattttaagccttgcagttccagtgatttcaaccaaggagagaaaattatgtcttccacttccccacggcacaacaaaaaatcagagttttcctgtaaatttgggaatttctgagaaatcattggaaagagctttgttgatcaacgtaaatttgaatgaagataagaagaaagaaaaagggtaaaaagtaagggggagacagaacagagaacctgatgagagagcatatagtaatacaacatccccagtgttgcagctgcactgcattgctcacctggagcaaacagggcggcctgaattgctggttgaaaaatttccttgtagagtttttgagagcaaccgaacatcttaaacagatctcttgcactcactgcaggaaatatgacaataagacatgaggaagaaatgatctactataactatagctgtcaactcttataaattgtgcaatatgtactaaatttcctcacttgcatcatatttcatccaagcagtgtctgtgttgttgaagtcaatgactagatcaaagcaacaaataagtggttagaactgaggccattagcatttaaagacagaacctggacagatggacgtgcatacctgcagccatgacaggaatcgatgtcaacctatcaattaaaggaagacttgggaactgtaacaaagaaaaattaggatagtatgagaatatggggtggttgggactggagagataggtagcagcgaacacatccagacggaataaatcatacttctggatatgttaacattccaaagggagctggtaatcggggctggtcatgaaaaatgggaaa

SEQ ID NO: 48250 - DNA, 2640 bp, Oryza sativa
  unsure (1)..(2640): unsure at all n locations
tgtgtgccccacggaaagtgaacatatatttccgtttatgcatatatttgtaacagataattggactttccaagaacaatttggtatgcaaggcgattagtaatcggtaatactaaattgtggcatatagataatcaacataattatttcagatagatttgtataattaatattctagttttatatataatgtgtaaatcgcatgggattcatatgtcaacgacgacatcatttgaaatttctctccataatttttttaagataatagaatataatttttgtccataattgttatcctagaataagttaaatcatttatcaccctgtagcaacatttttactcgaagaaaatattaagttatgcagtgaacaacccgattaacaaatactctgtagcaacgttctctaatatatttgttctttttcccacaatataaaaatatagcattattctctaatctatttgtactccatgttctttcataagttgacttgaacaatggttcaatgggttatggtttatataatcgttccacatcatatcaatataatgtacatgtagctgatatcgatttatccgtaataatagtaaataattaatgatttagtgttatggatggtattatatgcagtgatatactgtatgtgatctattagatcatctgttaattaacccattgcattattttcttctttttctttttctttttctttcttaacttcacatcattaaaaatccggctagacatcacacacaattattcattcccctactcgtgtccatgttttcagattatttacaagatttcccctggatttttttttgctgtggcctctactcagggcttataattcagtttgtgcctgtggagcgcgcgtggtctccctctagaatttcccttttgcagagttagagtgccaggccgcggtgtgnggccatactaactagaaactatagagcagtcaactctacgccacgctgaggtgaactgaacaccctcatcgagggatcaccgagtgacaatggcgaccattcttcttcttcttcttgggttgcttgtcggcctccccctcctccgcgcccatggcgtcaccggctccgcggccccgacgccgccgcctctgccggtcctccccgtcccctcctacgcgcagctccagtggcagctctccgagatggccctcttcctccacttcggccccaacaccttcacggattccgagtggggctccggccgcgccgacccggccgtgttcgcgccctccgcgctcgacgcgggccagtgggcgcgcgcggcggcggcgggagggttcgggcgcgtcgtgctcacggccaagcaccacgacggcttctgcctctggccctcggccctgacgaactactcggtggccgcctcgccgtggaagggcggcgccggcgacgtcgtcggcgagctcgccgccgccgcgcgcgccgaaggtatcgggctggggctgtacctctcgccgtgggaccggcacgagccggtgtacggcgacaccgtcgcgtacaacgagcactacttgggccagatgacggaattgctcaccaggtatgtcagcgattgcgttcgaattgcgagattattgttgtattcgtcaatggggatcttgcaggtcgactactgaattttgggttcaggctgaggagagcttcgatccagatgtggctgtgcgcttgtgggaacataaactaacattgcatttctgcatgatccttttcagaaattggtgatcaaaagtagttatgtttattagtgggttttttttttgggaactttttctcggggcgcagtagtcagtgcttaatttgtgttgtttaatcaaagtcgctacacttttttcatgagtcactacccttattccaattatctatgatgatggaatgtttaatcactacgcaattatctatgaaaatggaatgtttaatccctacgcatttattgttttgctttggacttcgagtaaactacatacactcgatttgattactgtacacgatttctcctgtgtaaagattctgactatacaagtgcaggtatggagatgtggaggaagtttggcttgatggtgcaaagggagagggcaaggacatggattacatgtttgatgcctggtttgcacttatccatcagctccagcaaagggttgtcatcttctcagatgctggaccagatacaagatgggtaggagatgaggcaggggtcgcaggttatacttgctggtctcctttcaataagagcacggtgacgattgggcacatcattcctgagtaagtaacagtattattgagctggggaaaaaacagagtgctgtttacttctattaagatcctaatcaatcatatccctagtcccctggataaaaatgctagaattggaattaagtaactctaataggtctgcagagtacctaacttcttaaaaggcttttctagttatctaaattgttctcccaaatcacatcaatggaaatttcaattatgtaatgcaaatattttttgggaacaagacaactttttacttgtgggaagataaaattgtatcatgcataggaccaaaactccaagcattccttccaactgtctgccgtgataagtttaaagtttaagcaattactgat

SEQ ID NO: 48251 - DNA, 2596 bp, Oryza sativa
cctgcccggcatgcactactccctcggcgactcggtcggcatggccgagctcgtcctcaacggcacggtcctacctggcgcgagtacgtcctctcatctcgctgcaccagtggctgggcatacgaaaacgttgcagggtccctgacggtgtagcgatttttctgcagattttacggtgctggacaggccgtgctgcggcggcggcgttggcgggtgcaacgggacggcgccgctgtgcctggatcgggggagttacctcttctgggacaacttccacccgacggccgccgcgtcgaacgtcttcgcgcgcgagctcttcttcgaccccggggcgttcgtccacccgatgaacgtgcacgagctggcggagctgcggccgtagaagggcacatcgtacgtgtgcttggattggcaaagtgttagtgctggtactaataagtggtggtgtctcacggtactatctccgtttttaataaatgacaccgttagctttttgtcgtacgtttgatcattcgttttattcgaaaaatttacataattataatttattttgttgagagttgttttatgacttaatgtattttaagcataatttaaagcttatatatacatttacatgaaaattttaaataagacgaatggttaaatatgtctaaaagttaacggtgtcatctattaaaaacagatggtgtattatatagagtgcaattcagcaggtttcgcacatcggcgtgcttgtcgtgcgagattcttcacgtacctgtctttttgtcaggattggttatgaacaacattggcaagttaattgatcgcagatcgttttatcactaataagaaaagaattactctgaagatcttggcccgcccttcacctgatctctgaagaacattgaacatctgtgtgacacgtgccttagcacaaatcgtagagcagcgtacctctctgttctcctctacggcgcaaagcttctctctgcggagcccgccactgttcgcctcgaggccgacaaccaccgtggacggcgacgcggcggcgagcggctcggcgcccccgacggccgaggcatcggcggcgatttccgctccattacggtgggatctgcaccggtccgttcccggccgcggcaggatcacggtgttctcacgcccaaccgcagcaggaacggcgatgggcggactgcgagcctcgctgttgtgttgaatgcacccttctcctcgctctgctctgacctttacgaccggtgctggtggccgccggtaggcggcgagcagcaaggaggggggaagaagaagggtgaaattttgagaggtttgtttgctttgagattagtgttaaatcaggtggcccaagttcagatgaaggaaggaggtctctctctccataggactagtctgaactagaggggattaactagggtttaatcaaccgcgtcgaggaccatggcggccgcagcggaggtggatgcggaggcgaggagcatcctcgaacgcgcagcggcgtcctccttcccaccgctccacgccatccaccacctcctctccgtcggggttcgtcttctcagtcatgccctctgctgcacacttttcactatccaatccatgttcaacttcccccaattccgatttcacctattacggaaatatttttggatagcgtactgggtgttacgtattgttcgtgtattactacgattatgttgtgggatccatttcctcccctttactgaatgaacatttcgatgccatgctgaacccaatgatttttcagtttcacacacggagaaatttgtcaacatttttgcacaatatttgcaggtctgtgtgcggtgcatctttcggttctttggagcctttagttatgcagcaccatgcctttctcttacggcatcagttctgcattcgtttcttgaagagcatgacgattccgcaaaaagtgggtcttgttcatgtttgtcaaaagatgaggcgtactgctctatttgctttggagtgttactgcccacctgctatcaagatgatggtgtagaaccactccgtagtgtttctcctatcgataatgttacttcaattatatctgaagcagtccagagagagggtcaccaagtcgatgagttctccctagaaatttcactgcctgcagttatagcagctaatgatcgtgccattaggtaaccatctgcacctaagaatttttgcctcacttttttatacagcaccatgaattggtttgtgactgaagggggtgccacatattaatcatttttaaaagctaaaattatgtaagtggtgatatataatgcaaccatttgtaagtgaaaggtatttacatttttttaattagcaaaaaattcagagaaatgaagtatattcagtcttgatggataataattatacttcaacaatttactgtgtttgttctcaaccacagatggaactttctgttgtgtgcttatattaaatctatgatgacactgcactggcattttcataacgtgctggcatttgtgtctttaataggttatatatgaaagagaaatatggcagtgcaaattggttcgatgaaaaaatatttactcaacagacaatgtcagtgaag

SEQ ID NO: 48252 - DNA, 865 bp, Oryza sativa
ttaactactcctactacatttgtgaatccggtaatcttcactataagattcttcagtaataagtaaatagtttgactgccgatacaagcaggttttgctaccttcgcatacccttcagatgcaggtgccatataaatctgggaaatctcaaaaatctaactagtaccgttgtatcatctaacaatcaccaaaaatgtgatatcagaatgttctgggacaaagccagcgctcagtagaagcttcatgcgaacaaacagcatgattaccaggtagaaacacgattgacaggataaagaaaaatcatgcggtcaagcttctaaatcaaagtatcagtaactctagatcataatgcagctaattcaggaactcaagatttagatttagggattccaatttttaattttgagggcctagttttagttctactgctgttccgctctgccttaatggatgcaatcacagcatcagcccccggaccaagacctttcctgccaactaatttcacaccaagcttttcacagaggtaatgcagcctcatttcatcacctcctctaacctctcttagctccatagcctgctgtcgtgatagtaatgtgtagacataaagttgttgttgctggttgaaatgtgattggagttgctgaaacaacaatttatttgagtggtgctggtccgcctttcccccttcagttgcacctttctttctagggccacctagttccaccttcagaatggctggggactttggatcagaagcttgtccaccaaaaatgacagagaagctgccaaattccaaatctggttgcctaaacaagtccatgagtagagcagcacaggcctgtgtatttgttgatggacctttttc

SEQ ID NO: 48253 - DNA, 1189 bp, Oryza sativa
tgctacaacacacctgtaataccatggtttaatgtcgtgcccaatcatctataatacaagaaacacggtatagtgattagatggcaaacctatgcagtgctggatcatcagaaagttttcctctggctctaaaccaataatttaagctgaaagaaattggatacatttttttagataatggaatagatgcactaatgaatcagaacaatgtattaaattgcaatgtagcaggaaatgcgataaattcttgcacaatggaattaaaattggatgttttcacagtggaatttagaatcgtgaatatgaaagtacacaagaatttcgtggtaaacttatcagttatcaccaactaggggaggagagaaggtatgagcaggctgcactgaaagaaaacacagtgtgtacataccttggtttatgttgagatgctgaatcttcacaaaacctcatttctatgggccaaggtacgaactttttcttggcagctgagttcctatattgcctgcagatgactaacagtcaagactttgccaggtggcatgcgactgtggcacgaaccaaatacagttataattgaagcttaagaagatagaatgcttgatttactaaacgtgagaaatactaccagataatttctaatttatgtaataccagatgctagattcatctgagtaatggtgacaaatatagtgtccgagaaataaatggtgacaaatataatgctttctcaataacataaaagaagtttattctgaagattaaagatgaatcatctgagaactgcattagctaggaaactatcatcatcaaatatatggttggaagtcatgaaaattacattgggaagcgaggatcagtaagtcttctttcccgtatctcttccagattcaggagctgcatttgattacctattaattatcaattcttctttcccatatacattacaggaaaggaaaaaaaattacctcttctggaggaggaacatcaggcatgattgcagcttgatgctcaaaccctaattcgtctttctgcaacataattgatcatgcagaagttagataccatctattcttctgctggcagatttagtctcacgaaccttttggcttaatgtataaagtagtataaacatgaaaatacacatttcctcaggatttaacaagagttcaaacagttcgttatcgttgac

SEQ ID NO: 48254 - DNA, 2101 bp, Oryza sativa
aacatgtcaactcaagaaatccttattaggctccgtttggcattagcggtggattttggtaatctcatttggttcaatatatagtttttaacatgttggtgtctttttttttagataatggataaaattcggcctctatatccaaagtggatatacacaatcaaagtttacacgagtgcatacattctaaaactcataattgagaaacatgaaaaagaacaaccgaaaagaaaaactagaagactagctctaatcttttcttcccaggttcaaacttaaaatagatgcggagctagcccgcccttccacatgttggtgtcttggcaaattgcttcagctcaagatactccctccattccaaaatataagggacaaccacccttaacccaaagaccaagaaataattattatcatattgtagcttggatcatcctaataaatattaatgcatgcatccaatatgattagataacttgagagtggatgatttaaaaaagtaataatttaatgtagaagatatcatagttaattgcatgtttgcatgtatgtctattatgaaacatgtaataaaaatagttgtgccttatattatggaatggagggagtacttattaggctccggtccgtttggcatttgggatggatcctggaacctcatttggtccaacagctttattttagtattttggtgtcttggcaaactgcttcaactcaagatccttattaagctccacttggcattcgtgatgttgcaaacagtaatattatgaaaaatataaacaataggagaaataatgaaagttggataatatattttctctattcgtaattcaattggcaaaataaactacaataatgattatatgttttaaattttcacatcaactttaaaatataatcacagcatatatagcatatataacacaccagcatctatttgagaggagtgtcacgtctgcatctatttgagaaacaggaaaaaaagaataaatgaacatatatcatgattaaggggccggggatgaaatcacatctcgtcccctggagtacaaaatcaatgaatggtcaagatcagccgcgtgcactagtggtaaaaacagcaagaaaaacccgtcaccccacttccgcggaggaaaggattaattcgctagcctccacatacatgagcctaaacctaccgagcgaagagtaaagcaccatcaaacgttaacacgcgtggcaatctagtaatcatcatcaagcggctatctcttaggctccgctcgaccagtgctctacgccggtgcagcccccatggaggcggcgctcttgccgccggtgccggcacagaaaggatcgggctgcgcaccacgtctttttccccgacacccacttcagctgcccctcgatcgtgctggccggcgccttgccggaggccgtcttgacggtgaccgtgtagttcagcacctcgttcagcgccctgaactccagcttcgccgggttcacctccaccgccagcgtcgccggcacgtccacctccacggcgtacgtcgaggtggccgccccgacgttcgtcgccgaccggttgatgctcacctcgtacggctccatgtccaggacggccgtgatggacgggtagttgagatccttctgatcgaccttgggcatcttggcgcactccaccgccggccccgggtggatgatcgagttcaccttctggtccttgtacccgagcccgcagaggtaggggatgtagtccagcgacgacaggttgtacacgagccccgggtcgatggctttccgcgcgttcacgtagccggcgccgatggcgtagtaggtcgccggcgcgccgtccacgtcggttatcggcttccggaggttgtcggtgtaatcggccgtcgtcatcatggccgacttgatggcggcggcgaccacgtcgggtgcgcgttcttgatcagcgcggcgaccccgctgatgtgcggcgcggccatggaggtgccggacttgatgtcaaacttgggcatcacttcctcgggcccgagcgccaagtcctcgatcttggggacgccggcgaggatgttcactccggggcctatgatgtcgggcttgaggatccccctgc

SEQ ID NO: 48255 - DNA, 2017 bp, Oryza sativa
tgtcgtcgcggtcgcagcccttctccacgtagcacacctggtagaaggcgatgtgcgcgcggggggccatgccgcccgccgtgccgaccgcgtagccggagacgttggcgccgggcacgaacgagccggccgccgtgctggacgtgtgcgtcccgtgctgcccctcgttgatcggcaggaccgggtcgcgcagccctttccacttccacttcgccgactcgaagtaggagcgcgctccgatgagcttgttgttgcacaccgtcttgttgaagtcgcaccggccgctccacttggccggcggcggcttcatgcccgccccgtcgaacgacgggtgcccggcgtagatgccgtcgtcgaggatcccgatgatgatgccctcgcccatgttgctggtgttccacacgccgccgcggcgggcgccgcccatgaggccgagcagctgcggcgtgtgggtggtctggagctggtacgtcttctccgggtcggcgcggatgaaccagtcgttcttggacatctcctccacctcctccggcgtcaggcgggcggcgaagccattgacgacgttgcggtaggagtagatgagccgggacacggaggaggggtccctctccagcgcctccttcgccatgtcgcacaccgacgccaccagcgacgcgtgccagctcgacacgttcttgtacaggttcgtgtcgtacgcgtacggcttgcgcacgatgacgaggtagttgctgtgcaagccggtgtcatcgtgcccggcatggctcgccgccggcgtggccgctagggagacggcgaggaggaggacggcggcgccaacggcgagccgcggcaacgagcaccgcccatggttacgattgtccattgagtgcggcagctaaacgaaatgaggtctaggagggagatgtccaagataactaacgttacatattggacgcttcttctcgcggtctaaaaatggtcgtatatgttgtgtggtcaaacgataagatgcttaatatagaaatggcatgcaaggtcatggggatcatctatctatgttctgtgaccaggagttccattgagcttagcatgttgttcctggtctcacagcagatctcgtgggtttagtccacgattaattaagtacttcactaagacgcggtcagacttggcacattttttaaaattcatatttaactttaaatttctcatatactataatgtttgtagtaacaaaatcatattttttaacgaacgagcaagctgccaatttcataacaaaatcttaatcatatagtaaaagtgaatgtaaatgataatccaatgatattattttcattacataaaatttaatttataataaaatatttattggttaaatatttaaagagttgaattttaaaatgtgtgcgccttaatgagcgggacggagggagtgttagctaaataagtgggaaaaatggattaatataattttttaaagcaactttcttatagaatgtttttgacaaaacataccgtttagccgtatgggtaacgtgtggatgaaaaacgaggaagtagaggatatgaaagtgtagagaggaacacagcctaacaatccatagaacaaatcttatgatgtctccgccccaaaatataagtaattttggatggatatgtcttattttttgggacggagggagtagcagatcaaactggttactggatattaattgaattttctttttaagaaaactactacattctattccgtaataattgtatttctatcatttaaattttatataaaagaattatatttgtaataagatgatcccgttcagttagttacttaaacagaaatttcttgccttgcacttttatctttttcatcctcatctatctgaacctttctttttattctatacacgtagtgttaccgtggtcagtatttataattttgattgttggatcgaaaaccatacgattgccctgaaaaaaaaaaagaagagaaaaccatacgattgaacacggcaacgagcaacacgttgcttgt

SEQ ID NO: 48256 - DNA, 1240 bp, Oryza sativa
aattacaaagggaataaatggaactcgacgatacccacgagatcgtagtcgagttgattcgactagatcacccggcgacttggctcctgtaggctccggcttcgtaggctgtggtcgttgtgttggctataagattcgatgccttaggtcctcccaggggtcccttttatatcgcagatcaggtggtctccaagtaggacttggagacatcggaccctgcatgatatagtgatgacccagtcctatacgggtaggaacctttccattagtggacttcgtgatggatttccttagcgtatatagagaacgtccgtacgcgcgcagatgtaccatattaccgtatagcgtacatccaaaggtagagggtatagtttatccgtaatcctgacaccgtgtccaatgtatgactgttcgtcttattaaaaaaattaaaaaaataagttaggtataaagtattattcatgctttatcatgtaaaaacaataaaaataatattcatgataaaattttaaataaaacgtatagttaaacgttggacgtaaaaaatcacaaatacacttaaaactggacatatggagtcaaattttcgacacattttgctatcagcaacgggtttccggaggatctctgccccagaagtgggtcaaacgcacgtgagatcccgcgaagcacatcaatggaagaacgaaagcccctctccctttttcttttttcccttttccttttcttttcaagccgtaatgaagagatcgagcgagaggcccaaaatgaccagcacagtgcgccgccgctggtcgcggagatcacttccctccttccgagttccgagcagtctccggcccggcgcatgcatgccccgctcccccccacgcatatataatcctcgcccgcgacgctcccgcgcccgggtagcttagacgaccactgctcatcaccccgttgctctcgcgccgccctccccgccgagccaaaaagccttcctcctcgaaatagcacacctctcgccgccgctggtgcgtgcgtgcgtcgacgcgcgcgatcgatcgatgcctgtgtccctccggcgcgtccacccacgccagccggcgagcctcgtcggcgagtttcgggggcgctgattagatttgcccggtctcgatcgattgatcggtctcgccttcccgccgcgcgatggatccgcgggggaagggcagcatcacgtcgcatgcgtcggacaagtcgtcgcggtcgggctcgttcg

SEQ ID NO: 48257 - DNA, 903 bp, Oryza sativa
tcctgaagcccctgagagacttgatgcactcgaataaattgcccaagatcaggatctgtaggccggctggcaaagagatcatccgggcttcttgatgggattgcaaatccctcgttgctgtaggttgattgcttcagatggttaaaaggaatagcaccattaccaccagacagaggcgtggaggtgcctgaagtagttctggggcttgaaataggagaaggtgacattctgccattggaatgttgtggggaccttgattttagcaaaggacttccacatggagaaactggacaagatatattgcttcgtatacggatatcactgtaaagttatttaaggattagaggctgcacatatatagggaagttcaccgcaaatcattttccaggtaagactgagtttcactgaagagaacacaagttactaccatatggctagtggtgagatactcattcatactagtgctaggatactcattcaacttagattagccatttttttaacagataatactttgtacttgctttattgcacacattgtttggacttaggactaatactattaataaacacaaattgggaaatgatgtacctgtgttttgaagaaaattttgcacctcttctctggtaaattgtctgaccctccaatcccaatgaggaaatatttcttgtatgcgcagccatctgaaaactcaaataataccaagcaaagtgaacaggccatgaattatccatgtaaccatgttatgtcagttatggcagtattcaagtggtaccttggcgctcgatctacaagatataacagccaaatgttccaatggttcagaaagaacagatttctctagtgatactgctttttgaacaaatgggtgctgcaaaagctccattgcagtgggacgttga

SEQ ID NO: 48258 - DNA, 707 bp, Oryza sativa
taaagattttcagtgatacctctggagccatccaatatggactacccttaaaggagaaaggacactgctgcccattgatctgcataaagacacatttaatacgtattaatgagtaaaatacttccacattatacaaaaggcattttgtaacttatcaggagtgagggggctagcaaggtttcaagcacccttaacagcagtactcaatcaatgcattaaccagtgacaggagctacaagatcaagttgatatagatactgctatatattttttgaagagctcgatataattcaaacagttgtgactatgatatgaggcatagatgcagaaatggaatgacacggaaaataaagttcaattgacaaaagtcattttcaaaaaattaaagtgggcagaaaaacttacatgttttgccattccaaaatctgcaagcttaacacgaccactaggatctactagtatatttgcacctttaatatccctgcaaaattgtgatgaacaggacttataattacaccataattccaccgatacaaacaaaccaaagaaaagagagaaaaccaaagaaattgctacctatggactgtattcttcgcatgcaaataagccaaccctgaaagtatctgctgtgtgtagctgcgtattgcttgttcaccaagctgtccatactcttgtagaagtttatggatagatccaccagatacata

SEQ ID NO: 48259 - DNA, 1327 bp, Oryza sativa
ggcgaccaggccgaggtccgacatctacgtcaacctccccgccctcgagaagctcgacgacatgcttctcgtaagacccgattctgctcgcgctatgttcatctccatgactccatggattggcttcttgttcatcgtgaaattgctttgcttgttgccgtgcaggagattctggacagcttccagaagactgaattctggtacgtgaacgacaagggtcagaaggatagctgcgccgccgccgccgcggcgccgtgccgtccggtgagccaccgcgacggtgacaagtggtggctgcccgtgccgtgcgtcaccaagcccgggctgacggagtcggcgcggagagacctgcggcagaagcacgactgtgcgagccagatccacaaggcggccatggccatcaacaatggcgttcttgcggagattcgcatccctgagctgtacaagcaaacgcttcccaaggtacagcaacatcaaaaatctctctctctctctctctctctccccccttctctttctcgatacaagagcttcaaatcttccaattcgaggatttctcccaagaatctgaattctgatcctgtgcagtgcgggcgggcgagcgtgggcgacctgatctaccggcacatgtcgttcccgggcaagttctcgccggagtacctcctggaccggctggagatctcgtcggagcacgacgccctcgaggcggccgaccgcgtcgaggcggcgatgcacgtgtggcggcggaaggcgagccaggggcactccaggtcgccgtggagcgccgtcaaggagctcatggagtccgacaagaacgtgatgctggcgagccgcgccggcgacgtcctgctctgcctcaagcagcgcttccccggcctctcccagaccaccctggacgccagcaagatccagtacaacaaggtaaccacaccaacccatcaccagcaacgacgtgtcgcgacatcatcgccatggacgaacactaacacgaagctgctgctgctgctgttctccgtgcaggacgttgggcaagccatcctggagggctactccagggtgctggagagcctggcttacaacatagtgacgtgtatagacgacgttcttttcgccgatgagtaaagcaaggaagatctgatgatcatcatcatttgttcatcctgccttgccttggtccgggatatcaaaatataagggtccatggccaaatcccacaatatgtacattatgccaatactagaatgtagccatgtaggactaatggaagatactagcacaaggaaagcacagtactctattggcctagctaagctagcaagtagtagca

SEQ ID NO: 48260 - DNA, 1281 bp, Oryza sativa
taattgcagttgaagaagacgagcctcatatagagacagcacggaatctcaatagaagagccaacgaattaaagactcagattcctttctcggagttctttctctaatcacataactgggagcttttcagtatgaccatgagatttatgctctacaactcattcagaaaaaaggtcaagccagttctcacttccctttttccccttataggtcaaaccagtttttcgtacataaaaaaaaaaggtcaagtcagcttttagtatgatcatgagatttatatttcttttactgttgtgcatattgacctgacagacctttgtcattgacgcttcaactgaattaagttagcaataattaaaaaagtagaaaagaaggtatatccagtcttctggagttgcggtaggtaaatttcttgattctatatatgtttttatttgcatactggttatcaacaaatacacatactagatcaaaccacaacagccaaagcaactgcttttggggttaacttttttgcgtttcatctgcttgcagcatatactcgaacatgtctatacaaatttattcacaaagagaccagagagtttcctcaggtttgtattcctttcctcatcatttccacaaactcttcatagtcaattctcccgtcctgtgaattcgatggaggaaataattaaatccatgggaatgaccctaattagtgaaaataaaatactttaggtatgctttaccttgtctttgtcaacttcatccagtacttgtttaatgtttgcttcatcacccattccgtactctgccatggcttgttccagttcatctcttgttatgtacctggaattgtttttcatggtctcttgttaatatatactgattttttaacaaacgagtttatagcaagaaaaatatgatgcaaggaaagcatgtgttagacatcgttacacaatgaacatgattgttgcgcagaacaagttccagtgttggtcaatttagagctctttattcatggtgctgaacgagataaaaggatgtgcattggctaacaaaatttattttacccgctgttatctttgtcaaaatgttgaaatgcacgaagtaaatcctcctccttttccagtttatgcttatttatcatagctgtgaggaactccgagtaatcaatgctgccactcttgtctacgtcaacctgtaccacagtatcactagtaaaatccttttgtaaactaaacctgcagcgaagagttagcaaaagcaaatgatcttactgcttccataagcttctga

SEQ ID NO: 48261 - DNA, 717 bp, Oryza sativa
gctgcccgctgaggtgctgcaggatggtgatctcccggcgcacgtcgtccacgtcggtgcgccgcaccagcttccgcttcgacaccgacttgcacgcgtaccggttccccgtcgcgcgctccgtgcacaggtacgtcgtcccgaactgcccgctccccagcttccggtccagctggtacagcgaccgcacgctcaccatcgccctctgcagcacggggcccatctccccgccgccgccggacgccctccgggacagcgcccccgccgccgaagacgagcccgtcggcggccggtgcggcggggccccgtgcctcgggaagctcggccgccgccacgtccccggctcatcgccgccacgcgccttgctgcgctccgcggtcgacgccggccgccgcatcgtgcccgacgtgatgggtatctcgtacgtcttggtgaagcagttgcccattgcaaagcctcctcgtttcctttccttctcctggggtggcgccgagacgaagcgagggtggaatggtgagttgggtttgggagaacgaggagccgaggttttgaagggtttctctttctctgcgcgggcggtgggcggcgggagcggagttgcttgacgtgatgccctaccccttcgtttcgctgtttgcttttggtccgggctttgagctttatgccttgtttggttatctccggagggaaaggaagattcaaagaaagcctcgggat

SEQ ID NO: 48262 - DNA, 1075 bp, Oryza sativa
taaattaattctttccagctttttttcatgtcttgctcatgatgagatagtaactctcaaactaaactaaccaaaagggcaaggaatcaggggggaaatagactggtattgtagggttttctttttcagagtaacagtgcatggcatgctgttgcaaaatgtgcaagtgagctgtagtcattaaattcattatcggcaacttggcaagcatggtttcatgcctgccgtgatgccacctgacaaaatataatcaagcaatgttccatacgcacacacctaattgtccaataaatagtgccaataattttgtcctgaatacacatgagacaagctgacgacaaagttatgggccgaattgatgcacggaatatggcctcggataagcaaggagcacttatttacactggaagtatggtcagtaagaaaggtaatagagtcagaagaaacagttcatgcttctctatctctgggccccagattatttgtatactgtgtgtacctgcatatgcacaagaggtgattctctattctatactgcctgaaatgagaaaattcggtgaatttctttattgctgcttcaaacaagaaagcactatttgacaggaagaaccttaagaccgtccataacgaccaggctactaattcagttgcacagtccatcccatactgtcctccacgaggcctttctggatagccgtaagtgctgaatagagttgctgagacacagttctgaacttctggttcccatactccactctgtaatggatagcggatgcatgagaactgattttttttttaatatagagtaacaattatttaatagaacggaggagccctttctcaatgctgcatttgttcgtatttgcagaatttgtatgacatggatcactgataaagaaaaataggagaataatttggtggatacatatgctaagtttttccatttagtgaaactggtatactaacacagtccccatgaaatatgctaccggttactttactctttttttttccttttatgagacgacattgtactctgttgatagtactacaggtgtacattttcactgtatgg

SEQ ID NO: 48263 - DNA, 716 bp, Oryza sativa
agctgattggagataagccatcctgaatgtaaacaagacagtaatcttgcaactataaccagataaaatgaatatgcaggaaagttaagtcaacgctgccaaccttaaaatagtgcccaactgggcaagcaaagacaacaaatgtgtactctggggctggtgcaacaccgaggatagccccacttccaatcagcagcggtctgatatataaagaacctttgccagtagggggtacctgcaacggagcgcatagctcatgagaaagatgtgcgcaccacggcgcctatcactgttgaagaaacaaaatgtccttacccagcgcttgtttgctaaaattgttagctttatagcttctaggaactgctctacacttggtgcaggcatacataaccggtctgcgcctactctcatccgtaaagcattttcatcaggacgaaatagaaggactgatccatcctcttttctatgtgctcgcagaccttcaagtaaaccctatagaaattttacaagtgcattagagcttttcaaacaaaatggagcagaataaatggacaaggctcatttagtacagctctgctcaacaatcagatagtgattcttcaaggtagaattaagagctcaactaacctgaccataattcaacactccagctgctgggttcagttctattggcccatatggcaccaattcacccttggtgaacaccccttcctcgg

SEQ ID NO: 48264 - DNA, 1095 bp, Oryza sativa
ggttccacatccccacattgtccagcgccaccaacaccgccgtccacgccctcgggtacacctgcacagcgccatcaagcgagcaatttagccagtccgcaattcgttttcgtgtatatccgcactgctcggcgcccgcgtcgagtgaaacgtggctgcgtgtgttacctgaaccgtgcaccgggagactgcgtcgacgaggttgtagctcttcctgctctgctcgctccacactcccctgtccatcctgcgacaatgccaaaatcagcgaacagatgagaccagatggtgcgggctgcattagtcaggaggcatgtaacgtgggccgtacccaactacgaacaagctgtagccgtcgaggtgccagatctggacgctgtcctcgctgttctcgaacacgatctcgaggaatgaccggtagtcggagtccatcacggccgcctcgctccgcggagccgccgcggcgcccgcgggcggcgcgtccgggatgccgccgagccggaacacgtcgctgatcctgtagtagtcggccagcttgagcggcgtgtcggcctccacgaacgacacgccgttcacggcgtaccgctgcttgccggcgacgcgccccgccgagttggcgagccggattgtgcgtgtcacgttgatcgagccgtagtggtacgagccctgcgggttcggccgtggcccgctcgccgtcaggttcgtcctgggattgggaaaacatcaaaagaaacccaccggtcagtaccagcatctgccgtccatcgcgagaaacggacggtcaggatgaggcgatgcggcgaacctgatggagcgagcctggtcgagcgagaagtcgatgtcgtcggcgaggccagccggtggcggcggtgaggagatggtggcgctcgagccggcgtagcgcaggacggcggacgagttgagtgcacgcttggcgaagcgggtggagacggtgatttggtagacgccgggcgggcggttggccgtgaacagcacggacagcgactggccggcgtggacgtagagggagctgtaggtgttctgcaccgtgtgcgtgccctccacctcgaccagcgtcatgttgtggtcttggat

SEQ ID NO: 48265 - DNA, 1427 bp, Oryza sativa
atggcatgtttgaaataatgcacatatgcgtgatctaagattgtatttcaggaccgaaaataaacgtcggaggtgatctaaaactagcatacataacaaaaacggaaacaaagtggaaacgtatgccaacaaggctgtgtgtagattcaaattttggatccaaacttccaactttttccatcacatcaacctgtcatacacacacaatttttcagtcacatcgtaccaattttaacccaaacttccaactttggaaggaactaaacacagcctaaggcaataactaaactctctctctaagtttgtggtgtattagatgcacggacgcgactacaaaagctagctaatcatgtaatcaacctaatctgcacgcaaaatgcgttccaaaacaaacttccacgttttgggttccccatgacaaatctagcctagttgatgtttagcagtatattcaatcaaaccaaagataagttcatctacagaatagtgcacataatttgtacaaactaatgatgaaaatgagcaagaacgcagattgactgggtgcaacgcttgagagcgtttctgtgtaaagtgaacttgccatgacagaagaaacggctccgacaaacggttgtgcacgttgacgatcaagttatcattcgtctggcagtcaatctccggccccggaaattgcccattgatcagaataccctacatgaagaaaaaaacacacacaaacaagtactaaaagaattagagaaacagcgtacacatcaaccctgaccaaagatgaacagcagaacagatccatcaaaatctacacctgctgctggacgccgagaggattgatgttccagtagtaacctcccaatcgaaaaatctatacggatcttctgcccgtgcggaggagacgaagacgaacatgcagacgcagacagcggccagggctcccatgcttcgccgtgacgacatgacgccggtcgacgctagctgccgggagacggtggtacggcggtcaggcggcggagatcgatagcgcgcgcggcgcctgctgtggactctgctccgggtcccgtacgtcgcacattttatagatgagatctactgggacgcaaccgcaacagcatcgatgtacgtgaaaaaaatcatcgttattgagtttaggcagggtggtttagtttaggaggaattttaattctgttacaaaagagataagatattacaaggggattggtaacagaatttgtggtatgtctatggagcgatggacggtcgtaaaattcgtggtgtttctgttcatcttagctgatgcctttggggatagacgaacttccaagttccaatgtcttatctgccctttgtttgtccggttttgttcatgtccttatattttcaacgcggaacagttttatggatatctcttctacatgtccagcattgatacg

SEQ ID NO: 48266 - DNA, 3710 bp, Oryza sativa
atggtttttatgtatgccttctatctgcaatgccgtctgtgaggatgatgtcgtgaaattactgggctgagagccttccagcatgttataatagtgtaaattgtatttaagtttgatatagaaaaagaaggattgcgtgacatgtttggacaattagcatggtgtcccgcaaatggtgacatgggggctaagggcatattgcttggcactcatttgtttcgttcatcctattcaacacctgaattaatagaagttttaaatggaacaacatgattgccgtatgattttcaccaaatatgttgtctaaaatttgtagtttactatggacatgccagggtaaatctgcttcgaacaatgctgcagtagcattatatcatgaactttataataatattaatggataaagcggcatgttattgaccttgaaaactaaaaacaacatattttgttacttagataacaattcgatattccaaactaagatagtataagccataaagcataccgcatacacctgatggaaactgatggtttttgtttgtaatttagagattgttgtctcagatgttctagtgcacattttatgacttggacaaagtgaccttcataggaactgaataactatgctactagaacataagtgaattataaatgcctattgatcaataattcaatagatacaatgtgttgctcccttccttccttatcaagctaccaaggtattatcggaaccacaaatcactttttactgttaaaagttgatgaaaaacgtgtttatttaaaatattatatagtccatagaccatgtgcatatttctttgttcatcttgttgtccttgagctatatgtgaaaatagagcatcggatcaaaagttgtgcctatatttaaaaaagggaacatgtatgtttaacaaccagtgctgacatgatgatggcatcagcagacctttgcccctttcctataatccacatgcacgtacttcttcttctagcaggtccacgtgtatgtgctcagttctcatgagacccgtgttagccagcttttgaagttttaaaaaccagcagttatgctttattgacacatattttcaatgagggtccactgaatcaatggccagatgtttttttttccttttttgtgagaattcgtgattcttctctcttttcttagcacttctaaaaggcctttgaccaactcttatatgtaatatgtagtttttttttctatttttatcttagcacctctaaaaggcctttcactaactattgtatattatatatactacagctgaatgtcagctgatgctgtccagcctatttggaaactgaaaacactattgtgtcatttctctgtttatatgtatatctagaagaaattccatcacccctctatttaatcttattctacaatctgctttgatggcaggtacataattctatatgggttgctggttttacttaccttggtacaatacctatatacagccacttcttctccagggtaattgatccttgcggatgttgaagttttccctagatgatgacacttatacgttgcgtttacttgactcttgtgctgttagatatttacctgatatgttgacagctggctcaaggatgcatgcaacctttattaatacaacaactctctcaaagtaatgtcttactttatgttgttttgccttatgatatatatgtattttaagtgctgagcctgagtatcgtacaccacttatttatgctaaattaaatgcctttgtgattaagaaaaggcaggccaattccaaaagtggaagcttaaactctgccatgagtcgcagcaaaatagatcagcaaaatccacaatccactacagctttgttactacagcagacgatggatctatatcctcctgggacatccaccaggtacacctgtttatgtttggaatttatgctgctgaagtgtaatattcaatatcttttgtcatgtaatttctgtcctgtgatacagttgtatgcctccattttattttagggatttcacatgctcttactgccggctcatccaggtatctttggttttccaaatttggcatccagagatagtattaactgaatacagtgctccaaaaatatacaaaaacaaagataatttgacttgacataatgtaggtctttcaaggatgtaacaaactaacaatctgcattttgtaggaggtatgcttattatggtgattagtcttgtgttatgccaatgtactgaatgacaggaccagtgtatcttagattatggcatgtgccaatcgccctattttttttgtatctactaagttgaatgttggtctgccaatgtatgacatgaccagttatgactactagcatcctttctcatcagtgtgtccagtcttaagaccccttatgctttccaaagtccaaacgataatgagagtttctctggcttgatttttgagaagtcataaccatcaccagtcacaatctatctaattagaaaaaggtagacactatctgaaaaagagagaaggacacactgaacttcttttccttcatgaacacaccgtgctatgctcgttgttcttctcaattaactttgtaactgctcacatttgtatgcattatccatattttttagttactacaaatttcattcatactagcgtgtctgaagttttttgtcctgtctactaccttttgcagcctccacgcaccaagcactgtcatgactgtgataaatgtgtctccaatttgatcatcattgtgtttggcttggaacatgcattgctaaaagaactactgcagattttggtgagttctgaatttatatattgtgcagcttagtttgaacatatgcttctcaggtgcagcataatatcctgtgtggtgtatgtcatgcaatctctacataagcacccgagtgtcctgcttcagttaacatgtgtttattgtgagaaatcaattatttgtgtgctcatccatccattatttctttaggtagtcaatttgtgtcttgtcttaatttttgtactccaagtctctgtggcagaactgtagatcgagaaaacctgtatgaagataccaggttataacggttatatgccttttgcctaattatcaaaccatgccctcacactttcttcatcttgattcttatcaaggatttatttggctgcaattaactgtgcacggaagctgtgctaaatcattgccatgcctttcctttaatattgatctagtaggaattagcaggactgtgtgttcccagcaattcattcaacctatacctcccatcttccatagtccagaattctagaagtctgatgcttgttattgtgttacattttcttgaggaggttggtcagggatcatgttagtcttaattcttaggcatcctaaatggaaaaaaaaaaggagctaacatgcctcattgaaatgtacatataacaatctaatgttgttctattatatgactcatcgaaagtcttggcagctatcctcaggacatattaatgtttttcaggtggtacatattcgaacaaacagttttaactgtctggactgttgctttctacattcagttcttttatttgggcatcgttgtatcctggtatgtattttaccccttttagaccctatatgcacaaagatttttcagttgtgccttttagttggtctccagtttgattcgccagacatctcatctgagtatattgg

SEQ ID NO: 48267 - DNA, 1195 bp, Oryza sativa
aacttttttttgactaagaaccatactgaacctgagctggtaaaggagatcagaggacgagatagtgattggtaatacaacaaattacgattgatcaataagaagaagaactgaccataagtgtcttggctttgattcttgcagcttccttctcggcggtgaggcgctgctcctcttcttccatctcctttctcctccagaactcctcgatctctgcccttgtgatgctgtaaaccgggatcgccatcttcttgtgggaatatgggctatggccggcagttttggtgtgtccgcaaaggtgtcacctgctgtcttccttgttctttctaaattgtaagttcaggctcaacagggtcatctgatatatatacaccaactcttcaaggcttcatgtgtagggtgttgccttgcccactgaaaaaacctagtcacaactcacagtcatggctacagcaacctaatcttctagaggaatactactagactgggtcccttctcgtctactcttctcaaccaacggttatgcaactagtgtttgcttacatgttagttggtagagtcagtgtcttctaaagttaaccaaagtaataggtaggattaggaaggtgctttggggtaataaagaataagactcaagcgtgtgtcaagaaacaaaacgaacccctggatcacactagcttgcatcagcatactagtatttcttttttctacttagtcaaccacatctattaatttgaaaacgagtgcagttgaaattccatacggccttaccggcatacaaaaggttcacatattcttcctttttagttttggtttaacacagtgttccttcgtttttgttactaggcttcaaaagaaacaacgaaaagctccttttgttttctggactcgaagttaggtcttcacaaatatatattaattaaggacaaagaaagacctagactgagtttgcatcaagaatcatgatgaacccattcaggccttcacaccactctagtgctgcaattctgaaaaccagtttacttgttatatacaaccacagctgtttaatctgagaagaattgataactgaagaactgtaccgtcggtcaccaagggtacttattactgtactttcttaccttggactgcaaacaccacacatatgctagccttcaaaggaacttttgtatattgatatccgtaaagagaagaa

SEQ ID NO: 48268 - DNA, 1050 bp, Oryza sativa
ataattcagtagctctgtagctgtagctgacttctataggtgcaagcatggtgaggtagcatttgttgcttatttaattatagataggcttagcttaacaccctcatctgaagggaaatgttgagggactagtttcagtgtagcaggcaactgctaccatctctgacaatgactcaattggctattactgtatgataagtctacatcattagtgaggacatgattgagcaatggcacttaattacaagcactaactcccgctgcaatttgctggttctgcagtggatcttctgggttggccccttcattggcgctgcccttgctgccatctaccaccaggtggtcatcagggcaattccattcaagagcaggtcgtaacctgcatcagctattatcactgtcaagatgccaatccagagcaagctgtttctgatgggcgcggctgtttcccgctgcctgctttgttagtaattattgtggagtcgacgttcctcttcaagtttgttgtactactgtttttatctgaacacagacttgtaatttcagtactcagttgtgtatccctcttttactatgtgcaaattaagctatcctcctcctattggagttcggttcagctgccatctttctgcaattgccaacacggctatccacaaaaccttaacatcaaaagggataaggcatagtgggtgtcgagaagaataatcattgggttccaaattgagacgaaacctctctttctgagctatctgtcacacttgcatcatcgagatcgtgatgctattcagcctactccaatctgccagcacacctgggctgtggttggcagcttgtggatggagtaacatctcggcgaattgaggttggtggtgacggccgagaggacaatgatgtgagtcattgcccgttggcaattggggttggggctgtgtgtgtgggcgctctggtcctaaacgcaacactacaaaaacttacaccgtggcacatgccgtgctgattgtttggttcttgcaaacagcctagctgcggaagatctctccccctttttac

SEQ ID NO: 48269 - DNA, 702 bp, Oryza sativa
ccgcagattagaatagcgaaacacaattcaggtgtgctacctaaggcctgcgatgcagtaatcctcttctggggatctctatgtaacatttgtctgataagatcctttgcactttcagatatcgaaggccacgggctggtactgaaatcaacttggttgaccagtatagcatcgaatatgcctttctctgtctctgcgcagatattcaaatttgacaattatctccacgatatacttgatagaatgtagcaaaattagccaaagagtaaatatgtactatggatatttacctgcccagaatgggggcgtcccgcatagaaggatatacaatatcaccccagcgctccagatgtcggcttctttcccataatttcgttgtaacacttctggcgccacataataagcacttccgacaatgtccttgtacactttacctgcatttgttgttttgttgttggggaaattttaccttagcttgtacatatcttgttatggcgagctaaggtacgtgcattatctctcgcaagatctttcaacatgcatgatcgatgcatttctgcatctgctttgatattgtacgtttctactctttagacccgtgcatttctaacagccaaattaactcatggtgttgataaaggggggaaaagaaagaaagaaagaggtagtgtagcttatgtgtgatatcgcgaccctgacctt

SEQ ID NO: 48270 - DNA, 719 bp, Oryza sativa
accatggctatacttattttaggacggatgaagtattaccgtctctgaatctctgatatatgatcaggcgaaggtgacagagaccgggctccgtacggtgtgcgtctccgaaacccaccgcactgcgccctgcaccacccttgcgccgccctgccccggccacacgaccaccgtgaaatccttctcctggttcactccggtgaaccgcaatgtcctcgggaacacgcggacggtcacggttgtgtccagcatgtcgaccgccgcgtagtactccgatggcacctccccgacgttcttcgccgtgcgcctcacgagcaccggctccgacgagttccacgcccgcgggaacctgaccgagatcgacgggtagttcagctggtgctccgggatcgccgcgacggcggagcagttcaccggccggcgcgcgatcaccgagacctcctggctcgtgtacaggccgcagaggtagccgacgtagtcgcaaggagcaatgtcgtagaccaggccagggtcggcggccctctccgggttgacgtgaccggcgccggtggcgaagaagttggccggcgctcgctgctcgtcgagtatctggttcccggagcggtcggtgatgtcggcggtggtcatgatggccgacttgatcgccgccggcgaccagtgcgggtgcctgctcttgatgaacgccgcgacgccgctgaggtgcggcgtcgacatggatg

SEQ ID NO: 48271 - DNA, 712 bp, Oryza sativa
cccgtttcacaatgtaagtcttacatttacattgtgaaacggaggaagtaccttataaatgacaatacagtcattatatataaattgtaaaacaagagagtagaaatatatatatatatatatatatatatatatatatatatatatatatatatatatatatatgcaaaatagagcattctaaaacacagaaaaataacaaagataaatacactacagaaaacacacaagaatctgagaagagataaagtttcaaaactaaagttcccatgagagaaaatctatttcctctgttttatattataagacttctagcattgtccacattcatatagaggcaatgctagaaagtctataacctgaaacggaggtagtacataataaaaagaagtatcgtagatataatgttgcactggagcatgagcattcatgtctgcatgcagcaaagctggaaatatagaaggtctgtaggtagatatgtaattcagcttatcttattaagtttgatttgttgacaaatcaggaagtcagtaaccaataagggaagcaactacaaccaataattcacaaaataggactgcaagtatgcaactaccagaactccgacctcttttttcactatcttccagtagctggtaatcactttagatagggccgtctcactctctttcagctgctaagaaaaaggagagtttgaaactacaatgaagag

SEQ ID NO: 48272 - DNA, 1320 bp, Oryza sativa
tcattcgcgcacttcccgccaacactccgatttgtacagactttccagttcccaggtacaccaaaacagagcagctataatggtcatcgaaaccagagcaactaccggtggccgcgactgacgaccggtgcccactaggaggcgcagcgcagcgaatgcagtgacgcggtggtgtccatggacgcggcgtcgaacacgccgcaccgttcgctcgcctcgatgccgtagtccatgagcggccgttgctcgagctcgtcgtcgtgccggcgcaccgcctccgggacgtccagctcccccttgcgcacgtgcgcccacaggtactccaaccggctcacgtacctcagcttcccatacaatcttcaggaaaaaaaaacaataacacaaaaatcgcttagtaagcaaatcgatactccctccggttttattttaattgacgatttagacaatgatactctctacaagatatacctttcccttatttttctattataatatatacaataaataaatgcatgtttatttttatatagtattttgaaagacaaatctatatatgtttttctagtttttttaaactaaatattttgacagttattgatgatcaatattataaaagtttaacctcaatcttgtccaaaacgtcaattaatatagaaccagagtgagtaatctctagtacggcctaacatcgcgcgtaacgtatgtaccctgagctgaagaggaaccggccaagggtggagaagaagaggcgggactggagccccgggtgaaggaagtacacggcgtgtagcctctccctgacagccgccggcatggactcgtacgccgtccggaccgcgccgacgccggggaagttctcgcggcgatccacgccggagtgcatgtacaccaccacgaactccgcgtccccgatcgccggcgtcacccgcctccgcacgtaccccttcagcgccgcctccgcgtgcccgccgccgcccagctcccgcgctgcaacgccaacaaaaacgaaacacccgctcgcgtcacgagcccaacacgaacgtactggcgtgtgtgacgtgtttctgccaccgtaccagggaagttcttgccgacgatgcggacgatgggccggccggccttgtcgcggccctggacggtgatcacccgcttcttctcgagcaaaatctcctgcttggtcatggcgtccatatcctctctggactgttctgctcgagattttcgcttcgtaaaactttcgtacgagcgagtatgatgccgtgatggtacgagcgttgttggggttaaataggtcagcgtgcggtgtggggacgatcagat

SEQ ID NO: 48273 - DNA, 1463 bp, Oryza sativa
gtaatcagctagcatttctccctatttttttcctctccatttttttcaggtgttctaccctagcaaggatggaaccaagatcccaatgttcatcgtgtcgaagaaaagcatcgttcttgatggatctcacccgactctgctgtacggctacggtggcttcggcatgaacatgacgccccatttcagcgtcacccgcatcgtcctcatgcggaatctcgggttcgtgtcgtgcatcgccaacatccgaggcggcggggagtacggcgaggactggcacaaggccgggtcgctcgcgaacaagcagaactgcttcgacgatttcatcgcggctggtgagttcctcgtctctgcaggctacacgaacccgagcaggctgtgcgtcgagggtgcgagcaacgggggccttcttgtagctgcctgcatcaaccaggttttctcactgtaacctcttcagttttttcagttctctgcagaagattgagcaagaactcactgtggattgtgcattttttttacagcgtccggacctttttggttgtgctctggctcacgtgggtgtcatggacatgcttcgattccacaagttcaccataggttctgactcatccctgaaacccatatacttgaactttctttttcgttgaaatatttcatctcaccaatgtgctcggcaacacttgcatgcaggccgtgcatggacctgtgatttcggctgctcggagaaggaagaggaattccactggctcatcaagtatggcactagccctctctctgaccaccaaggaattcttaatccttttttccttcagtcacatcataagttaggaatgccaaactactgacgcgcaggtactctcccctccacaacgtcaggcggccatgggagaaaggtcaccggaggcagcagtacccttccaccatgctgctgacggcggaccacgacgaccgcgtcgtgccgtcgcacacgctcaaattcctcgcggtgcgacccgtgatctctcctcctaccttcgccgccattttctctggattctgatgaattttctctgttgattgggggcagacgatgcagcacgtactgtgcacgagcgtgaaggagagcccgcagacgaacccgatcgtcgcgcggatcgaccgcaagagcgggcacggatgcggccgctccacgcagaaaatcgtaggcgaaatctttgctcgtctgtgtgtgtcacgtttttttctgctgatttaactgaattttgctccgtccgtgggtggcagatcgacgaagctgcggacaggtatgcgttcgcggcaaagacgatggggatctcttggatcgactgaacaagcctccgagcagttggtgccttggtgggtgctaatgggtttaacttcttatagcatataaccctataaaatttgagagttggatctagaatgagatgaacacaacttctgtatatttttggcttaaaaatatt

SEQ ID NO: 48274 - DNA, 1012 bp, Oryza sativa
aagttgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccacagcgtcggcataataggccagccgtgtaggcggaggcaccaatcggcggcgacggaggcaggccggcggtgaagtcgtagacgcccaacagcggcggcataataggcatgccgtgtaggcggaggcaccaatcggcggcgacggaggcaggccggcggtgaagatgacgatgcccatcaacggtggtgtgaccaaccgaccgtataggcggggacaccagtcggcggcgacggaggcaggccggcggtgaagtcgtagacgcccaacagcggcggcataataggctagccgtgtaggcagaaacaccagtcggcggcggcgaaggccagccggtcggcgaagacgtggacgcccatgaacggtggtatgaccaaccaaccgtataggcgaggacaccagtcggcggcgacggaggcaggccggtggtgaagtcgtagacgcccaacagcggcggcataatagaccagccgtgtaggcggaggcaccactcggcggcgacggaggcaggccggcggtgaagtcgtagacgcccaacagcggcggcataataggccagccgtgtaggcggaggcaccactcggcggcgacggaggcgggccggcggtgaagtcgtagacgcccaacagcggcggcataataggccagccgtgtaggcggaggcaccactcggcggcgactgaggcaagccggcggtgaagtcgtagacgcccaacagcgacggcataata

SEQ ID NO: 48275 - DNA, 15937 bp, Oryza sativa
ccgtgcaggcggaaacaccagtgggcagcggacgaggcggccggtcggtgaagacgtagacgcccaacaacggcagcataaaggccagccgtgcaggcggaaacaccagtcggcagcggacgaggcggccggtcggtgaagacgtagacgcccaacaacggcagcataaaggccagccgtgcaggcggaaacaccagtcggcggcggtcgaggcggccggtcggtgaagacgtagacgcccaacaacggcggcataaaggccagccgtgcaggcggaaacaccagtcggcagtggacgaggcggccggtcggtgaagacgtagacgcccaacaacggcagcataataggccagccgtgcaggcggaaacaccagtcggcggcggtcgaggcgagccggtggtgacgttctgactgatccattcctggagcgtaagagataagcttaaagccatgaatcccttttatgcatatctggatctggatcctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacgtccaacaacggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcgtcggcataataggccagccgtgtaggcggaggcaccaatcggcggcgacggaggctggccggcggtgaagatgacgatgcccatcagcggcggtgtgaccaaccgaccgtataggcggggacaccagtcggcggcgacggaggcaggccggcggtgaagatgacgatgcccatcaacggtggtgtgaccaaccgaccgtataggcggggacaccactcggcggcgacggaggcaggccggcggtgtagatgacgatgcccatcaacggtggtgtgaccaaccgaccgtataggcgaggacaccagtcggcggcgacggaggcaggccggtgaagcagaagatatcgccatcagcaacggcagcggcgcacacaaccgtggaggcgatgaaaccaatcggcagcgacgaaggcggccggcggtacatgtataaaataatagatcaaataataattagtgatctgtgaattaattctaatttatataagaaaatttagaacgataaacctggtttgtgatccaactttgattcgaggcctgtcaatggatgaaccgtagcatgcagccgtgtcatgcagccgtgtagacatgtaatcgtcggtagcacatgcacggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccaacggtgatcttcgcatgattttggcggcggctgcttgctgattgcttcaaatcatgccctggtgacgaaaccgacggaccaacagatatggcagcattgtagcgacggatttgatctcactgacggaggtaaaattgacggtaacaagctggttgtagatcgattcgatcggtgattaatctcctggttgattgaccagatccagatagaatttttggcgacgaagaccctgcccttttgttgagaggatcacggccaaagacaagagtagcaccgatgatgccagcacaaagttccatcgcacttctcgacggaaaactcgacgcagcccctacctggcgcgccaactgtcgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtgtgtattaatctgacgatcaggttgtctcatgccccctagagggcttcctgcccaccttatgatggggggcaggattacaagatagaaaccttaaccaacacggtatcggtctactttacaatcttatcaaaccaggactttaggctgttccgtaatatataaggaaacgtaatacccgagtcatgatctattacatattccatagatataagttatcccctatgactagtcggataaccatgccgtatgggtatggggtacccataatatccacacgtggcgagacaccatttccgggcgcccgagcgaggcgtcaacgatggccaactgccggcgagcgcgaggcggcggtcggacgaatctcgtgttcctttcgctccgtggtggcgcgtcctaccgcggtactcgctacctcccaaaatataatgattttaaactataataaggtctctaaaatataaaatattagtttgactaccaatatctgtaaaactagtattgtaaaactagtattttaaggtaaaaaaattacatattataatagtttgtttaatgataaatctaataccatcaattttacatgattgatcttttttaaatttttttactattaataattaaagtttaaattttttgactttttttgcggtggttaaattttttgacttgctactctgctacaaaataattagtatattttaagacggaggtgtacttgatacgtaccacgacaccggggcagttggtcccccaatcacggccgtttgcttacccgataaggaaaaagagttgggaggagacacaactcgcccatgcactgcacagagagcggctggttggtcaccacggtagcgtacacgaacacggtcgatcgggagacgacagacgagacgccatgcatgttcgcggccgctcgccggccggtgttagcggtggccggtgaccgggtgtctgaaatcctatccgatctccttgggaaccggagccccatgcgcgaacatgagcatcacaacgtctgaacatgacgggaacgtggctggggtccgtcccttcccttcgcagcccgaaatgcgcaacgtgctgcagatcagtggttgattactccatgcttgtttatgtgcaccaccggggaccagtgagtagatcacgtgttaatcggccgcacacactgacgggatagtgccgtactagaatcatcggcactggtgtacgaagcgctactgtagtagttgccgcttttcaccgatggataccagggaaatccaacgtgcaatctgccgcgaggtttaccgggcggcgggcggcgaggtcggcaaattttgcccgagacgcgggcagtcggcagtgtggccaactccgcgtgaatttcttttgcccactcgggggaggtttgcttccgcgatttcgcctccgatcctgcagttgcttggcttgagcggccacttctccgctccgcttgctgctgtggcctgtggcatgtccgcgctgtatgtgcagcgtcagcgcggctcgcgcaacacgcgtctgttgcgtactatctccccaccttgttggttgatggccacatctcacgccttccagtctcgccggtgtcctggtgtgccctgctgacccaatgaacgcacagtagcatcgttttgctcatcgaagagccgaagatatgtccaggcagctacagattgtctatttgtctactttttcttttgaaagagaattactaaatgtcaattaaaaaaaatctatctttgcctgtgagcattgctagtggccggtgtctactagctagccaagagccaaaaatgggtgatccaatagctgtaggacactgcgccgaccggagcccatctcccacagattccagtcgattcctcttatcgtctcctattatttttttcccacgagaattcagatggtatcgacaatatcctagagtaggctccgtcctcgtgcaccaattattcatgcacgcaataataatttgaatagtgcaactatgattaattggaaggattagcttgttgccctacgcaacgcacaaccccaaacccaactgacggggttaatatctatcaccagcacgactaatgacatgtcaattaaactttgattatccgagtcatcatcgaatggctttcttatctcgcaactcgcacattgctttttcagtgacccaaagggagctctcacaaagtcccaaaaggaaagcatttgactctgagttagtgcgagccacgttttgccatttttctgattgcaagatgctttcccttcctgactgacccaggagagcttcaccgattgctaagcaacaaccctgtagcttcgtcttatggattttctttttctgtaatcacatgggggtatggacttgtagctggtgaagtagataagctgcttaccagataagatacttcacgagaaaacagtattatattaaaacagatactttcacgagaacatgaaggcaattgtgactgactggctatatatactccaggatgaacccattatactatccctccatctcaaacaatagagcgtatttttgttttgttaggacagggaatactctattatgatataattctcacaaaattaatatgctttgcacgactgatcattgttttacatggcattgatccacaggtaaagtatgtatgaagaaaagaagctatgtatcaacagctcattcatgtttctgtgcccactgagatcaccacctcaccgtcagtcccatgatcccatcctgaaacttggacaggcttaacaacagtcagtcagcagaaggcagtgacgtgaagccgtcaactgggcaagagaaaaatcaccatctagatcatggcgtccaagcaaggtagaccgcagacatctctcttcaaaactgatgccccgcacattcctggcggctacacactgaggagaacatcaccctcgtcgaccatgttcatatgcaaagagctcctagatctggtgcaactttagaatcgtgatcccggatggctggtgtttcatcttgttctttcttcttttgcttcttccccttctggcctttcccttggccacctttggtcctgatagtaaagcacattaagcagatagtattagtacataacacttccagcattgtgttaaacatgcaatgcaactaacctccctagtgaaaaaggaaatagtaatcaggtcggtgactttaaggcatatgggataagtgcatattttgcagcaatactgttaaggtttcataggccagatacaacagcagcaatgcactatgcaaatacgctggaaatattgatttcaccccccaaaaattccatttgaaagaatgcttacaatgcgaacagcaggacataagttcagttgtagaatagaatatggtaaaagacaaacaaaaggacagaaacattataaaggggattagctatatttaagacaccacattttccaccaaaaaacaaaaaaaaattaaaaccaaatctcaatacttacaccatattttttgcagcacacactatataagagaattaggatgaaaacaattaattacctacttgaaagaggagatagtagagcgaaacatacttacataggagtataaaagaatggtagcaatccgaatgggaaaaaaatgactgaaatcaagtcaaaaatgtggcgccatatttttagcaaaaccattataaagccatactttggaggttctctcgatggtgcagttgtttttggaggttctctcgatgctacagttgtggctaaattacaagaaggcttgtgcttcctagcagatccacaagagcattccttggtttttgactttccctgtgcaaaagaataaagggataattcctatttattccttccaacatagtattttaacaaggcaattcaatgtttggaaactattaagagtcgtccacatgatagttacctttttagaatgtgaactgttgtgtttctgagctgtttcgctttgctagaacagtccttttcttctttcttgtgttcatccagttgactctcatcctgcttcatgctaagctcatcctctatggtctgtacatactctgctgatccaggtaatatacacaataaaggaaatgagttcagtgcatggccaatgtaaaacaaatattacttgaacaggtatgagaaattggatattaattgaaacagttaatgccctcagtttacaaaatgaactacttgtgcttctaaaatagtggtctccaacaataaccagccaaacaaaaatgttacctcctacagggtggttagatagcacactaactcttagtacagatatacctcctacagggtatgatattgacctttggcaattgcagaggaactgaacatggaaaacacccagcacagcaactggtatgggctgtttggtgggagcttaaaattctgagaaacagctagttggtaaccggcatctagttcattttctggattctatagctaagaatctggattgtttgagagagctgaaaattctgggagaagctgcagtagctagaagctctccaacaaggccgtagtcttacttgagctttctataacaccgttcatgcttcttggtactgttatcatattttgatgatcttaaaaataaccagtaaatggtaaatatcatattagtgaggcataaacccaaaatgccatgagcacaacacccagtataggttttacctactagatttatgctactgaattgaggggtgtgcatgaaacgcttgctcaggtgaggcagctcatgtttggcaagaatatgaataggattaaacaatgaaaactcaatctatggaatcccagaagtactccaaatttcaccataaatttcattaattgtcataagctgaagtcctcaagaaagataaggatgagattcattcatagggacagccactttagacttcagaataatcaaatgtttaccatcacatgcatagtccagataaggatctccatccgcatcatcagaacccagtattagttgctcagctaacatgtactctatagcagcatcaatgtcaccatccatgtctttcaaaacctatgtgatgtggcattgaccattaatatataatgactgattggctgctacggtcagcctaggctcgcagttgcaatacaagaaagtcgatttgttgtataattcatacctgttcaactgcagcgatattagaacatccagttccagccatcaccaatttaaccgatatatgatcatactttgatctgtctgaagatttcttcaggtcctttgcttttgtttgagcattattgcttgtgctagctacattggcatctgcctgtaatttcataacggataaaattaagattagtaacagagcaagttgagctacaacaggatctcactgtccttccagggacacaaaacaaccaacagtttacaatttggacagtgagaaaccttgataataactggcattgcaggaccttgacatggatcttccctcagtctgacactattgtagtgctcaccctgatgatacgatctatattggaatcaaaacaaaggaacatgagaatgtatgtccttttactgccagtattagcatattagtttaaaacagcagaacacacattaacttacaaatgaatcatactggtagcttcacgatcagaaaagtttcttatgtaccatcgtggtgagttaagctgcaaatcattcagtaatggtacaggcatcaatcaaatgttacagtacgttctcttctatagaagaaaggctataatatgaaaatgagtacgaaaaataacagagaaccatcaggggatatataagcagcacattgatctatatcacccatgtgtttcaaaatacagactaggcaaggctcaactgcctagcgtgttattcataggttgaagaaatcatactgcaaagcttgtattgaaaattaccatgtggatgcatatgttttttctcttgagaatagaagctgcttgcaactccatatgaccagcccaagtcccatcctcaagcatagagtcacaatatttctcaaacggttcctcgtcctcaatgaatggctcaaaatccacacggtgctcctgtaagatgcatacaagaaagattatgaagtgtaaataggccaatgcttgcttgcagcatgtcttttagataaaagaacaacccagcctggcagcctgtactctacgcccagatcagatgtacacagccaaagtttgcagcatgtgcaataccttattgattcaatggcaccctaattacagttcttaagtcacagtgttacaagatgtttcttggtcatagccaaagcttgcagtatttctaataccttattgattcaatggcaccctaactacagttattaagtcacagtgttacaagatgtttgttttggtcatctcatctgatgcataccttaatgtattgcacaatcattgcacggtacttcatgtgctcttcctcgttgccttcgagctggtcgcccattgccctgcagactacgatgagtaaccatataacacaagactgcataatgcatatactattcctcctttcataaactaacagtactctaacatatcgtacaacatcgattagcctcttcttgtaaaaagtggcaagaatttgagtaatggaatcgaaaagaagacctaaagaagcagttgccatccgcactaacttcgataatcttcaaccccagcgagtccagctgcgcccggaactccgtcatgtcggccttcttcgcgaacttcttctcctcctaacaaatcaatcaccaaaaggaaaaaaaaacgagaaaatatattagctaaagctcaattccccttccaccaaaaacgatccaatctccagctgactgaggcgcggggtattactgcatcacgcttcggcttccgggctttgggcgccgccacggctaccttcttcttgttccgagccattacgacacgtgcggtagtagtggagtctcgcctagatttccccgcggcggcggcggcggcgagggggaggggaggcggaatcgcagatagtatcaaatcgtactctaccagaagcccggagaagaaatcggatgggaaaaggaagaggagaagagaagagaagtcgtcaggtgatatttcgtgggccaaatgggccgggccgtaacacctcaatccccaatctgctacggcccgtgtgtgaacgtgacacgtcatcctatttagaatcgaataccgaacctgaacgtgacacgtcagatttaggagtagaaacgagtacactctacacgatacagatccaatacgagaccgacacgtcgtcagcgaccaagtaaaattcggtcacgaaccgtacgccaccaacctgtataaattcatcgaccgccaagcctctccagaacatagcacaagccaaccaaacaccgcacgatttcgtatccacacatacttctacgtgatttcgtttcgacgatctcgaggcgccgcggcgtgacgtgacgtcgacgacaaccatggcaggcggtggcggcaagtccgtagcggcggcgctggccatggcctgcttcctcctcatcctcgccgccttcgctcccccggcggcggcggcgccgccggacatcatgtcgatcatcaggtacaacgcggagcacggggtgcgggggctggagcggacggaggccgaggcgcgcgccgcgtacgacctgtggttggcgcggcaccggcgcggcggcggcggcggctcgcgcaacgggttcatcggcgagcacgagcgccggttccgcgtgttctgggacaacctcaagttcgtcgacgcccacaacgcccgcgccgacgagcgcggcgggttccgcctcgggatgaaccgcttcgccgacctcaccaacggcgagttccgcgccacctacctcggcaccacgcccgccggcagggggcgccgcgtcggggaggcgtaccgccacgacggcgtcgaggcgctgccggactccgtggactggagggacaagggcgccgtcgtcgcccccgtcaagaaccagggccagtgcggtagctgctgggcgttctcggcggtcgccgccgtggagggcatcaacaagatcgtcaccggcgagctggtgtcgctgtcggagcaggagctggtggagtgcgcgaggaacgggcagaacagcggctgcaacggtgggatcatggacgacgcgttcgccttcatcgcccggaacggcggcctcgacacggaggaggactacccgtacacggccatggacggcaagtgcaacctcgccaagaggagccgcaaggtggtgtccatcgacggcttcgaggacgtgcccgagaacgacgagctgtcgctccagaaggccgtggcgcaccagcccgtcagcgtcgccatcgacgccggcggccgcgagttccagctctacgactccggcgtgttcaccggccggtgcggcaccaacctggaccacggcgtggtggcggtggggtacggcacggacgccgccaccggcgccgcctactggacggtgcgcaactcgtgggggcccgactggggcgagaacggctacatccgcatggagcgcaacgtcaccgcgcgcaccggcaagtgcggcatcgccatgatggcgtcctacccgatcaagaaggggcccaacccgaagccgtcgccgccgtctccggcgccatcgccgccgcagcaatgcgaccggtacagcaagtgcccggcggggaccacctgctgctgcaactacgggatcaggaaccactgcatcgtgtggggatgctgccccgtcgagggcgccacctgctgcaaggatcactccacctgctgccccaaggagtatcccgtctgcaacgccaaggctcgcacttgctccaaggttttaaatttaaattttatgtttacttttaatttttagagttgattttagcgtttttataagtaatttctttttcatcattgacttttttttaagttgttaagaacatatgtaaaagttacattggccgctaatacgtgttatgtctgtgtgtgttatgtgctcacacgttgccatgttttttccttgacagagcaagaacagcccgtacaatatcaggactccggcggcgatggcacgaagtgttccggaacaacctgattcaatctcttttgtagttttgaatagggaagatctagtatagaagccttatctttgttactgttaccgagtcctttattattatcgctctttttttttcgcaagatgtataaagtcctaaacagttactgttactattactgaagttattatctatctttggatatgagttctcccaagtacagcatcacgtgttgttacagctctatcgtttgttttttagggtgtgtttagtttacgaaaaaaaaattggtatcacatcgaacgtttgatcgacgttgaaaggggttttcggatacgaatgaaaaaactaatttcataactcgcttggaaaccgcgagacgaatttattaagtctaattaatccgtcattagcacatgttggttactgtagcatttatgactaatcatggactaattaggctcaaaagattcgtctcacgatttccatgtaaactgtgcaattagttttttaatctatatttaacgcccgatgcatgtgtccaaagattcgatgtaatatttttagagaaaaaaattgggaactaaattattaataaacgttacagctgacaaatgggattgtagcttttgactgagttgacaggaacagcttcctccatatggagaaccctgtcctgaaatatcaggagaaccatctcgtatttggctcatcccaataatccttctttctataaaactaatacctattaaacacctaaaacttaacatcaaaatatactacctctgtttcaatttataagactttctagcattccccacattcatataataaatctatatatatatatatatatatatatatatatatatatatatatatatatatatatatatatatatatatagattctactcattaaacacgcaaaacttataacatataaacatatagtaattatatttacaattatttcattataaaactaaatatatacatgctaaaccatcatccttcaatcattttcataatatttcagttcaaatcatttcatcgtttcttcaatatctaacgtatatattctgcagcaaagcgcgagagatcatccagtgcatgttatgcttgtgctttgaacgatagtttcagcgcaactaattgcattggtactctgtttcatggtgtggaataaaactgccatgtttagtttccttcctattcccaattttccatcacatcatatcacatcaaaaaaaaacttttctacacatataaacttcaaactttttttctaaactctcaactttctttgaacttttattttttttcaggaactaaacacacccctgctagcatgagtttccaaaatataaatatcaggagaatcctatttccaacaaagatattacgtacactctaggagggttggacgagccctcctattttcggaaaaagatacagtagtacacagtaccgtggataggtgggacgaatcgcttccacaaaactacaaaagtgccccgtctcaacgagaaacccgcgcgcgccccgacaaaaattcgcggtggcctaccagcgatttcgcttcactgcagtccgtctaccgaatggccgcggcggcgcggcccgtcgacgtcgtccgccacttcccgtgctcctcctcggtcgccgcctcctcctccttgctgctgtcgcgctccaagtccaggctcgcgtctcctgcggcggcggcggcgagctccatgcggcgaaggcttgtgctcggcgtgggcgccgccgccgccccggccgtggcggcgctcgcggcctcggcgacgcccgcggcgctgcgggactgcgccgccacgctgctcatcaccgcgggcgcgtactccctggtgcgcgccttcgacgggctcacggcgcggcggctcatcgaacaggtgtcggatctcgtttttcctttttttttgtatttcttttttttttgaggtggagctgaagctttgatctccgccattcttcaaaaaatatcaattctttagctctgttgactgttatccggagagtaaaatatggtatatacaattcagtggatgtgatctgtatcttgaatttattttcaattgctgggaagatctgactggttcagatggactgctactgttcaaaaaatacagtagttaggatagataaaagagaagtctttctttattgatcaatcaaaggaaaatagattattcaagcataaaatttatacctttcttaattatatcttgttaacttctgattcttttcataattaatctcagaacctgagcagaaaaattgtgcatgtgctctccggagtcctgttcatgtcttcctggccactattcaggtctcccttgccactgcttcttccagcatcgaaatgttttctacaaccaaatcagactagagatcttaagaaaatcatgcccctttcgcagtaattcgacagaagcacggttcttcgcggcaattgtcccgttgctgaactgcataaggcttctgacctacgggctccgcctttccactgatgaagctctagtaaaatcggtgacccgtgaaggaaaaccagagttcgtgctatgatccttatttctgatactccttcattcaaaaatcaaaatagtattccttgacatgatctttggttgcttacagggaattgctgagaggtcctctgtactatgtcattgtgctgctggtcagtgttttggtcttctggcgccagtctcctattgggattgtttcgttgtcgatgatgagtggtggtgatggtaagatgttggatctcctgggaatttaggaaaatctgcagtttttttttgtaataccccagttcacttgatgaaatgaatgcttctgctaagtatatccaccttcttggttcttattttttcaggctttgctgacattgttgggagaaggtatggctccgcgaagctgccattcaatgagaacaagagctggataggaagcatctcaatgttcatttctggcttccttctatctgcactgtaggtttttgcttcagaatgcattgctggttcttttgcattgttactccttgttattgttaactcatggatcttttgcatcacaggatgctgttctacttctcttgccttggttacttcactgtctgctgggatctggcacttggtaaactggctcttgttgcattagcagctactgtagtggagtgtattcctgtcaatgatgttgtggatgacaatatctccgttcctttggccaccatgttggcagcctatctgttatttggctacagttcatgttgttgagactataaaatttctcccttttgcttttcatgtcctgaatttggtactgccaaacatcatagattggatctctttctgttgaatcaaaaggtattttgctcatgatcatgcatgcattttgggtgaacgctagccaaatcatttagaagcaacaaatataagggactacgtactgtctcaagcttctctctgagtaatatggaaaattgtctgccgaatgggcagattcatatatgaattctcatggcagtgaaccaacaaacctcacacatggagcaatgcggggaatcactccagacgaaatacaattgacaacaagagcataaacctactgttgaaatttctctcatatttgcactacaaacaatccataaattggcagggaatgctaactaactcctcccatgggggattgattgctaatactaacaatcatgtctcgcgagtcatgtacaatggcaccgaagagggatcgatgttccatcaggttttcgcttctctcgggtaaccgcttcttgaatcatcggcaacttctggtgaatctttttccagatgtggttcacagcaccatcttgtgcagcagaggccatcctacctgggtaaatactatcatactcaaatataggctggacgtgagccatgtttcttcggaattcatctttctgctgcctggggacatttcttaagtagtttgtgagccattttggtctcatagaattattgactgagacaaaaatggcgaattctgtgtaatctatcatcccttcaaagggcagctcaatctcatcgctgacaatgacaggtatgcacagactagcaacagcatcaaagagacgacatgaagttggggtgtcaccagctgggtgcaagcaaaactctgatgtccgcatcccttttattgattgttcacgtcctgtggcattaggataaccttcttccatgacaacatcaggctcattaaccatcaagtcccatagtttctcccgtaccaaaccaccctgaaagaaaatttcagaagttatagtaagataaagctgtatagagatgcacagtagtacagaacaacaatctcataagtcataaacaaagctggtttgtaaataaaagttctgttgagagcataatgcttcaaatggcaatagtttccttgtagatacataaataatagagtaaagtccatcaccagtccctaaacttgtaccgatgtgtcatcccgg

SEQ ID NO: 48276 - DNA, 19863 bp, Oryza sativa
aagttgtagatcgcgtcgagggctacaagtttgatataaagtttgtgttcattagagttcacatgaaaaagttatgaattatttttaaatataaagtctttaaaccgtcctatttgacccagatgatattcaaatccaagtttagggactgaggtgacacaactgaacaagttggaggacctatacgagtgatctacaagtttagggaccgggatgacacagtcgaacaagtttgagaacctgaacggtcgatttgcgagtttagggaccgggatgacacaacgatacaagtttagggaccggtgatggactttactctaaataatatcaaagagctgtggattcagactcaacaggttctaaaataaaattttaagatagcccatatcatactaacatgttcttttattccattttcatttccaattgcttagattcagatactacaaagaagataaatattgccatgcatacattaaatgcttattagtatgataaatggtacgaacccgatgcctgtgtttggctcccttgaagtacagaagagtggggcggtccttattctctgataagtgcattgtagggagcaaatgagtgtaaggtacaatgacatctttgagcaatgacacttgcgtatgctgtatcatatgagaaacattgctgcttgcagagtttgaatcaagtttgtaccatccgccaaaatcaaccaccaaaagaattgcaggagcaatctctttacggacatgccacatcgccacagggtctgtcaaagaatgcctcaatatttaacaaaacctgagcatacaaaagaataataagctactatgcagatcaattacaacgaaaacataaacagtatatcttgtattcctacattgcttgcaaaacagttgtgtcttttgctccgaaacactgaggattaccaatatccccttgatgacaaatgtacagaaagtcacatggttcaaaattgtttttctttaatgatggcatttcaagggtatgccactcccttacacaagaaaacatgtaaagcgtgcctaagaaaccaaaaccagctaccttgacccccctattccaagtatgcacataactaatttcaaatttatgagtgcattgtgaggttcctatcatggttaaatctacatgtcaatgtgctcactgttctgggcacactccctctgtttggaaaagggaacttggtaagtcttacactgaggcgccgagcaacaaatcacatgtatagccggtaactaacagaacacacaaaatgatttcaagcctaaatcagctcacagtttttagagttgagtagctaaaccctgtagatatcagtcagaaagtgggattgagtatggaggagaaaaaactagtttccaatcatatactagttgagagttgggattgagtatataatagacggacaacaagcataacttaacctatcgaatgcttaacatataacccacaccaattgggagcaatggagggttaatatgatcaacagcccgttccattatgccattttgatcacttaagttcactcaggaaaaaataaaaagcacatttccaatttccaactgaatcacagtacctgtcaagacgaagacgtggtcacggccaccggagcgccgccacgctgggtgggcggtgacgcggtcgacgacctcccgctggcggcggtagtcctcgttcccctccttcctgcggaacgcgcccttggcgccccacccgagctccatctccgcggacagcgtcgcgaagaaggggacgaacaccacatccgcgtccctccagtccgcgaccaccctgacggcgggcgcggacgacgagcccggctggagggaggcgaggagccagtactcggcgctgtactgcttaatcagtgggctatccgggtacggcgagtgcgcgcgcggaggccgcggcggcgggtggtcggggtcggaggaggccgggatgcgggagtcggcggcggggagcgaccagtagaggtcgaggaggccgtggttgagcgcgcgggggagctccgcaacgtagaccctgaggaggcggcggcggtcggggccggacgccgcttgctgccgcgagaaggggagcggcggggaggcggggcgcaggaggaggaaggagagggagaggaggagcgcgacggggacggcgaggagcgcgaggcgcgccatggccgccttccagatctcgctctgcttgcttcggatgggaggaggaggaggagccgccatggccgcactgctgcttgtgcgatgcgttcgtgggcctgaaactagtatacttaactgggccgggcttttcactgtgtccgtggtccatttgccgcgaaaaaacaaaaaaaaatcctcgtcttctctctcgccggaaaccgcttaagccagcgccaccgtgtcccatgcgctgcaccggccaccgaatcaatttttgtttatctttttaaccttttttattttaaaatttatttatatataagatctaaacattttaacaacgttatttgggttagcgtggcaagacaatactactacgtcgatctggctaatagtacgtctattatcttgacattgcagcagtgagaagggcacgagagaaatagaagtcgtcatcgacgtcgcctactcccttctgctgctcccgcttctcacctccgcagccatcctcctagtcctctccatcgtgaagccgcctgtggacaagagtggctgcggcggctggtctgccactttctctaacgacgcccaccttgcattcatgtccaccgccatgctccggctcaacttctttcctacctcaccccgctggtctcctccccctcctcctcgatctgccggcctgctcagacgaggagaagaggacagggtaatgacttggtcaccatgacatgcggagcctacgtgggtcctgtgctgactcagctgctttgttgaacaaaaccagggtcaatatcacctaaagaccaagaataattcggttctgtaagttgacaattttgtaattcgctgagggacctcagttgtactgtttactggaatctgaccaactggacaaacgacccattttatacttcctaggcccatatactacgtggcatggtccacgaactgatcgaatcacgaggcccacggcatgagcatttctgggctcgggatgggccctttcttcccttccaagccgtactccccccaacacttataccatctccaatcctatacttccccatcgcatcgcatcgcacattcgcactcgtctcgtcttactcaccccgcacgtttccacttcccctctcccccacctcaccaacactcctcgccgtcccaccaaaccctactaaccgccgcgcgcgagagggtcccatccccgacttcgccgccatggccggcgctcccccgacggaggcggagaaggagtccctcgtcacctccttcctcgagatcgccgccggccagacgcccgagacggccacccagttcctccaggtccgtcgtctcgttcctcccccctctagagtctagcttctgatcgattcgaagggtttgatgcgatcccgtctctcccagatgacgagctggcatctggaggaggcgttgcagctgttctacatcgacggcgaggccgcccttgcggcgcatccggccccatcgccggctgctgcggcggaagcggcggcggcggcggtggcagcagctgctgaggtggaggacgcgatgaggtaggtcataggtggatcggcgcgagatttctcgggtttgggctttggtttttgggtccttgagttttctgttggtttgtgtacgcttaccgtgtgctgtgatgggcaggttcgctccgcccccagctgctgcactgggtgatggaatgctgcagggacttggggaggaagaggatgtgcgggcaccgctgcccacaaagcgggagactctctacggcgatgcccccatggtcgtgtaagtctagtgcttggttagcaaactctttatgatagttgggttcctgggattgagttcctcagtataagtgttaagactttgtgtgagacaacttctagttcaatgcaatatctgtgctgcccctgtggtgattgtggtttatgtgatgtactgatacatgtaaatagccaaatagggtgtatcggtggcacaaaatcggtactagtaatgcctagaatcattggtttggttcaaagagaaattgggataggttacatggggcatgtgattgtctaaaaaaactcttatccgacaatgttaaggccatgctgtttaggggagctttaagtttttgatggcttcaaatcgaagcttaagtcctcataaaaggcatgtgtgtgtttggttggtgatgaatagatgtcactaacctatagtaattttgttctcgtccaatggaattagcatgtgttgttggtaatcattgttggcttgctgatgggatataaaccttttggcctaaattgcacctttggctatgttaatagctagcaccattttctagtaccactaatttgcagtcaagcctcctgccctctcttcccctgccaagtggactaacatctctttcatatagtttgcaaccaatgagattattggtatttggttggtcaccaacaaatttcgttcatggctacaagttagatatctttacttgtcaccaacagatatgatgacaatcactagctcgaactcaaccagaatttactgatcagaagaaacatctagtcatttcatttgctgccaattattttcaaaacaggagagattgttgcctcctgaaaaagataaagttaggaatgtttttattcggggtgttatccttctacccattaggacaacacaatgaccattaacatatcagtcacagctcttattttatcccttattctctatgataccgatggcatatctgggactgccccaatggcactgcaaattaagggggtatacttagatatatatacttaaatgcgctgtgccaagtatttattataattggggttgattttgctgatgtttagccatttctttggtagatgcaacatctcttgaatacatatgacattattactatggttctttgttatagtccacttttgttaaatctggaaggaatagcgctgagccacacctaatgacctaaagtgtgggaagtgatgcaatttttgttctactctttcttttggagatgataaggcccaaattttgttgtactcttttcttttgggccgacatgctttgttaggcttctatgtcttgctttgctaaaaccaaaattctaaaacaacagccttttactctaaagaaaattagaataggctagagatgaaactcaagttgagccacagtaaccaaagagaagtatagcactaatagaaccaaactttttgcatgattttcctggaacgtggactactaatttaaaatctatcattttctaaatttgaaacggttttatgacttcttttcagcgttcggcctaattcaacagttgcatttcgtaactttgaagaggagtcaaggcaatctgctgtttgggattctgagcagaatgctgcatctagttctcgtgataatctggcggcattgtatcgtccaccatttgctttgatgttcaatggacccttcgacaaggtcagctatcctttttttcttatttaacgtctggtgttacctttttatctctaacatgaccatgtgctgcctttgcctgcaaacttcaataacctgctttgtctgtgggcatttggtatgcattgggaaaattgcaatattctattagtgacatactgaattgttatcatggagcagcacgccatgtaacccacgaactcttcatttatctcagctgctaacaatcctacctgtcaaataattagttcggtttattagctgctaaggttcagtttattactcaagcaaacattgcctcccttttgtcaacaagaggcatggtcaaacatgcttcttaatgttctttgttcacactatttatcattgaaagtacattgatgtttttattagttgttgcaaattcatttgttgtctaatgaccagtgcacgagaactagtaaactgctactaattttcatgtgaaagcctggagctgatgaacttcataatactaatttgattatcctttaattttctataacctaccaatttaattcagatttctaaaaacaatgaatttcataaatgtaggcaaagttagaggcttctgttctggacaagtggctcttgatcaatttgcaatcgactgaagagttcagctctcacatggtacagatcttaccattaatgtcatgcagccttgtgttaacccttcattctttttcctgcattggcaaagtttttactcttgagtgtttctttatgaagcttaatcgggacacttgggctaatgaggctgtggctcagacaattcgatcgaactttattttctggcaggttggtccttactcctttgtttcgccttctatacctgagccacataactgtatctccaatttttattcctgatgtattaggaatagtattggaaagaaagagtttctaatgttcactttttttcccaaaccccaagatggatcaaatttttagcatctctagttgtctactgatatgttctatcatcttaaatataggtttaccatgacaccagtgaggggaggaaggtatgcacctactacaatttggtctctgttcctgccattcttctgattgaccctatcactgggcaaaaaatgcgtgggtggaatggaatgattcacccggaccgtttgctggaggtaatttggtaaccctatcgacctactatctttcatctctcatgttactaacttctgtagtgataacattcttacttccacattctaatactggaatcttaactgtgatttgacatggtattccttgttactgtctgcatgtgaactgtccacaggatttgatgccttacctggacaaaggtccaaaggagcaccatgcagctcaacctcaaaaacggccaagaaaagttgatcaggaaacttctatcggcaaacaaggtatggcttgtgtccaaagatatgttaactagcagtgatgtttttttttccctttgaaacatttaagctcgaatagtttgtttctgcagaactattatatgaaccaagcacattagtacataaataaccatatgttgagcctatcttttttcgttgcaatctttcttcacattatatggatttatcttttaacacggtgaaataacttttttgtggaatagatgcatagttaatgctaagttcgtgacaatcgaaacttcatctgttaaagatatggggcttccatacaatcaaaactttcaaaccttgtgagtggatgtccaattcttgaaaaagtagcagggatgattgtcatgtgagggtgcctctaggtgcattgtgttttgttttctagtacttagtataacagcatcagcctttgttcccaatcaagttgggggtaggctagctgtactagcatttgatgctttacaaaattggataagggggagcggtgttcatttgtatcatccaactacagttaggtcgttcttacactacataagcgtgatttccaggagcagttggtcattgggaggttgcttgtaattgttatgagagtaaatttcacaaaactacagatactatgaccaaattatcaccaaactacagatttaactcggtgtatcacaaaactacatatttaacaccaaatttatcacaaaactacacatttaagatgaagtgtcacaaaactacatatttagtaactaaattatcacaaaactataggtttagaatcaattaaatcacaaagtaatgatgtttatagctccaccataacaatggtgctagggatttaaactccaaaagttgtagttttgtgataagttcaatattaaatatgcatttttatgatacttaatctaaaatctgtagttttgtgataaatttggtgctaaatatgtagttttgtgatacaactccttaaatctgtagttgtgataatttggtcaaaatacctgtagttttgtgaaatttactcttgttatgaattatgatataacgatgattatctggtggatgtgcctggcataatcactgacctttatgggagtcggaggattggccttacgagtcattctatcctcatacatcatctgtcaccagattttatcctgttggtgatagctggcaataagttttagtggtttatttcaacttgtttttggcaggtacttctagatattaaggattcttaatggcccagataacacaataattggatagtatggacacgagactcaatggacattttttataataggaaaatcattggaaatgtatggtttctggcagtacttgtcttagccatgtttcaaacttggatatgaatcatcgctgacatatcactttccattaacactcatcttgaacaatgataatgcataacatagaccagacgcaaggaaaaaaaatatttcagtagtctatatgtcaacaacaatttatttgttgtgtagttaggaattagaatttaaatcatgtctaatcacagttatctttaggcaaaagtcacaactggttttgccaccctctgacaacgatggtctttgtgtgtcgattgtaagttaaggttatttcaaatttgacttgtgataagcaactacccagatttatttgcaagaggggtaggcataacaaaagttagcgtaagctctccatgcatggcatgacatgcacaaagaaaatttgtaattttcaatattaccggtatggtcatatggatgccactacttaaggggatattttgatggattaatttcgcagcattgattgtgtgtgtgtgtgtgtgtttttttttattattatgttaggatctggttacgtgcaatgcatttcaaggttgaccaaaagcacatgttcacagttccatttctttgtaggtaaaacccctgtacccgtagtagccacagaggatgaagacgaagaactagcacgggcagtagcggcttctcttgaggagagtaaaggctctgacactagtgaggaaaagattgaacctgaggtagaaaatgagcctagcctgagtgctaagctgaactatcctcctctccctgaagaacccaaaggaagtcgggagcttttgtgcagagttgcaattcgcctacctgatggtaggaggatccagaggaatttccttcacacggatcctattaaggttagaacactgaaataaatttccatagttttgtctcttctcctacattgttcgctgatgctttatccatctcgccgcagctcctgtggtcattctgctatcctcaagtggaggacggggataagaaggctttccatttcgtacagcccattcctagggcatccacaaacctggagtacgagagtgataaaactttcaaagaagccgggttggccaactcgatgatcaaccttttgtgggactaaaagcctattttatcaactcatgttatttctttattggctccaagtcaagattatcgagtgattttctgtgagggttcataattgcttctcttatttttctttttccctcctggtgcttggagccaaatgacgaatctggtttctttggtgtggaaatgcccatattccttttgtagtggttcctagtatgtttatagaactcttgagtaggtttactccagttctcttttaatgcatataatattattatacctgaacagatgctgataaaatcttgttcttcttacctttggatctttgtcaaatgctggaagagaaagtccactaataaccatggtgcccgtggtaatccttgcgcttacctgcatcttactttttgggaaaagacaagggtgtgatggttttggttggtactcttgagttctgtttcgttcaggcaggctccagttaattgtgccgagggagtactcttggtgatcagagctactgccataccagccatgtccgtacgggcacagttttatcttgtctgatcgaggagcgtgaacagttgctttgcatgccatgttgactgttgactttgtctggacgtgaaccatcattatatatcggatgtcggttaaatgtctccgggactgactgtagactgtagttggacgcaaaaggtaagaatgctacagctctttttatcaaagtaatttttttaaaaaaataatttaataggaaccagttcagttttcatgaatttccttaattataagaccacctttttaatgtaggattaagaaaatgtagtaaaaggtagcgcacgatttaggacagatataaaagaggattttcaaacatttgagaaatgaccatatatataaaacacaagaaaaatgcaagaatgagaaaacacattaatatgaaaaatgtaaaattttaaaagaaaaatagaaatgtaaaacatggattttcaagcaattttatgtttttacacgaacgacagtttggatagattgcaagaaaaattgcagagattttccatgacgttagatctcatgctaatttgtccataaaattttcttgtcataagttattcctttctaaaccaagttattaactttctactaatacttaactcgtttgattgttttctcctataatggttacaaaattcagttttttctatcatccataattcacaatatgttccatgctctcacagacaatctaccgactaaaattaaagttcagtactaccacggaattctcgttccagcgcagcattcaaggtttttaacccatgatgcatcccagtggcctaacctatatattactaccctgtttagtttcaaagttttttttccaaacttttaaccagtttttttttttctaacctttcaactttccatcacatcaaatctttcatacacacacaacttttctatcacatcgtaccaattttaaccaaactttcaaacttcagcgtgtactaaacacagccaattatctctctccccatggtacaataatgtcatatactgtcaccgccgctacccttgctggacaagtacacgtacggtgctggatggatgggtttgtgtggggctgaaacacagtgtgggggaagagaacggtggagttttgactggctccgtttgactggcacgcagctgcgtgggggcaagccttatgatttgcctgcctcttctgctgctgctgccgctgttgcattggccggtgtcaccctctcgcagcagcggcatcggcagtggctgtggctacgcgttattattgcagctgtgggttggctttggcttggcttcttcgttttcactggcccccgtgtccctcccggataggagaggaggggtgattggtggcggtttggcccctgcccatgggccgggattgcatttatacaagctgccatctccggcgcatccgtcgacgtaccagtaccaccgtctcgctgccagtaaactccatttcaattactcctgtgtgtggtcgtttaagatagcatcgtaattctattcttgtatgactagctagctatgctactgtcgtactagaggaccctatatattctggtcaatcaatccaggatctctcgactaataacacaagattaagggctccttttgttcaaaaaattaagacatattttgttacgttaagacatgatttagaccgataattactccattagcatataatttttcgacatcaaattggtgttaatagttttatattcagaagtactttttatgattatgcttttcatcacatgaatagtatataagtagagcaatttatcagtcaaagtcttatactaataatacaaaatactaatatttttagatgcaagaacactgtatatcacttatcagttcggcttgcctctgcagctcacttcaactagtttacaaatcacctgatcatcagtaacccactgtgtgtgtactaatttctcggatataaccagcagttcatgctttcgttttatttcttttcctccaatataataatgcaactatttgtgcaaggctccaacccaaaagcctgaaataaatggccacaagctcaatttatgtcctgaatgtataggcagattgttgtaagtaggggcccggcctacgctcctccaatggcaccacgtcctctgacgtccatccatgagcttattgttgtcttaactatataggtacggcgtttctcgtcgatctggccgtcgaaccatgcattcacagtgtgttgtttgtagctgcacctcatattctttttcaggaagtactagcttttttaaaaaaaatcaattaaagctgactcacaattggctcattaaggggttgtttagtagcttgaaaaactgctatacgtacttgagttagccaaattcagtactagcttaattagagcatactgtgttcaactgaaaataatccaatacattttttttctcgaagaaagttcagttttgcaactagtgctggtacgtgttccacttcctcttaatgaatagttaaacagtatgtatcattccattctaccgggctcatcttttcgcttacgcttatacttatcagctaaaatttgaatttttaatcttaaatttaaagctgattttgagtttttttatagaagtttatttttcagtctgtgcttttagatcactaaggacacatatataaaagttttatttataaattatttttcgtttataaatatgttgtttggcttattccagatataagcccaacgatggggctgtatatgtggcacataattcaggcaaaataccaccaaacattcccttacgaattaaggtttttattctgagtcatacaaagctcttttctggcaaatataagtacaccgtacttgttggacggaacgggaacgggggtccttgtgcgtgcgtgcgtgcgtgcgtgcgtgtgtgcgtggagaatcgtgcaggctgtgccttttttttttttacagcttgcatgcaccgctagctcgctcagctccggatcccctgcccacgcactgcatctgcatgcctttttacagagcgcggctctctctctctctagagcccatttcagtggagctactagcatccaatgctccaatgcttttgctctttgcaagtacgcacctgtaggcccccctgctccagcgttgccacaccattttctcttgagaaatttgtagtccaaggagtagaagtacaaattttacgattttttgagcttaattagagacatgcataatgcattgtgtagtacaatagagattagggggtagtagcacactgccctgtctgtactgtagcagcaagatgacaacgaagcgtaacgtcaaaaaaactactcgtaggcggctatgcattgcatgggcggtgaattataagggtgatcgatatgatcggtgaggtgaattgaaaggagcaaagttgaactcgtactagtagtggctacttctagctagagacatgtggaattagctttaagacctatactgtgtttaattcacatcaaaactaaaaatttggttgaaattggaacgatgtaatagaaaaattagaagtttgtgtgtagaaaagttttgggacctgttcactttgatgccatttacaatcttaccaaattttagtaaagttaccaaaaaagttgctacatttagtttgctatcaaattttggtaactatataagaaattctgctaaaattttagcaaattaccaaaattttggcaactttaccaaagtgaacaggaccttgatgtgatggaaaagttggaagtttgaagaaaaattttggaactaaacgtgatgctagggtgtgtttagttcacgctaaaattgaaagtttggttgaaattggaacgatatgacgaaaaagttaaaagtttatgtgtaggaaaattttgatgtgatggaaaagttgaaagtttgaataaaaagtttaaaactaaactcggccctattcgggaagcttcagtttataattcagattctaaaaatatatatagttatagaaccagaaaataaagtaggagttagaatccgagaaacctaaatatttttaaattctttaaagctaactatttcctccatttcataacgtaagttattataccattttctatattaatattgatgttaatgaatctagataaatatatatgtttagtttcattaatatcgatatgaatgtgagaaatagtaaattaatttacattgtgaaacgaggagagtaccatttaatttctgtttctcataattttaaacttctcgaaacaggtccttaactagggttacgtatacctttgtgattggaagggaggggcatttcggggatatgagtgagttgagtggcatggtatctactctgtccggtcaagggggtttgactacggctctgagcggggatgacagctaggggagattgtcagggccttttctgacaccacaaagcggggagaggaatccatatactcccagtagtagtagtagtacgtgtagtactagcactccaagccaacctcaccaccaccgcctgtgtccagtgtccagtgtcctgtccactctcctctcctctcactctcccacaccaaaatcatcgccatcgccaccaaaatcaattaaagcctgatcgccaccaaacgtacgagtactatcctatacgctgtgccgccatctcagtatatgaggtcaaccgtaatagttatttagggcacccacaatggttatctataggctctctataagagatccatatcagcatattttcttacttgaaagagattaaatgaagagagagagagcaaagctatctactaacctagagatagtctatagagaaaaacgaggcaatagattagaaagctatagatactcatgtgtagatatactattgaggtggtatactattaatctaatctattgctgagatgtatatgttttataaatagtaccttactttaacattgcgggtgctcttatagactatatataaaagatccatgtcagcatattttcctatatggaaaagattaaatgaagagagaaagcaaaactatctactaacctggagatagtctatagagaaaaacgaggcaatggattaaagaggtataaatacccatatagacatactattgagatggtttattattaatctagtctattgctgagatgtatatgttttattgagagcaccttactttacccctgatatcttaacctgatctgtttgcttgcttagcgttgatgaacgatgtagattaccataacttgtgttgtcgtaatatatcatcttaaaaagttaaaaaattaataagataaatcaacatataatataccacttcacaaacatatttataagattagattcaactaatacaagctaagcaaaaatattaataaatttgactacgaatatataataaatagtttatgggttctttttctaaatttataggttgaattttaatttatatgtttgtgtagtggcatatcatgtgctatcttttgatctgtattattcaattctttgaaaaatttaactttttacacaacatacatgaaacagggaacatcatgtgagaaagaaaacaaatctatctccaaggagtacaagtacaccttacgtcccaaaaaactaatttttaacaatgaatctaattaagataaatattggtcagatttattatcagaagttaactctttttataactgagactttcttttacagttctccctaacttggtttctcgccgttgaataaccaggcaagacaatggaaaattagaggttgtttttatgcccaaaatgaaaagaccgaaatgcccctatctgcgctgcctttggggacggtgaggtgaggtgaggtgagatgatgggagcaaagcgacaagacagcggtccacccacacccactctctctctctctctagtctctaccttccctctctcgctagaatagattagcataatagcccaggtagtacagcacagggcggtgccggttgatcccccagcaaagcgcagccgtcgcaccaaccccgcgattcgccggccgcctacctcgcgcgacggccttctcctcaccaccacgccgcccgcgcagaatcgcagaatcgtgtgtgcgttttgagccttttttgaccgcgcgcgtcccatgcgatgatccatcgatcgcgagcttttggcaaagctacgctacccaccacacaggcagcacagcagagtagctagtggaatcgaccagagaagagaatctctcccctactagttccttctcgcgttaatttctcggtggaacacaagctacgtacttcgtataagtaattaaattcttttcacaagaagaaacaaatcgtgaggaatcatgcaggctagctagggatcgaggagctacgtactactgtctgtaacgtaagcaaagcatctacgagagctagctggttgttaacctggagaatcagcacgtactacgtactaccacatgattaatctgtctacgatatcgtctctaaactaacgagctagtagtaatatatgtgtcgtgcatgcagggctagctatactagagaggtggttgtgtgttcgctgctgctcagctcggctgttcgatccggccgccgacctatgcatgtggagaacaacttatccgctcgaggaagtatccttccattttgtgcatatcatataaatagttaaaaaaaattaaaaaatttagcaagatagattaatatgaaatgtatcactttacaaatatgcaaattaaaattcaactcctataaattgtaaaaaaaaataaccaatgtagacgtgaatgtacggtaactattttcagtttagtttgttctttttattgcagcttatagaaattaaatttggttttgcatgtgatatattttgtattaatctatattattattttttaattttttaataactatttagataacatatagtaaacagtaaggttgtatccctcaagggatggaacttatcacttttttttttcttaaaccacagttaagtttgcagtgaccaggagttcaatgctgtgagacgagacacatgcatgcacgcgagcaaaagcaggtgaggtgagtgagggtttagcgcgtgtgtcggcgagcgtagatacgtgtgggactgtggggtaatcgcggtcttgatcacttggccgcgtgcgtgcgtgcgtgcatgcgtgcgttgcattaatccggacttgaaatgggagcagcgtacttggcttacccggcaatgcagagagacacacgtccctacaattaattgtcatttgctcagattaccatctgcaaatcacaacattgtgctagctagagtaccgtactagtgataccattaattaattgacagaagagtgtagccagtgcatgcatggatcggtacaatgcacgtcaattccatgtactcgatggacatggacgggcgtcgtcgtatcaggtgatttgcatgagtacgtactccgctgtgctcgatctcatgctatcttgtgctcaacaattattacaccacacgaacgtagtactgtactagtactccttttgtcaaaaaaaaaaaagcagtagtgtgtttctttgtccaacgaagtttaaccatctatcttatttaatttttttttgattaatacttttatttttattatagataaaacatactttatgcgtgactttttttaaaaaaaaaatcatattttttatataagacagacggtctaatgttagacacaaaatctcataattacacttaaaaataggacggagggagtatatttttgtactctcataataaatcaacctaagattgaatgtgacacaatctaatacaataaatttggatatgcatgatcagatttaatttattatattaggttatgtacaattcaattcaatgttaattagtttaattatgaacggagtatattgcaagtacaccacgggggcaaaagcggaatctcgaatgtaaagtggtagcacaaactctgatctgattcggccaacaccaccatagcacaaaagcaagcagaagtagcagcaaagcttgtatagctcagcacgagctcgttctcgcacgcagttgcagcagctatagcggtaaccgtggcccccatgcgcagtagtgatcacatgacagcgcagcgagaccaagcgacctgcagctagagctcagctctctcatccactgtgccgctaatgatcgccgtccacgacaaacccaacacccgagaagaaaaaacgcagcaacagcaacagcaccagcagcagcagccacactaaccatttcgatcattcacaccacacacctgccagtctctccactaattgcacgaaaagaataaacaacaaaaaaatcacaggacacaggagagaaagaaagaaatcaagaaacggaggcgttgtgcatgcaatgcaccgtactcccaatactcgcagacgacgcgatggcgatgcacactcaaaaaaaaaaatatatagctactcctcttcttgcagccattccaaacaataatccgatgcctcgatccatgcatctccatgggttatttacatcgatcgtccttgctgcattgcatatgattgcaatggcgatcatcggccggaggagtcgccgctgcggtggtcggagacgagggcgtggatggcggaggagaggctgttgacggcggcgatgaggccggcgaagccctggcggcggacctcggtgcgctcctcctcgaggcgcagccgccgctcctccagctgcagcagctcccggtgccggcgctcccgcttctcctcgcacgccaccagcgtcctcgccaccaccgtcgcgctcctcaccacgctcgaccccagccggctcagccgccgccgcttcgcctccggctccccgcccgacccctcctcctcctcccccgactccgacgaccccgacatctcctcctccgctacacaaataaatcacacacacattagtcaaccacttaattaatcgatcaatcaattactcactccgccccaaaacaatacagttttaaactattcatatccaacgttttaaactattcatatccaacgtttaatatttaactaatacacttattgttattagataataaaatataaatagcatttttaaatgtaactaatttttttaattatcaaaaataagatagaacggtcaaaggatatctacaaatgtagtattaattactgctaatataggtatagttttgttgatcgatacaaaagtccaaagtagttcaagatacgcagcgcggcatgcatgcacgaggagaaaacaaaaggtgctttttttttctccaaagtttcaggcttttttttcattcaaagcgagtgatttcgcaatgtaacgcattacgcatgcttgcagcatggcaggagtagagggtagtatcgtcgtggagtaaatctttcaattaaacccccataaaatatccggattcgcatcacctttcccatgcatgaactgcaccacactgcacgcagctttattctcccaacccctgagttgaggacattattattaccgcgaccaccctctcccgaaccccacggtaaaaaggtaaaaaaaatgtagcggtagtaaataattacgaccagctcaactcaacaacgtaactagcccaatcataacgcgggcttttaataacgtatagtggcggagctcagctcgctgcgaggtgggcccacatacagtgtgagagaacagtagtaaatggtttggaggggaggggatgtaacagctactatgagtattaagtgtacggtgcgcgcaccgaccattaccggaaacggacgccggcggcggagccacgaccgcggagggagctgcagcgacgacggcggcggctg

SEQ ID NO: 48277 - DNA, 25909 bp, Oryza sativa
gtcggcggcgacccggcgccgccgccaccagccgccgcgcccccaacgccggcgcggcggtcgtcgtccagacgattggcggtgatgaggatgagcgtctcgtgcagcgtccagttccccttgcggtagtcccgcggcgccgaccccgacgccggcgacggcggcggcggcgccggccccgtcgcccccgacggcggcgtagcagtcaggtgcccgtggccgtggccgtgcgcgcggagcagcgcgagcggcgagaccgccgcccccgcggtcgaggcggatggcgaggggtcggcagaggagcccgacatgctcgctcgctcgcgcgcgcgcggcgcggtcgtgtcgtcgcgggcgtagcgactggcgagagccaaggcaagctgaggcgtttggtgttcggggagcgatgcgcgtcggcgtcgcccgtatttacaaggccgcacggcgttgtgtttttgcgtgtgtttccacccgttttttccctcgttttttttcctctcctaatcaaccgagcgtttagctggttaagtagtcgaggcgagcagaggcgttccatgtgagcgagtgggggctgagctgagctacttcgctctcttctcatgtgacagacctgacactgctcatcaaaactctgttcgggtctttttttttcttcttcttcttcccggtcttcttttcagttcgctgactcttgtttgtttcggtttgtaactgcactgctgctttaccttaatcacaggctttaattaattactgctacttaactattttctttctgtaacacgctgatactactaccttaggctaatggtgccaaatactagcatgcgttttgcaatttgccgtgggaacggagggagaagtagagagcaccatgcatgcaaatgcaaagcgtccgctagctgccggggcgtcctctcctcatttccgggcaaaacccggggccccttttatctgcaccggcctgccacgccatactagatactgctaccaatagctttttaacactttaaccccacactttaccatggacaggacaaagctcaatatagttatagactttggtgcaatgctaacatattaggagatatttaagtatttgctagttgctactcatagattacttgacgtttagcaatttgttaccctatgcgtctactcctatgtcacacgagtgttaaattgttgagaggtggcaaataattaaatgtctcgcatatactcaatctgtcttttaatagatggcgttattgattttttttatcatacgtttgatatttcgtcttattaaaagacgtgtgataaaaagtgaaagatgtcatttattaaaaaaaataaatacgagagggagtatgtatatatgcaattaaaatgattgatgcaaataatgcagctatgggatggagcacacgtacaaggtgaaggtacaagtaaatagtgcctaaattgttcgcatgagatgttgctcaaaaaaccatttcccaaacgtgcttggtggaaccgtccctatatatgttactgtgtgagaggtgcagcagagtcccctgtttatatgtgtgcaaaaatccaacggtggcgcactggcaactcccccagaatccctgcacttttcatcgaggagccttttcgccggtactctgggcctgttggttttttctgcagtttagcacatgatcaatcaaagtatcaaacaacagacacatggaaagaaaataaaataaataaataaataggtgaataaacgaactcttttgcaatcatttagtttgctttcaggagtccccacagatgtggttttgcacattaaggctttgacacttgggagcttgggacacagaagcaactaggcttaggtccactccatatgttccatttgtatagagacgtttgcactttggactggatgacatgttctcttctctcctttttgctgcattatcttggtgctagctaggcccctcctctcctctattgagcctgcaaaaagaaatgaggaaaattgaatgcacggatgatcctgctctcctagccaaatcaccctaccatgcaaatgcaagctagaggtgttaccgtaccgctgctaatcaaatccaagaacattcttcgccaattacggcttttttccttgtcctttgcttgcaaagtaaacgcgcgtgaagggagggggtttacaccggtggcgcggctcacggttttccatcttgtcacctcacgctgtcacacgttgcgctatggatggatggatagctcatagcctcatagccccatcggttgccccaaaaatatataataagtcaaaaccaaaatttaaattttgaaataaatttttcagcattatcttttaagtcgtaagaacacacacatatataaaagtttcatacagtcactgataaagtctaacgatcccttatttgctgaaacggctcgctcggcaatgcgttttccggcgttttttgcagggaacgcgcgcgcgttgtttgctacggagtacttttcacgaaattgattgggtcacattggcccaaggatttacgggtgacgcctctgaaaatggcccgttgggttgtaaaaagaagcgatctgcagactgtgagatgggcttgacttctacggccagcggatcagcggacagccagagcccagaatcataggcaccttctacggcctattccaattttgtactacctaaatacgaagttctttgtttttcatttcatttcatcacaagaaaataaagttctaagtgatgaaactgtggtggaatgaaaaaaaagaacaaaaaacagattttaagttatgatgaaatggaagttctgagtgatgaagctgtggtggaatgaaaaacaaaaaacaggttttaagttatgataaaatggaaatcaaaaaaagatcaaaagattggaggtgcggggaatcgaacaccgtgcctctcgcatgcgaagcgagcgctctaccatatgagctacacccccgttgtgacggtgagttgctaccaatgctgtagtataacaattcctaacgcctttaaccgtgataccttcttctaatccagatactatttggttcctgctaaaagggtagacacatttcttaccgtgaggagattgcattcgaaaagacagatttgctacttgaactgagtctgtgacctctgctgtacttcctccgtcccaaaataagtgcagccatggctttccgcgtccaactttgaccgttcgtcttatttgaaatttttttttaaaaaaattaaaaacataagtcacgagtaaagcactattcatgttttatcatctcataacaacaaaaatactaattataaaaaaatttcaaataaaacgaacgattaaagttgggcacagaaactcatggctacacttattatgggacttattatgggacggaggtagtattcagcaggctacttgcatattcagataagacccaacctggggcaagggaaatttcagaaccatgtgcaaacactctcaatgtgtcaatagcaccagaatttcattacaatggttgctctgtattgctttcaaacaggcatagttgcaaggaaaatattactgtcatcacaaggcttgccttgtgttgctttcaacaagcatagttggctacaaataaatgtgtattggtttattggaagctttctcatttaagaataacaaccagcacactcatcgatcatggcatcatgcaagatcgatgatgaatcacctatacaattgagtgctatatcaatataattttggtaacccgattgaactacttctagaggtacaaggaatactcattacttaactacttctggcgtagggctacaaatacataacgaacattcctaaagcaaaaatcatgctgctgcagatctttcattgccagggtctaaattcaatgcttgcagtaacttcggccatgattctggaattcctcctggtagattgaactccaatagtttaccacgtgctctgtagaagtcctccactggctcacactgcaaaaatgacagcttagagaggacggcacgatgccaaagtaaactaaatgtaaactttcccttattcagcttttcatttgcacataaaataagacaagccattagtgcatgataaattgagtataaataaaattaaaaaatgagtttatttgttttttaaagaaatttctatataaaaagtttttttttaaaaaagaaacacattgtttatcagtttgggaagcatgctaacggaaaacaaggaatttgcaactgccgaatgcccaaacaaacaaagccttagtcttttactagcaaattacaagtgaggaattcaataaataaaaataacacaagctagaacataccaaatcatgataaacacgcaatcgctcctttaccacctcttcagtatcatcaggcctagttatcaactttgattcacactgtggaggaggcagtagtggaggcatgtacattcgaggaccaccattttcgccctccatatcaatggacgctacattaaaatttccaccacactggctgcacatccttctaccaaggcattttgcaagcagagcctcttctcggagtttgaggttgatgaccaaatcaatatccgtgactccttcaagtatctcctaccaaagcacaaaatagttccagtggataagatttaacaagtagttgatgattgttggcctcaacgatatatgcaatataggcacaaaaatagcatcttaactgatccgtttatggaattatggcacacctaagtaaactaatgcatagctaccaacttatgcaaaggttaacaaattgatttgtctagtcgccaaaatgctgctagtaaccagatcaagctgattataaaggcacagcgtcttaatgttgaactgccaaagattaatactacctcagcaatcaagttacacattatgtgtatcaaattgcatgctatgtatatgatttcacctcttaaatatgaaaatgcaaatttgaaggcaaatcataattgtatactgagaagttgcaagtatgtgttttgcatacttacagtcaggtcaaataactagctcaccgcttgtcttatggttcttggaaaaccatcaaggatgaagcccagctcacccttttctgctccctcttcaagccgctttgacagaagatttattatgatctcatccgacactagctttccattattcacaatctccgcaagctgaaatcggatcagacacagaacaatgaaaaacatagaagtaatacattactattctcacatcaagccatctctttaggcaccctaaggatcattcttttcctgttcgttgttataaccacacgtactacaaaaaaatcttacataactcttacaaacaatgatcttaaccgcttgatttaactagatgggggttagaggaaatctagatttacttatagcataataagactttagtaagaacaatttagtacttaaagccttttccgtactcgatgcaggggatccatcaacttaacaaaagcaattgacagcaagaaattggaatctgaaaaacgcatgctctcttgttcattatcatccatccccatcaccatcattgtgagacctcgaagggcgaaggccaagagagaggaagagagaaacggaggcggcgtttcacctgctcggagaaggggcccggggaggcgagggcgtcgcggacgagatcgccggtggcgatgtggggcacgcggagcatctgcgagaggcggctggcgtaggtgcccttccccaccccggggcagcccaggaacacccactgcacgcgcctcccgtcctcctcccgctcccgctcccgcccgcgccgcgccaccgccgccgccgcccgcgccccggccgccgccacctccttcgccgacgacgccatgctccgccgggaccccgcggcggcgcacgcccggatcgcgcgcgagatcgccgccatgggagaagcgaacgaatggacagagatttttttcccccgattttctgtttgtttttcgtgtcggagtagtagtatttttttgactttgccgtttgagattttttttttttgatctcttggagttcggggaaagcgttaggtatagagaggcgtagcgtgggtagcgtggcttaagcggtgcgctcacgtgcgtcaataggaaaagggctctcgttttctttttggaaagggaaggttagggttccacgtggaatcttgggagattctgccatcgtggacatgtcagctcaaccggtctccctcccaaatctctaagtgacgatggagtaaatacatatatatatatatttgagtcggtttttaaaattatttatttttgtaatacagaaggaatcatataagaagtctgtttaaaaaactcgcatactaccttgagacgatctcgaactcctaaccacagctcatgattttctaaaaaaatatatatccaagcgaactcccacaataaatttcatcttaactaatccatataacaataataaaattaaaatatacttcacccaattaaaatatacttcagcacgaacattttttctagtatttataaaaatttaaaaatatagttacgtataaaatactatttacattttatcatctaacgaaaataaaaatactaattagaagatttttaaataaaacggagagttaaatgttgtattaaaaactgaattttttttaaggaagtagcgttttattgtagtcacaagatgacctgtcatcttcagaactatgcgtggcgccaaatttgtgttccaccacgtcgacgtcgaggtcagctgccatccaccgccggcgacggtcaaaggctcaaagcaagcaaaggcatgagacgagacagccgtgcacttctccctcgcaggttgcaatcacagcagcaaaagacgaacaagcaactccagcccaactactcacattcattcactccaaggttgttactagcattaattaattgaaactgtgtcccagtacaaagatctcaagcatgatctcgatttatttattcaataataacatgacaattacataattattaattaataattttgattcatgcagttaatcccctacatgaacttgaacttgtatgagtgattgaatcatcaagattccagggcataggcatggcaattgaatcaatccagattccatgacaatggcagggtggagcaggttcagttttttcaggtcctgcaaatctgaaggggagcaatgactccggccatctcctcgtaggccttgacctggacgaggtcagggatgcccttctgcatcaggatgcgcttccggcactcatcggcggcggcgatccccgacgagtaggcgccgtggacggaccccgagtggtcggcgctggccgcctcgccggcgaagtagaggttctccaccggtgcggcgaaccgcgccgacacgtcggccggcttcccgaccaggtcgcacgagtaggaacccagcgagttcgggtcagaaccccagcgtgaaaccaaatacttcgtctgcaataacacaaatcaacaagtgcaaattgtcagtcgcaagaacaacgaattcattcagataatgcgaactcgaaaatggaactaactgtggccatgatctgagatggcaaactcacaggttcagtggcgtcaggtagcattttcttcaggtgagacatgaccagatcaacggcctccttgtctgacagtttttccacttcttgagcaaatctaccggcggccatgtagacgaggaccggattgccggtggccttgtggaggttcaggaagtacccacatgctttaggcgttgggccaaccattcccagcacctcaacattaggccagaagactgtatcgaagtgcatggcgatcttgttctcgataccgacaccaaggtctgcgattgcagagctcttccatgagggcaactcaggctcgaacttgattatgtttgccttgagcacaccgagcggtactgtaatgatgcaagcatcggcagagtaacttgttccatcttcagtggtaactgtcactccattgaattggcgggcaattttggttaccctgaagatttagcagtagcaaaagcgagtaagcaaaactgtttagcaatattgacaagtgaaacgacaagtaattttgtggagccaaaatacactgaaaaagggacttcagtatgctgaaattaattgttgtgtttgtatgctcgggaggtaaaagaacacacctttgattaagccggatatctagaccttgtgcaagagcctgaattataggatagtatccgttcaccatcagaccatggccaccggtaagaacatgctcctgcatagttaagaggaatacaaacataagtaactaactatgcaagatggcaaacaattcgatgtaatttaccaatatccttcactaagcaaactaatgtcactataagaatgtgcagtgtgctaatatagactgatttcagctaacctgatcccagtttttcagagatatttcatcagcatctgcagcaaaccatgcctcaagccgacagacacaccattgcaagacttgatcatctatcccttgtaacctacaaataatggtaaccatatcagtcaacctctcatgatgcatcctaggaatttattaagtatgttgtgagtaaattgatagcatggtacaagaatgtgcatacttcagatgggggtgcctctcaagaacaagtgaaatcgcctgtagaaggggcatgtcatgttcctgctcatcacgcactttaactgtctgcaatgcaacagaaaattttttttggaacattaatgcaacagaaattagatagtgaactgaacatgctcttcaaacggcaccagaagtaccaagtataaatgagttcattatgtacctcatcaagaattctttcaaatgtttcttcaactttagcaactgtctcctttgagacctgatggccagccttatcaaagagtgcataactgtaacagaatcaattgacagagttgatgtaagaatcaacaaggattgtgcggatcggtaaagaaaagcgtaagatcaagagctaaaagattacctttctaaatcatgatcatacagaacagagttgtcgccactagtgcgatataatttcagcccaagatagccaatcaatggtgccaaggagttctcattacaaacgccgtggagcctgaatttttggaatgaacagtaagtaagcttgtatgaacagaatctaaagtgaatttctcacactaacaattcagggtgagactgaccatgaggctcccatatcaattgggcatccgaaagagtaatcggtatggacacgaccgcctacgcgatctctggactccaaaacagtcacctcaaacgaagcattggagagagcacgggctgctgcaacccctgaaattcccccaccgatcacgatgacggatggaggcgaagcacattgcctctcaatggtcggaagcaagaggcctgaacaaaaaatgttttttactgtcaggtatgtgaatcataagagagagaaatcacgttgaacatcaagctcactaatctacataatactgtagatacccaagttaccaactaactaaccaatttgtacccaactagaattataaattctaataatcttgtaaaatctaaagtgtgatgatcaccttccctatgtggaaaatttaattctaaagtacaatagatagatttctaaaaatactatgatcaatgggaaatattcccacctttcacgacgcaccactaccaagtactcctaccagataaaatttcagaaaaaaaaattacaaaaaagtgggaataattcatacctccagttttgaggctattgggatccatagccgccagcgccgaagccgaaggaagagaggaagaagaagaagaagatgaacacgaagaggaagaaggtcctcccgtccccgtacacgcagccgcgaggaggaactccgcttacaggagattactactaatactactactggaattacaattattactactactgctactagtacgtatgggaatcgagatgaagaacatgaacacgaggaggccgtcctggcggcggctggcggcgtagcagcggcggtccgcgaagcagctcataaccctatcttgggctccaaaccggcaacacccgcgaggtccccctccccacaattcaactccaaatcctcaccaccacctcgaggagaggtagatcgcttctcttctcctgcgaggtgggtttgatctggttggcgcgtgtgattttgggtggggtccttcggttcggtttggtatgaagttgatgagggggttggggcgagtcttatatggagcggaggaggaggagtcggagtcggcgacgacacgggatcccagcttccgcctttgcgtttgcgtttgggtcgcgtagccgcgtttggctcccggacatgtgggcccaaatgcggtggaaatagttggcgtcggcaccagtttgtttttatcttttcttccttttacaagaggaactactagaacacagataatatatatactccctttgtattttaatagataacgttacgtttgagtatcgtcttgttaaaaaattgtgcaaatacgtaacatataaataatgctttaagtaattttaatgataaaacaactaaaaaatatggtaaatgataattacgtattttttaataatacgattagtcaaacgtgtattcaaaactcaacgacgtcatctatttaaaaaggaggtagtattgagtccgttttttaatatgtggttgttgacttttagacatatatgtttgaatattcgtcttaaatattttgtgtaaatatgtaaaatacaaatcatggtaaaatgcattttatgataaaacaaaatacaatgaaaataaataatagattttttaatgaaatatgtatttttgaaagaaaaaaaatgatttttaggtggtgggggagggaattaatgtattctctgtttgtggctattacaatttacaagtctgatgctacaggatgggatggacattgcaaattgtggcagcagatgttacagtggaatgaatgcgtttgatatggttcacacgatggtggaatcgtttccgaatatgcaggatgctgtatggtttattattagtggagatctacgtatgaaagtaaagaaagaaaaacctccactgtttatgaccattgaactgcaactagcctgcatctacaaccctatatacatgcaaaatgaagcaaatgggggcgcaagccaagttcgatcagacgattactagtttactacagccctccagtctcaaggcaaacactgaaaactaaaataaattcagcagtactgactgggaatgtgtaaatgaaaagcaatatccatggattcagagaacaaggtctgttgatatataattattctgtttttatttgaatacacataaacgatcaaactgtgaaacggtacaggatctgagataattaggaaactacagagcagcagctacaatattaaccatagcagctgcaggataaacacggtgctaaataggcaggctttgttcttctttcacagcctggatatctggaaggggaccatgacttcagtcatctcctccctcatgataatcttcccaacctggaaaaggtcggagatgcctagctgcgtcgacagatgccttcggcaatcctctgcagcaacaatgcctgaagaataagctccatgcacggacccagagtgatcgatgcaggcggcctccccagcgaaaaacaggttgcccaccggagcacagaatctttcatacaagtcagctggcttcccaacaaggtcgcaggaataagaaccaagcgaattcgggtcggttccccaccttgaaaccaaatactggacctgcagttgtgtagcacaagtgttagagctactgttcatagtctgaaattgacagtactcaactgtacatggtctgaaaatgaattttgaggatttaccggttcagtagctcctggtagcattttcttgagctgagacatgacaaagtttacggattcttcatcggatagcttctcgaattcatatgcgaatcttcctgctaccatgcatacaagaaccggatgccctgtggctttgtgaaggttaagaaagtaaccgcaggcatttgatgttggggcaaccctgcctagcacttctacatttggccaaaatacactattgaagcggagggctattttgttctcaatgccaataccaagatcagatattgatgaaagcttccaatctgggagctcaggttcaaacttgatgatatttgctttaagtacaccaagagggacagttattatagcagcatctgcaacaaagcttgtcccatcttcaacacatactatagttttgttgtacctctggatgattttggtaaccctggaggaaagttaagagataagatactatagatttgggattataactatgaaacctatgaaacagaacttatgtgaattacttggccatgaggatatgtaactgcatacctgtggttcaggtggatatcaagatcttgcgcgagagctttgataacaggatcataaccatgcaccataagcccatggccaccagtaagaacatgttcctgtaaatttgaaaggtcagtccactgctctacgtgaatacaacaattcttcatgtgcgcatgtaaatacaaaagtgccccctattgcatacctgatcccaatttttcagagatatattatccacatctgtggcaaaccatgcctccagcctacatatgcaccactgcagtacttcatattgcaaaccatcaagcctgtaagagtgaatgcatatcattagaacatttcaccccgtcgctaaagcaccaccattccagatataggtgaatgctaaattccacttactttaggtgtggattcctgtcaagcacaattgagatggcttgaataagaggcatgtcatcttcatgttcagctcttactttcaccgtctgcaatattaacaaagtaagctcacaagagttgcataaaagcatttgatggataacaaatgaaatgcaaacgatgacaatacctccttaagaattttctcaaatgtttccccgacttttgtcactatctcctggggaacttgacgaccatccttatcaaagagagcatagctaaatgaacaaaaacaacaattgtaagagaatgaaagcccatcaagttgaggataaacttatgggttaggaataactcctaacctctccagatcatggtcatatagcacagagttatcaccactggtgcgatataatctaaggccaagcaacctaatcagtggtgccaatgaattctcattgcatacaccatgcaacctgaaccacatgataaaaccatgagatgaaaaccaaacacgttgcaaggcggcgaaaatagctacttctgggatgcaactaaccaagatgctcccatgtcaattgggcagccaaaagaatagtcagtatgcacacggccaccaagtcggtcccgtgactctaatagtgtgacctgtagttatgtaaaagtatctaagaaaaagggcccgggaagcatcaaaacattaacttatttttggacaataagctaatagaatatagaagacagagatatagttatttcatctttcaatgacagcatttaccttaaacgaagcattagacagcgcacgagcagctgcaatgcctgaaatccctccaccaatcacaatgacagaagggggagaggcattttgcccatcaatgtgacgaagaaaaagacctgaatgcaccgcacagtaaatttctgggttaaatattgaaatcaatttggaattgtagctcaactaatatcacatatttctcaaacatgtacatgaataagcacatttaaagtttcattcagtgcaaccatgtgtcatttgttaaatttatgactgaaaatagttgtgctttcgagcccacaagtggccaactgaataatctttgttagtgatttattcattacagttggtttttggcaataaagtgtcatgttcgaattagattgagcagaatgatccatagagttatttgacgcagagcagtctggattaatcgatgcagcagcatattctgcaaaaaatgcaatcaagaacaaggaaacaattcggcctcggatgctacttcttctggacaagggatacatttttttcctattgaccttttactcttttagagacctcaatttttggaaccttgttccacatctctttcacagttttgctagcaaattgccatcacaatcccttcctttcctctagattcttgctgattgatggtatctacactactgtgactcatctgatattgcaagatttaaaacaatgggggatggtccccaatcaattaaaggatcgttttacaacatttcgttttttaaaaaagaaaacagtaatgaagggtcctactttatgtatttatataattattacatagaacaaaaaaggtataaagttaaagatatgtacacatttcatattcgataggattttagctttgctttcaccaccttaatccatggctacgcaaccccttttgcgtattcaccggaaccaaaaaaaaaaagaaaaaaaaggatggctccatatcagcatttactgaatcgaaacattctgacccctacgatttgtgacactaaagcactgcactgtcatactcacacaatcgattgcgattgggacgccagtccacgacaggtcgacagcaatatttgccgtaacacaatcaacttggattttatacttggatagtaatctaaagttgcgtgtgggatttgtatgcatggttgaaattgaatagcactgatgaacatatcaatttgcaaaaaaataataaaataaaaaatgacttctctacctaaaaatggaaaaaaaagaacaggggagtattctgatcggagacgcacctccggcggcgaagccattagaaggctggtccattatcctcccgatccgagttgcgttcgacggcgacgaggtggagaagatcgaatcgaatcgaatcgaagcagagagagagagcgggatcagagagtgtgggggagaggcgagatcggctaacaattagaggaggagattaacgagtggtcgcggccaccacgtataggaagcgagaggtagaagacgaagatgaggaggccgtccatggagccgcggcgggggacgctcgtggtcggcgccgcatgggtaacccctctcatacccaaaccagctcgtcgccggcgagtcccctcgccgccgccctccccacaccggcgttcccctccctcggcgccacgccgccccgccgccgccgccgcgcgagccgagccgagccggtgctagtggagagcgcgagagagacacagcgagagattggctcgagccggagggaagccgatgatgcggtggattggcgcccgcggagccgcggttttatagcgatgccccttttgcgttttgacccctcttttttttgggttatttcgaaacacggccggctcgtagatcgagccggcttgaacagccgagctggatgggcacctgtccatgtggtccatccactctcactctctccgtcgatgcagagtttttttgtaattatttttagaacgatgcagagttcttggctcttgtgaattctcacaaccaaaccaaaatacaacggcattgttaaaaaaaatgtgatgctgaaaatcctgtgtgttggagtgttgcaatgttgcatgcattgtgatttacgggtaaactttacaaaactgtgtggaagttgattaagttatcgtaaaagtatatatttaatatgttgtattataaaattataggtatgctttatacaaaatttattgtaaacctatatatttaagatcaagtatttcaaaatttatcgtaaacctatatatttaagatcaagtatttcaaaactacaaatttaatattgaagttatcacattgtttaaatatctagcagtaccgttatgataaagttaattataaaagttgtagttttgtacttggtggaagacataaaatttttatgataattttattgctaaatttgttgtttggtgataaatttagttctaattatatactttatgatacattgatttaaatatatagttttctcataattttaattttatgaaatttacgcgtgcattatcatcagtgttgtgtaggaccatgtcagaatgaaagacttcacatcgcattttttttacgaaggctgcgcacagctttttctgaaagcttctaactgaccatgacacgtgtgctttggtttctgggctcaatgcatggtgcatgtgctcctttgttactgtcagcaacagcgtagatagtctgatactgtaccatgaagagcacagcatttccttttaaaaaaaattgaagagcacagtattgtattgtgacagtttttttttctccggacgagaagaagatcaagctgcagagcagacaaacaccagtgacagaatagccaatctgatggtccagtatgaaacgaatgcactacaaacagagaacacttcttcagtactgtatttaacatcaaccacgagcaatgtaaggcctgtcaaatctagattatactgcctgttaatcacaagggtttctggagtaattttcacataccgccttatttgtgtcagctgaattctaaacttcaactccaaactacagctttattatttttcattagcacgttttctgaactaataaatgatatgttttttttaatatataagttttcttaaaaaattaaataaatctatttttaagtttataataatatatacttaattaattacatgttaatgaatcatcccgttccacgtggctaacgcgctgtttaatagagggtttcaaagacaccataagctgcagaagaaaatggccctccagagtagccgagagacccggtggttggccgagacgtacacggacaactccacattcggcaagtagaccagacatgcatggtccatggggatctccatatttagggtatattcccctgcttttccttgataaattgtgctatctattagctggtatattctaggggagagaaaaggacagccaggctttctggactcgatgtggtagtgtattctcttggagagtttcagactttcagttagtgtgccatgcagcatgttactgcctctttcagttcttgtataatccatgcgttcattgctacatgtatgacaatgattctccaatcatatgagccaattgtttactccctcgtttctcgaattactgccactgatgactacgatcatcttactttgactaatataacacccttaggtgtttataaatttcaggaaaaaacaaatttgagcttgaatagtactgctagtgtcaattattcgagaacggatgaagtaattagttagctagtttccaaaaagtgattttactgtgatctttaacttagcattaggtgatctgtacacatccgactgaaaaaaaaaatgcgatgagcttcagaagagtagaggaaacaagaaaggcaatcgcagtagcaacggcgatcggctacagcgattgccatgccagggcagttgatgcagctgattatagccatatataaaggggaattaggttgtacgttaattgcaggtatgattgatcgcatctggctcttgatggatcgatcgagctgttttgtcgaggaggaggcgcaaagtgcaggcctccggaccccaccaccatcaaaattattggattgattgtcatggcccacgcgcgagatcgatgatattttttagctgattcatgaatcaacacagctgctttcaatttagatggtgatgtagttttagcagggaaagaaactggatagaaaaatgaatgccacgtaaggtaagaatagtctctaagtgttttctcggcacgttcagagattagcttagctgttgcgagatgattctctcggtgactgtacctgcagtgaggcagtcactgcagtagaagatagaatgcatcagcgtcgctcacatgaagacgaaatgattcatgttatcagcaatagttttccaaattccaagatggagggtgtgcaaatgcaaattgtgcaactccatactgcagttgcaggcttgcagcgtgagagacgaaagagcagcatcagaaaattcagacaaagctagtaggaaggaaggcaaagggaagctggtttcggttgtccgttggttctgtgtagggcccacgtccttccccggattctctccacgtcaatcaagctgcaaaaatatcactgcaaagtgggcccaccacgaactgtatacacctgttttggttgtcacaattcagcagcaagcttagctcagttcaggtcccgggacagagagcatttgctgttaacgagttcttgagctgacaatcccgcggccggtttcaccggagagatgcaggttttcaggtttggacccattaacttcctcgcatgatcatcacacggattcaattgcttatgcgaaattctgtgccacaaatttatgttttagtaaatcttaaagttcaagaatgggatcaatgtattgggtggaggaacctggtacactacttacaagagtttttataaggtgtagacgaaaatatccctacgtttatgtgacggacgatattccttcgaccctgtttcctatttttctgtgtctaacagcggaaatttccactgaattcagagttttatctgttaaaaccgacaacagggtatgtagtgtgtatctgatcaacttggcagcttctgttttgttttgggatcagctatcatctgttccattccatctggatcttccctgcttttatcagggaggaagggtactccagtgcagtaacaatccttatgataaaaacctgagaagaatgatgtgaatgaatgattcatcctggcccagttgacggccggtgaagagcattattcggtttccatacctttcagctcatcaatgagaaatgtgaactgcgatagcaaaggctcacaaaagatttagtggtgtaagatgtgcaacgcatgaaatgacgaccatgcaacctctctctttccttgcttttagatgctcagatgaggatgttaatgaaggtcttttgcttttctgcgtattttaccacatccaaagaacatgtttcctatggataagttggttttaaaagatcagttggactgggtggagtactaacactgaatattctaggcaatttaccatgtgcctgaagaaaaacacagaaagggtagctaccaaagattaggttcatcattctcggttgttaactttccaaatatcttttcagcaaggggaacaatcagacatgtatgagatgacaacgatatggtgtggcttttctaatctaaagatatcaggggaatgaataaggaagtttcaaaagattgcatataccgaattacatcccattcatagggtaggtgcctggattagtttatttgtaacgaaaagggcccttctggggcctgcattactcatatgtatggacatgttgcgtatcttgtagcctgttcttgttgtttgtctgatctgcacgggtagcatccagcatgacgacgcccaggtaactctgttgacagatgccataggtgatagatcctcctgcaactaccaattatcgcagttactctgaatgatttactatgtgtgcaactcttctgctcaatttacctctatgtaacacttacttcgaataactgtaatttgtgcagctgaagtgtaaaccgttctgttggctagctgctgtcatttgtaatatgaagtttagactttatacatatatgtgcaatactattagaagtacatatatgttttttttagaatttcttgtgtcagttttttaagttgatgtgtacgataaatgtatcgaaacttatatgtcctcagtcaattgtcgctgggatcttgaaccgtagggtagttatgtgttggatttgtcaattgtacagtatattatcatagattctaagcaatcaaaatgtatattcattgattgataaacctgcagttttctagaggctggatgtctcatcagcaatgatcaatcagcagctagatgttgactgcatctttattaccaataatgcaatattccgtaggccggtggattggatctgcataaaatggatgatgataggagtaggatattttggtgcttaatatgcccgtgaatgcatggtctgattgatggcatataatttggctagctagccagaggtccatcttggaccatgtccggcaccaataacccacttgcaattcgatctgtgatcctgcatgtgttgtgcgtaccttcagaatccctgaatattaatttcaagctagagctgtgtctttttttttgccgggacggccaaaggatggccggccaatttcattaagataggagaaaaaataagttacaaattacaagatttacatcgacatgaggatgtcgagggggaagaaagccgaaacagagttcagcctaggggaacaaacaaacgggacactgactactcgcactcttgggaaaaaatcccggcttccttccacatcaacgcttcttcttttatgtcttccactagatggttcgccgttcaaaacgatgctcaaagatcctagcgtttctttccttccaaattgatcagcaagtaagaaggactagactgtcaaaatctgtcctgtagcttacccggcaacgggctctcggctgaagccaccagcacattagtgggcagttttcctcggtgggaatcgggaagttgaaattcactctgctcctgatcaatccccagaccgcagaggtaaagctgcagtcagcaaacaggtgctggcaatcttcctcttctctttggcaaagaacgcagtgatcctcgtggggccaatttcttttagcaagattgtcggccgttaagcattttcctttgagagctagccacatgaagaatcgaaccctggaaggtgctcttgagtgccacaagaggtcgcccacaggacagtcctctttggtcgtgaaaaagaagttgtaagttgccgatgctgagaattgcccgtcgggagagaccttccatcggatagagtcatcaccattctgcagcgtggtgtttctgacctcgtcccagagctgaaagaactcgcatagggccgcagcagacaacgaacccacctgtgattgatcatcgcctgagccaccgtcagacgtgatctcccaacataagaaaacaggatgggccatctccaagcgaaacctccctttcccgtccaattcgacgtccagaagttagtgtcagttccattgccgatgacgaaatccgccactcaattgaagatagcattgacgtcgctacccagatggtaggaaaccagagtccacggccttcctttctgctcaaggctcttggcatgccatttcaacctcaacgcttgcccgaacagatctaggtccatcaccccgaggccgcctttctcaatgggcatacagagcttgcgccaggagaccagacagtgaccaccattgactttttcttggcctttccaaaggaaaccgcgacacttacgctctatgtctttcaccgcccacttaggcaattgaagaactgtcatgaagtgcaccggcaaagcctgaagaacagagttcacgagacagaggcgtccatcaatggagaggagtttaggtttccagccagcaacctttttagccaatctatcaagaatcggttgaatctccgccttagtcggctttctggttgaaagagggaggcctaggtaggtaattggaaaatgctgaacctgacaatgcaaaatagcctccacagcttgtatctgcgacgggttgcactgtattggtgaaagaccaagaacagctatagagggggggggggggggggtgaatatagcaattcaaatcttgcccccgaaaatactcatcaagccggatttctcaaaatccttactagaatcgcggctattagagaagccggatctagaaaagaagagagaaaaagaagagaaaaggaattcccgaaactagaggaggaagagaaaaggaattcccgaaactagaagtgaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacggaaactctctcaccgagcatctcaaaatgattaccaaaaggagcaacctccacccttgcatccatctctctatttatagcctaagacccctaagacattttctcaaatacccctagggcgaaaccctaactcagaacagatctggtccatccattgttccttctactcaaaggaaaagctccagatgattgccacctcatcgatccgaaccctcacatggtcttcttgctgatgaatccgcgtgctctccgtcttgacgaatccaaacttgccacgttgcccagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacgggggttgccgcgtacggtttttccgcgcgcgtccttgcgcatgcaagctgcctgcacctcctgagcccatgcgccatgggccgccgtcttgggccgtcgctgcttggacgatgcaggcctgccgagccgagccattcaccatcttgggccacgtggaacggctggattggcttggcctccctgccaaccaatcacagcgcacatgcacagctagctagcttgacttttccaccgagccatgctagtagcaaccagtacagtgcaagctcctccttgcacaagtacagtacgtgtacatgcatgtatgctacctacagcaagtactgtagcagcaatgcacttgcacagtcccttctgatttcttcgcgaatccgatgcttgcacacttggccttgtgaagcctgttgcaaagaccttttcacacggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacaatctcccccttgatgggaacattgacaatctcaagcaaaattttgaaaatttgatttttgattcacaaagcaaaccattttgcaaaagcgaactttggtcattttgaaatcgcgaaaaatcaagaccaagtgacaagaagaaaaaagggatgcaaatgcaaatgcaagaatgctccccctatgtgccaaactccccctttcaccaagatttaaagcaagttttaattttcaataagtgcaaatttctctccccctttgtcaatgatgccatcaagatcaaaagagacaaaaatgcaagataaaaatgagatgaaacttgcaaattttaggttttgagagctttgagagttatctaaaggcatcaaaaggtagacatggatcacacagatacaagcatgtgctcaagcctagctaagcatgtgcataagaagtatgaaacaagtcatgaatatcaagttagtatcgccagcaagcaaaaagctttcaagtgaattagtgatttagtgtgcaaagctatttctagaagaagcttaaaaggaagcaaaccagctcataatcatgcaagatttacataaacaaagcaatgaacccatgctaatgtgctaatgcccagttcataaagagtatcaacatgataacaaagcatagaacatgagcttttaatcttttctcatgacttttatttttatgattttttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaaacagagataaaacttgtaaagcatgattgatacaaagtatggacgcataagcatgagcattcataagcatgtactgacagttattgcgaaaagaatgtaaacatggcatgagtatgagaaggatacttcaatttaaacaaacttctagagcaagcattgcacattgattgagttcaaatgaatagttaatttaagcaggtttcaacacgcttgaacagcataacatgatcacacaagctacttaagcaaatgaaagctagacaagagatcaaactagcataagagtgatacatccatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacatgcactagcagcagctacgtactcagcctcagctgttgattgagcaacagaagactgcttacgagaggaccaagagaccaaagaagtgccaagaaaatgacaagtgccagaagtacttttgcgatcaatcttacacccagcaaaatcagcatctgaaaaagctcgaactgaaagggcagaagagcaggagtaccaaataccgtactcaagtgtagacttgatgtagcggaacatgcgcttgactgcttggcgatgtgatgttcttggagaagcctgaaacctcgcgcacaggcacacggagaagtggatgtccggccttgacgcagtcaggtagaggagggagccgatcatgcttctgtactcgcgctggtcaacttcttcaccgtcctcatcaggaccaagcgatgaagtagttgccatgggagtggcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttgg

SEQ ID NO: 48278 - DNA, 4313 bp, Oryza sativa
cttcacaagtctccacaattttgttcggttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagcagaaatagcttcagtccagaattttcttggagtcgtaaactcatcaagcatagttcgtgccatctccacaagggtgcggttcttcctctcaaccaccccattctgttgtgggacatatggcgaagaaaactggtgttcgactccagaagaatcacagaaagattcaaatgcagaatttttgaattcagagccattatcactgcgaatggctgaagagcaccaggaaactccaaagccaaactacgagcaagagactgaaagaagccaaatgtttcctcctttgattcaagaaaatagacccaagagtagcgagagaaatcatccacaacaaccaagacataccacttccccccaactgactggacccgagcaggaccaaccgtatccatgtgaagcagttgtcccggtccatctgtcataaccattgtaacaggcttgtgggaagaagatgtcattttcccatgacgacatggtgcacacacaagatctttcggaactttcaacttaggcaaaccccgaatcaaatccataccactaatgcgagacaagtggtcaaagccaatatgaccaagacgtcgatgccagaaaaacaaatccctattctctgaggcaatgagacaacgagaaggaccaggagcagaagagtcgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaatttgtcattgaccttgattgttcctttagccatcacgcgtccactgctcgcatccccaaaagtgatggtctcatcactggatgcacgagtgagagaagtaaaccacttggcttcaccggtcatgtggcgtgagcaaccggagtccacaagccaagaattacttctccctactccaaaatcctacaagaaagacacagcagatctcgatgattcagtactggggttagtgaaaaatgacttaggaatccagtactgaatcatgcgagaagtacaagcatctttagtgttatgagcagaattatatgcaagatgaccatgtctgttttgccccaaccctgctaggtcacgtcgagggtgcacatctcggcgaggaaagcgagatacaccacttgaacgacaatgatacgcacactcgaacctctcagggactctagtagctcttctagtcctaagacgttcttgtcgctcttttctagcctttctaaagcagaaacctaccaaatgaccagctttcccacaataggtgcactcatacttggttttctctacaggcttggtttgtctctggttttgcttgtgctcaacttgttttggatttttgggtctaggtaactctacaggcttagacttgctagtcataggtaccatctttggttctgaggttttgggtgtactagaactagtgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttgtaggtatgagttctctttcttagcagactcaagatcaactttcagagaaatgcatgaagaacaagaatcaatagatttgatagaatcaatgacagttttagcatcttttagttcagtttccaggatagcacaattagcacatgaagaatgaataggttccttagtagcaaaagattctaacaaatcattcttggtcctaagcatggcaacttgttgtcttaattcatcattgtcactagtgagaatgggacaattttcacacctaccaatcctatcatgaacaaatttttcttttagttctttcaattccatctcaagcaaacccatatcaactttcatttcatagcaagtagagcaagcagcactagcactagaaggattcccagctcctaaagcacatgatttcaacttatccttgaggagattaatttcagaaagatatgaagcacaagtagaacaggtatcctcctcaggaatcatggatcgaagcctagcaatttctagcgccattccatcattttcagattttagtttctcaattttatacttagaagacctatacttatcactaatttcaatcatcaagtgtgccattctttctttgcttagttcatcatcaacagagtcattatctgagcaagaatcatcacaaagagaaccatccaaggaagggatatcatcaagacatacctcaggatgctccgatgagtcatccttatcctcaagcgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatccttcttcccctttcgcccttgtccctcgggcttcttggtcgtcttgtcactcttcttcttcaacttgggacaattcactcttttgtggttaggctctccacactcaaaacacacaaatggttcattggtttttcctctttttctatctctcacatttttgtaagctcttgagaattttctagcaaaaagagcaagatcatcttcagggatcttctctaattgctcctcagtgactgagtgtaaagcggcaagagagaagccaccatacacaaaggctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaataatttctccaaaacgtttgaaataagaatcaatggactctcctgggtgcatctcaaatctttgatattctttatgaaattgattctgacgaaccaattgaatatcattgtttccctcatggaaattgcacagagcagtccacatgtcatgagcggacttgtggtgttgaacacgattaaattcaccagaagaaattccaccaatgattgcatttcttgcacgataattaaaatcaacctgagccatatttgcaggcgtgatgtcagcatcatcgggcacagtataaggagatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgataccaattgaaagaccaagaacagctatagaggggggggtgaatatagcaattcaaatcttgcccccgaaaatactcatcaagccggatttctcaaaatccttactagaatcgcggctattagagaagccggatctagaaaagaagagagaaaaagaagagaaaaggaattcccgaaactagaggaggaagagaaaaggaattcccgaaactagaagtgaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaa

SEQ ID NO: 48279 - DNA, 4142 bp, Oryza sativa
cggtacttgtcaatttcccatcacaaaagaactataaccacacatggtttcacaattggcgtgatggcactctttgcgagatttgttttcaatccagtggcctccccaaacagatccagcacagcctgaataaccaacgcttcctgagtcaccgggcggaagaagacactgaagtgctgggcaaaaatctcgcagcattgagaggagagagcaatcccgtcgtcctggcttgggtcatgatagcctcaggcgtatccataaccaacacaaaaagaaggggtgacagcgggtcaccttgcctcaaccccctcgccagcttcaccggatcagaagtgatcccattgatcagaatacttgtctcagccgttagaagcagagcagacaggcatcttctccaaccagcaccaaatcccctgaattctaacatctccaaaaggaaactccaggaaacggtgtcgaatgccttagatatatccagcttgagcaagatcatgtctttcttccttctgtgaaattgctgcgccaaacctttgacaaaaatgaagttttcatgaaggtttctccctctgatgaaagctgtttgcgtgtgtgggattagatcatccatctttagggccagcctcagagccagctagagctatgtcttatgtgtagctttagtaagcctccagatcggagaaacgcccatcagtcttccggctaacttcataaggagggctagtcggcttgggttcgaaatctcacatcttatatttatttgatattaggtcattttctaatatttgcgtttttaggtaattagcctccacgtcttcagtccagtctcagtgtaacatcaatgtcagtaacagttaggagcagtgaaacagattcgtcggtgaatgctccaaaacttcagaaagtacaataagcggttacacaccatattcgatcttttggcgagaggttcttcaggcttcatcagcttacagttacaggggacgtaataacgtaactgaagatcacttatgttttttgttttttttttcaaaaacataactgaacatcacgacctaagaatagcattatgttttctggaagaatggcgtgtgagaaggataaggtagaagaagcggtagcgcagaaaggccaagggcacgctaggattaaagggctcggagctgccgtttcgtcgccatctttagcgtaagtggcgagcttttcttgaggcaaaattaggtggcaagattagcagcctcagatcatcatcatcatcatcatcaattcagtgtttatttcgttgccgcgcatgagcgaaaagccggcataatatattgaggtgcaatctttttgcgcgttcacgaaaaagcgaaaagccggcaaattaagcccaaagcttagctagaaagagtagcttagcttggagcaggcacacatacgtgatgtagtgcgtgcttgcgtggtgacctttctctgcttatctcatttcctgccgcttttggttccatcgatcggcaggtggcgctggtgccatgcgctttacccaaaccttaacagcgccgtacctaatttttgcaatattggagatgaaatgaaaggaagattcagagtttcagacgattaatttatacataggtgtgactattattactctgttactccctccctgctaaaaataatccaaattcatttgtactaatttggactagaatgtatcacatccacccaaaatcttttacttcattcgtttcacaatataagtcattctagcatttctcacagtctagatttattaacatcaatattaatatgggaaatgctagaatgactactccatccgttttacaatgtaagacacatatatgtgtatagattcattaactctatataaatgtggataattttagaaagtcttacgttacgaaacggaggaaatggtataaacagcaaatcgatcgaagaagctctgcaagctctgtagcctgcagaaagaggagggatgggaaagggtggtggacgtctgtcgagaaggaaggtacaaaaagcaagagggagaaggacccggcgccatagcctctaaggggaatttcaaaggacttggatttctaaggattaatttctatgaaatccatttggttcgaagaaatctagatataggaaaacaaaaaaattctttcctacaagttataaaaagaaaacataaaaaaattcatccgctctgaccaattggaaaattcctatggattgaagttcgcatgcattcctattccttcacttctcctattcttatgtgttattttttaaaaaaaaatgaataggccctgagagatggagatcagaggagaggagaacagccaactcaggtggtttgaccaagggcaatatgccgtcagtgaataccaccttcaatactactttgaagttattttataccggtttaagaagtcgtcatagctgcgttcaagggatacaaattaaattcaacctatatggctgcgttcgttcaagtgacattgagtgagaaatcacatcgttttcctcgcgcacacgtcccaaactactaaacggtgtgttttttaaaaaaaatatagaaaagttgctttaaaaaaatcatattaatctatttttgaaatttataataatttatactcaattaatcatgcgctaatggctcaccccgttttacgtatctttccaatcttctcaatcctcttctcctcaaactcagtcttagggagtagcgttggactttttccttctccgatcgctctcgcggtgatgggctgactttagtgggccgcacggtgaagcacggcccaagaagtactgcccaggtcggcgagaggcgagagctcatgaaattcaactgcagttcatatcatacacaggcaatccccaggtgcagctccttctgctcgtacagacataatactataaacacgcaaacccttttagtaattatcttattatttcaagcacaaaaaacgacagcagactggtacagtatcggtaagactgtatatatcttagacgaaagcccaaagctgtgtcttgctatatcgcgtgcaaaaacgctgggacctgacctctcgttgcttcagaaggagaccttgatgccaagcaatgccatgagctgggagatgaactccgggtggccaggccatgccgcgccggtcacaaggttgccgtcggtgaagcagcggtcaatgggattgggctccagccatgtcgccccgccaagcaccacgttcagcttcaccgcaggatacgccgtgcatttccttccctgcatatcatattatcatccacaattagggagactggggagcatcgctgcgtgcatcaaacaggtttgtgtccatttgtgtgagattttcggaagcaattcagtgatcctgaataactacgctaagaaggatagtgacatactgatactgtaatagtacgtcttgttgcctaccttaccacactatgaaaatgcttttactttgcaggaatgatttaatcatttaattatccattaatcaagaatagatattgttgcattatttttgttttgttcaaggtaaattttcctatcgctaggtattgagttgcatgcaccgaccagttcaatccaaaagcttaagctgatgaggaaagacggacaattcactttatattccaacactaggtatagaagtaatcaagtaagtacgattaatgtagagcaatggtagaaaattaatcattatcatgtacctgaaggactccagcagcagataaaatctgttggccatggcaaattgaggcgactggctttgctttatccatgaagcccttcacaaggctaatgactttatcgttcagtgcaaggtactcaggagcccgtccaccaggaattacaagtgcatcatagcttgatgctccacattgtcaaatgatgctgtcaaagcaaaatcgtgaccaggcttctcgctgtatgtttggtcaccttcaaagtcatgtatggcagttgggcatttctccccagcacccttgtcagggcaaactgcatcaacatggcaaccaagggcttgaagagactgaaatggtaccataacctcataatcttccatgtaatcctgttataagcatgtagttaagcaaagaggctcagcagagatggtatgacttatgaaaaa

SEQ ID NO: 48280 - DNA, 3519 bp, Oryza sativa
tagcaccagcagcaaccaaaactggtttaacagcaggatatgcggtgcatttacggttctggactactccagctgctgccaaaatcaactgtccatggcaaactgatgcaataggtttcttcgcatcagagaatttccttactaaatcaagaaccttttcatccatggcgagatactctggtgcacggcctccaggaattaccaagccatcatattcattgatattaacctcatcaaacgaagcattaagtgcgaaattgtggccccttgactcagcatatgtctgcatgatgaatcaaaatgaatctaatttaatttgtcaaagcaaacttatgttagaaagacgaaaagtaccaccatactatcacacctaaaagaaccaacaatacagacgatccttataatcgagtgcttcagagaaaacaaagattccattactaaagggagtagtagtccagtagacaaagaggacccccaaattagttttgaaagaagcaacaccatctaaagagaagcaggaactaatgcaataatatgggaaacagacaaggatatgaatttataagaaatctctacagcaacagttaacccccaaatcatgaaccaatcaacagttcacttaagtgacgaaagaaataagaatggctgtctaagtatattcagtatccaaaatgttcaaatgatttttccattcaatcatgcagaagagctatcccattttgtagacagttaaggaatatttctgctcatgactgattattccgtcaaacttatctcgcaatgctaaaccagatatttggagaatagaaagaataacagataaagctaatggatcaatcataccaagaaatctgtcatttcattatgagctctcaaaaataaacctagttgcacatatgttttccctgtcccgttgtgtgactgtgtgtactctccttttctttcccccttctgccaattgcgatgagcagatgtgtattaatcctagaaattacatcctaaaattactcaaaggcaagaaagcgaagatattcctgaccactctagaatgggaatccgccatgttcaattcatcagaccaagccctaactagttatactaaaccctatccaaatcgagcggaatcgaatcattccaagtacctggtggccaatcccctgatggacggcggtgcggcacgagtcgccggccttcttgccggggcaggcagcatccacggacaccccgtacgcttgcagcgcttggaacggaaccatggcctgatccacaagattccaagaaaccccattggaatcgcgaggacacgaatcgaacacacaagacacggaacaagaggaagatttgcctcacctcgtagtcctccatgtagtctccgcagagcaggagcaccttcttgggagccatctccgatcacttcttgttcttgggttggtgagcttccctagtctagaagccgagagactgagagtagtacagtagtaatccagattttatatatgccactgaaggctcatcctcttcttgtcttcttcttctcatgatgcaaactgtttcattcttttgagaatttctttttcagtttttgcgatcgtgatttatcctatctttttttataatgaaattgttactggtattttttagtacttgctaaatgccgaaattcttaattaggagtaacatccaatgttgtttctttggggaaaaaccacaagccgattgtattttacagaaaacattgcatttcaggattactctctcaatcctctctctctctctctctctctctttttgaattttaatttgaattgtaatttttgatctaacggaagaaatacacatgcgccctaatacaattttgaagggcatttgatgatgtgcaacaatatatgcatttggttgttggtttccccgtccagaaaggtgtgcatttgttgctcttaagaaggccatagaatctcacgattgcgttcaatgatcatgcaggcagataatttagcatatagcagtacagtttgcaagggtatacatgtgagcttcccaggagacttaatatactgataatctcgtggtttgcgaggattgattttcagtcctgtgatgattcaatgcggaacattttggtcagaagcagagatccagtaggcgcggcacgatcacgagtatatttaaaagatactaattaagactagagaaaaaaataagctcgcgcgttacaacgggtgaaggttattttaatttagagtaaagtgcattggcagtccttaaactcgtaaggttatgttataaaggtctctaaaatctcaaaatacatatccaggtcccataacttgtcaaagtgtatcatctatgtcccaaattgatacatcccctctagaatcctacgtgacgctgatgtggcaatgccacatggacgtgacatgtctttttctctttttttttcttcttttatttttctttttcggtttcttcccattcttttttttctttttttctacacgggtcatagagaaaagagaataaatgggaaaaaagagaagaaaaaaagaaaaagaaaaaataatgccatgtcatgtctgtgtggcatgtcacatcaatgcctcgtagatttttgaaggggttatgacgatttgagacctagataacacattatgacaagttctaggatttggatatgtattttgagagttcagggacctagatgacacacccctacaagtttaaggaatgttcgtacacgttactctttaatttattgttgttatacgatttattagttaagatgatattcactctaggaattcgcggcttggatatatatttttctagaaaatcatgagttgcaattaggagtttgatcatctcaagttagcatgtgagatttttaaagagatatcttatatgactccttcgatatttttaaaagcaaacgaatttaaaacccgactgaacggatgtgtatttccaaaatcaaacaaacttaaaaaccgactcatacacggatgatatattaaagtactagcaaaaacattttcaattagtagagatagagatgatcgtgagttgagaatcacactccgttaacctgataaaatagttcgttatgattataagatgattatatttgaatgaagcagcaaaattttacagagtcccagacggccaaattagttgacctgataaaatagttccttccctcgttcagaggctgatgccatcttaagaatcttaggaaaactgaggaaccacatatgtacaatcacacattactctttcgtgaagaaaagaacccctccaaaatggggctgattatattacccatatcaggcaaaaaatttatcaaagaaatatcttgtctgttagttaggaaactaatacaatacaatagtttcaggatagatcagatatatgctgaacacaacgagtgcagcagtttttacacgtaaagcccttttaatttatgaatcctacccccgcttcatacctgacctatacttatcagttatcagccttataaataaa

SEQ ID NO: 48281 - DNA, 7403 bp, Oryza sativa
agatgtgccattggcccatgctgcctctcttttccgctgtaagatgacactaaggggctttgggccctcaaaatcaagcgatgcttcaggctcaacacttccattggccttactggagtccctcgagtttttgcgatgagggaagttgtgtgagtcaggcacatcctttgtcaaatgctggccatctgcattcctggaacctaaagcaagttcacttgatctccgctgggtctgctcttcatgttgtcctgcctccctatgcctggtaccctgaaattccgtgcgcctaactggagacagcctgtcccggagtcttcttctatctcgctctttctcggagcgagtatcaactctgtcaggagatcttccaggaagctttattctgccttgcagacgagagctaagagtgcttcctcgagagctctggtgatgatccctgtgtgaacggtgaccatgtgccctttccctgtagcgctcatccctccgccgttgctctccattgcgttctggactaattgccaatgaagactcatttattcttctcctacggagccgatgacgtaaatccgatccatccatctcgacacggtctctatctctttgcagaaaccttctttctgagtggaaaggccgttccatgctcctctcagatgatctacgccgttttctctcgtagccatcatacatatgtcccatctggtcttgctcatccataccattgaaccgctctctttcatgatgtgcacgaacatcaaaatcagctggagcatattcataatcttccactggatacatatctcctccaaaatcttcatcatgtaaataagcagcaccatctgcatcattgtccacgagaacatcaaaacctggtgaagattcacccaaaagttcatcagcctccctactgttctggggcagatcatctgcagggggcatttcataactttggttccaatctcgcacaggatcactatccattggaaaatggttctggtagcactcaggatgatccccacctgaagaagtagtgaagctttccttaagtgctgctggcgtactactttttaccttctctgacttaggacaagacattgcattggaagcaaccggtattgcaactgtagctgtcctggcagaattaaccgttgaccgatcaacggctgttttgcccctctcattagttattggagcaccatgctgaatggaattagtagactgcacagaatctttaatgcccaacaaatcattcttttgagtctgaagctgctccaaaggtaaggaagaaacttttaccacctgttctgatggattatttcccactgattgtggtccatgataaaatgcgcatctgtcacctttcaagcagtttccctttttaaagtaatagcatggaaccaactgctttccagagttaaatggagcgtagtgtgaagaaactgcaggcattccagtagttggagcaccaaacataccatcaattggctgggtaaaagtagaagacagaattagactccaaataacttcactggacaaaatgaccaaataatattaagcttaataactaggagcaaacaccctgttagtttctgatgaacagaaacataacagcaaatttactagtcttagacaatgctgcttgctggcaagtattgataaaaaaacataataccagtgcataaggggaaaaaggaaggaaagggacataccggatggcgaaacggacattttggattcaagcaattgctatttaaccagtaccagcagtctctagggttcatacgagcattatcactgtgacgaaaatcacattcgttcccctgatgtaaggaacaaaaagaatcattatcaattaaaatattcaagctagaagttagtaacaaatccatgatggacaaaatattcatggtaaataagacacaaaagcccataaggattaatgtagcatttttttagtgttacattaatgtttatatatagagaattgcacatatttgcattaatgtagcataattttgatagtattatcaaacaagattacaaagttacaacacatcagattgtgtgacagatttgatttatggcaagcgttttgcctctctctaatttaaccatagttcatcagaacagctccagaactaaatcagtacagcatcatacgtattccaaaataatagaggggctaaaagcaaatggaattctgagccgagcaaggattcccaaagagaaacaaaaaaattgtgaagcaatgatcttgaataactagactaataaggatactaacatattgttatagtgctcctggtgacaagggaagcattacaattcctaccttaccgtactactaaaagccatgtagccactgcaatagcgatatattgggaacaaatgcgatagtaaattacattgttttcacttttcacccgaaggagcatcaattcaggacaaccataccattcaaattttaaattatagagccgattcagaatttgacctagcatagaaaccctgaaaaattcaggggctaacaccaagaggcaacaaataccccgaacctgaaggcactacgaacttatattattacgttatctacattaagcatcacatcttggatgagggggaatagccatatgaaaagattccatcttgaaccaaagaaattcgtgtttacttagctcagaaatcaagattcccgaaacgaggtgcggaattcaaattctaagctccaatcgagaaaagacgaattaccaccccgccccaaaaaccaaaccagcttatatacgagggaaaagagacgacgaatcgtcgagagagaacgagcacacaccttcttgcatgtgaggggcgaggcgaggaagtagacgcagtcggtgttgcgccgcagcgcctcctcctctggcgccaggggcctcgcgccggcctccgtgctcgcctcccccgccgccgccgcagccgcggcaccgtccgcctccatggcccccgtctcgagaggagccgccgtcgggccctcctcctcctcctcctcctcccaaccccaccccgcacgaacgcggcggcgggaggacgccgatcgcgcgcgcgcgcgcctccggcggcggcggggagggaggtggggcgggctagggttcggcggtggcggcggattggatctacgtggaggggaggcgggttagggttgggcgcgacgggggaaggaggggttcgcgttgcgttgcgcccttcgcctctcttggctgcgcgtgtcgacttggggaaaaagggttgggttggtggacgccgcaggttttttttaaaaaaataaataaatagataaaataattgggaaaaggtcggtattataggcaacggcaacgggagggtttttctgtaaatccgatttgggttgcgcttgcgcctctctgtctatgcaataggttgaccgttgaatagcacagtgctactccggtttgagtacctctgtgatgtctttgactcactgctcggtgatgttagtgactttttccatctatttaactcaaaataattttttatttaattatttattcatcatatcaaagtttgtatagtaagacataaatacattgaaaatagataaaaacaacaataattatattaggatttaataaagtgggatattatactatttttatttttgttcgtacgtgcataatgagtgaaatataaatttattttgagaagaggggagtagtacaccactactagtagaacaactctattttacattttcctttttttctctctagggaatacgttttacatttgaattcacttgttcaattattggatttgttcatacggcctagctgtggttgcactacaaccaggcatctagcagcaagcagcagcttcctgcgccatgtgtttgtgcagccgaacggctaagctgtgcaacacagcttaaaacgctgtagcaaaagtctaccgaacaaatccgttaactcatcacaacacccttgtaaaagaatttattatctacacttctcaaacatcttttatggtagcccttgcctaatgtgatgttattgtctccaactataacagggccagcaatgacgtatccagaaaaaaatagcaggatgtctaagaaattagacaaaggaacagcagctccatttccatctatgtatggcaaaaaaaaaattgtagagattatgtgagttgtccataatcctcgcatcaatagtagaggctcgagccacatcactcttctgatagaattgccccaaagaactaggatttacaaaactagtgaaaaccggatggtgacaaaaactcgatttctcgggctggttcgaggacataaaccgcttagtttaacaatcaaattcaaaaaaagttcaaagtagatttttatttttttatataaaaattaatcagattttgtcgggatcaaaaagttttttaaacggctttggtgaaaaagaaattgctccctcttttttttctccttttttgatcgggaacagtttagtactatgtggtcaggaaaaataaggaggggggggcaatcggattgggattcggtgacattccccatgacattctcgtgtcacgggggaatatcacataatcccaatcgggggcaatccaggtttcctcgtcagaaaggaggtgcgaaaacaactgcgacagatcgtacattccaatcctttataacggcatacgccgccatggagcctgtgttggatcatggatcccatctcactccacgcgaaagctcccacaaattacagcttcctccaccaccagttgattccctcgccgtcgtcccggataagaaactcggcgcacacgacggtggcaggcggcgcaaggagaaaggcaaacacaaacgagcccacgcaaaacggtatttgctcactctgcctcaaatcttactctcttgccagttcgtcgatctatgtattctgtagagtgaaccatcgggaattctgttctttagatttggatattcaacaacagaaaatatcacaacagtatatgattagcattaataataaaagcaaaatattaggcactacagaaaaaacttcagattgacagctcctctcgaaactgacataaccggacaatcggtgaaaatccagatcctacaacacgaattgaaacaatcctcgtgcgcttcgattattgcagttttttttggttgaaagcatgtagaggaatctcaatacacataaatcctgatacaatatcaactaagtttaatgtctaggaagactcgatgaaacatgaaaacagtggactgccgtgcgagttacaaatcatctaggataagagttaaaccgatactgattcctaagtggaacctacaaaatatcaggtttcgtggttccggtggcctgcaccgaataggtaacagagagttctggaaacatgtacggcgtacatgcaagatacaaatttgggacttctgacgacgtgcattgtcgagagcaagagtgccaccatgcactgcagaatcctcctggaagccctgtgatagtataccaggacatgttagtatgcagagatgaatatgcataaaaagactctaaattaaatttgagtcgtcaattaagatgtgagttattccgagcaataaaaattagagcaaacagacattcttcaacccgcacaatgagaccattttacattcaataagggacaaaaaacacatgatgccaatatgtcaacaactatcgaagtacacaacatgataacagatttactcagaaaagaacatctctatccagtcataggtttttaaggattagtgtgggatttggtaatcgttacaataaatataattatgacatcttaccagaaatggcaccatgttctctcacttcaggacagataccgtggatcatttccttgctttcccatcttatgcacatcctcaggtgaaagtatcttgatgtaccatacactattcacaaaggacctacatcatatgaggaaggtcagtttcaagaagaatcatgtctgatgtttactctcacgaagggtcttgggtaactgagcatcaacatatagtgactgaccaacacatattattgaaggaagaacagtctagtaaaaaaatttaacatattaatacacattaaagatgtatgactgaatgcacatgaattctgtttgagatcacaattaggcaccgaacattgcaaaaatatactccatataacactagtacttttaaacatattcattagatactgtccatgagctgtcaacatgtctttcagtgaatgaagaagggatatccattcacattgtacatacctttcctcgataagctattagttgtggaaaccaggaaaccaaagtattgtactccctccgtttcataatgtaagactttttagcattgctcacattcatatagatgttaatgaatctagacacacatatatttctagattcattaacatctatatgaatgtgggcaatgctagaaagtcttacattatgaaacggaggaagtataagacagccacttttgcacttgctagtcaagccaaattttgttgatcttaggcacgtttaatatctttaaattatttagatatacaatgaagttacaatgcctgatgtagatttgaaatttttacttagcatgttaacttggccgttttgaggccaacatcaattaagagattcagtttgtagtgtgcacacatggacagggtatgccaagtgtagtactaaaatttaagcagatttttttgcaaccaaatcatagaacggtaagatgaaacttaaatttatattgcttactaaaacttgaatttgtagtgcgcatgcatggatattgattactaaaactaataaataaatcagaattctgagaatatttcttactcccaagggtcgtctccaaggagaagcacatcattctccctgtcgacgaatacaagctgccagcctgatctatcagggtcgtccaattgacccttaatgccgaacatctgacccagttcttctcgaagttcagcataattagagaaccgggttatgtccaacgacctcccaaccgaacctgacttgtaaacctgcaattttacaatggttccatgaaaagaagaatatatattttttggaggaaaaagaggagctcatatttgacctagcaacaatgcaaattatactagttaccttcacaaatgttctggttgctggatcgttctctcctgtattttgcaataaaccagaagagtcgtccaagcaaccatacattgcattctgcagataagttgatccagaagggatcgttgataagttgccatccgaaacattcgaagtcagattaggaaccatgttgtacaggagggatgaagagtcaacttgtggactaaaaagggactggttttgcacatcacgaccaattttgttttcaacag

SEQ ID NO: 48282 - DNA, 10807 bp, Oryza sativa
tgttgctgctgctgctgctgctcactagctacaggctgattaaatcgagataagtccacagctttcgaacttccctgaaggaagctcgaatccaacatgttatcactactgctagaggtgatgaagcttgaagaattcgcattaggatcagagaagccaaatttttctcgcaaatgactcggtaatgatgttggacttgggagaactgcacttgtaggaacttggtagctttgatctggttgaatcttctgcttctgatcattctgaacttgctgcatttgctgtagttgctggagttgctgttgtatagcacttgggctcaacatcgtttggatattttgggcatcaggattaattatctgttgctggcttgcttgctgcagaatttgttgctgcaataatgggttgaggttgcagtgttcttgaggggactgcataggttgctgaaggtgcaagaattgctgttttaagtaaccaccagattgggaagcagcagcagcagcaactactgcttggtactgatcgtgatcgctgctcagtaaggatggatggagcctctgttgtccccaggagccaataccaggtgactgaaagttcagagactgaaaacctccctcaccagcaactcctctcagccacattaaagcattgctgtcatcttaagtgtgatacagcagttaataaaagaacagaaatatgaatgagagatactagaaaatggaattatgtcaggcagatcaatgcattctccataacaagaatgcacagaaagacaatgaataaaaagaatgcatattatagaacgttacatttgctacggaagagccttatcaaataacattgatccaccttgggtgcttaagaaatggaaggaagagatcaacttttcacttacaccataacttgttttacttttagcctatatgagcattttataaagttccctgatcaatctctgtatccagaaccatcatttgaggcatattgttcacagtagagaacactgacttgaactatagcctcttgctcttgcaccacaatctcaacttcaggttattttagttagaatcatcagctggttgatgtggcaggttcagaaatttattaaggctgtggcttcagtaatttgagtgtgatggctaaaacactatgtaaatgcaccaaataaacttccacatgataggcgcacacacatagcaagcatacagcaaaatagcttcaaaactagtttatgcctgacacacagtaacaagaatcttaagcgtaccatgcagggaagcaactcctgaataccaaggatgcttaactctcagtgggaacagagatggatacattggaaaggttgtcaatggttcaatttcccataaagaaactcttggtggtctttcccctgcagttgattcatcccaaccaacctgaaaatatcacactagttagtggaactgtggaagcaagcactagtgcaataacatctgaaggcagttccatgattgttataatgaaaaccagaggtacagatcataagaaaatgcaactaaagaagatgaagataatcaggaaagacaacacaaatcacgtttaaacccccacagctctttagaacaacctcaagtaatataaaaattaccttcacagatctccaataggaactaggccaacggactgggtctgcatcactaacttcagttatagtccccatatacctgtgtttcattaaagtgtgcattgggcgcattagtatattatggatttttatagaggcccaattataaaattcccataaataatggggtgatgtcctgacagatgcgcagatttttcaagaacatcaacgcgtgaaagcataaaaagtacagataatggcaatttcagccactggcatagtcacatacatcctacaaacatgtataggatctcctggtgctaggtaaccaagtattatctaaaaaaagtaccatcatttatatatttggcctagattatagaataaggactgagcattgacatttgctaggtcacctgcgaacgcttgattcctcagtctcaaacaacatcctgaaccgcatcccaaccgatatccgggtgtgaaaaacagccttgatgtattttgacagtggtatgacaaattctgatggacttgccctacaaacactctttctattaacggtgtacatggggaggaaaaacaacaatgcatatatactaatttaaaagtccaacttaccgggggttgtagaaaatagtgaaacggctgtttgtagcagcagcatgagctgctgctgcaaggagacctatgtgcatgctatcgcttgaaagaacagaggaaggcatcacagtctgtggccgactggcacgtcttattccaagtaaaagctggtttttctcgttcctgagtcagagaatcaacaatgcgccctactcattagcacaggtaaaaaagaaaatcacaaatgcaagagagatggaaaacaaaccatatgaaaagcacagaatctccagcaacaagtctcttagcactgacaaaaacgctccagccagtggttagcaggtgtcgtttgggttggcctgtcaaaaacagcatattactacaaaagatagtaacatggcatgttcaaaaatataaaactactaaacacaattactaacaacatcattagtgttgagcagatcccatttcataatcaatacagcacaagtacctcaagcatatgtactatcaacatttatgttaagacaacatttttttagttattgtgatcaatacaaagtacattctgtgtcagaaaacacactaacaataagttcaaccctgcagaaagatgggaattcaaggcatacaaaaagaagcctacaccgagaattatactgtccagtacagtgattgctcattgtgcaattttgtaagacctgcgaactctagtaaatatttcagtacgcctctgaaagtatcatgtattcatatgtcaattgtaacttgatccactgctaactatcctaacatattaaaatttgatattttttatgtgcttatccaattaatgatctcgtaacttcatttctatgcataaccctaattcaatcaagtatctcttgctccattcacaccaactgatttttaagtgaaaaagacgcttacatcacattgtgtgagaatggttgaagtttttctcagaacacttgaaaacgtttttattaggaaggttttaagccatgattacaaagggtgaacttatcgaatggaaaaggggcagagatgattattaggaaattccctttaagaatatcataattcaccgttatgaagaattcaagactgccataagctctacagatttttaagaagttacctcgaaagatgtgcctgaacttccactcgatgtcatgaatatcccgtgcaattagctcctgggctggaggctgctgtgtgaaatcctacaaaccacactataccacctgttattggcaacagcaaaacccaaccacccaagaagtacaagaaaggagcacagccccaaattacaccactcatcacaccaaaggagggaagacgcgctcagcagcacggcggggcacggagaaccccccgtgcgtgctggtgtcgctcgccgtcaatgtcttgcagaagtaattcgtcggctgcttgctcattatccccatctccgcgggaaggtacgcatcgttctgctcctgctgcacgaatgaacacatccaaaaaaaccatcaaattaaccgcttagaatatttcacgccttcaaaccatcaaaacctcagcactgcaaacatcatgcaaaaaccccaggcgccttactgggttcagtggctggagcgtcatctgcgcgtacacctcgtcagtctccacatccgcctgcaaaaaaattgccagcccaagtcagcaccgacagccatggagataaaccggaggagtggagtggaggtgacgccgcatcgatctgagaaatgccccgagaaattagggcaaggaaccacgtacatgcattgtgacatcgtggagctggcagatcagctgcgccggcaggttggggtagttcgggatgtgaccctccacctccttgttcgtcgacgccgccaccttcacgtatgcaaagctcacccgcgtcagaaacaagagaaaccagcagagatagagagagagaagcaaagcaagcgcgcccacgagacggctgaggaggtgagctcagcctcacctgctcgctgtggccttgcgggaagtagacgacgcgcgtgccgacggtggggaggcagacgagcgggccggcgcaggcgtgccatagctccgagttgaggcacttcttctctgcagcagcagcagcagcagcagatcgagtcatcaaccaaacgagaagggaagtaaagcgaaccgcgaagcgaagcggcggaaacaaacctagccacccaccttcctcgggcggcgcggggggcggcggcggctgcggcggcccgatgctggccgccgacgacgagctcatctcctcctcctccgaccaaaccagagaagcacaaactcttaatctatcccctcacaaatccacccgaaaaccccatccccctcctcaaatcggccgcattctgcaccaccaccaccaacaccaacaccaacaacaagcatcaacaaaccacagagcaaagcaaagcaaaatcaatccaacccccaccccgccggcaagggaccaaccaacctttctcttccgctcacccgagctcggagatcgccaccatggtggggagaaagggtggggttggagagagagagagagagcgcaagaggggtggaaatgattaggtttgtggcatttaagcgagagagagagagagagagaaagagaggggttcgcgtggttcgagtagtgcgagtgcgtgtgtgcgtgtgcgcgacgagggggggcgcagcgcagggggccgtacagtagcgtgagctcccgcacagtgtctgaagagtttttaaaaagttgggaagcgagggggttttgaaaaagccgtattttatgggctcatgtaagcggctgtcgggtcggtgtaaccacggccgtaagagcaagtttaatagtataatagtatagttcactactagctttaattcatctataaccaatttaatagctaattcgtacaataattatttaatatattattaatatatggtctcacatattacatatattgtgtcttgaagttcgtgctgcagctggctacatatctatagcccgcgatcacttatcttattaaaatatgtttatatctggctaatagtctgctattatatatgctctaatggtgatgagagagatccatccaccatcccggcatatgcagctctccatcgcacgcagcgcagactggtgttcccgtggggcaccactgttgtatcactggagtactactaccgttccttgtaacctgtagcccgtgttggtttgtgaactcctccccgtctgtgttacagctagtactgctcctcctacgtgtttgtccagtcccgtcctccagattctaccggtatcatgaagtattgatttcattatttgggttaacaatatggtcttatggtgctaattttgttatatgttcccttcgtcctaaataaaatcaacttctatagtttaaattttgtcccataaaaaatcaacttctaccatcctacctaaccttggcacataaaacgaaaagttttctcccttaaaaaccctttacctacctttcaacattactatttttttcaataataaaagggtattttagtcatttttactcttcactagtctcaccttagcatgataggaatgggttttatgtgggacggagggagtactcctactacatagaatgttaatcgctcaacagaatatattcaaccaggtgtaggcaatattttatatacgtagagctccggtgaacagagaggggagcattaggtatcttgggacatactttctcgatgcgctgactatagtgcttacagtctgtctaataaaagccatggtaaaagtaggaacgggtccatcgagttagtacataaatatctcgagacattactttctatgttaataagagacatatattataggtataaaaaattatgtacttgatgcttctattttatgagttggaaatcacaattagtcaaaaataccataatcatgacaagactaatcaagtactatctttttttttccacttaaagagctgcctgcggattagcgactagtagtacttaattaactgggagccacttgtgatgcttatataatcagtccttgtatgcttgtcctcctacgtacacatatgtttgattacagctaaccttgcctccttaacccatgtcgtcgtcgtcatcatcatcatcatcatccacaccccaaacgggcaacctgtcctagagcctttgattccacgagtccggccggtttttaccatccccaacaacagcaacgtaacgtcccctacgtgacagcgcacaaacagggggtcattttttaaaaaaggaggaaagggatgggggtgtgtacgtacggagcaatcttgtcacatcaacccaaccctagtgtgcgcgacatgccggtcgtaccgtgacgtgaccaatccaaccgtgaaagaaaaagaaaaaaaaagaactcgagattttttaatttttttatttttttgctcttgtcgaccactgcatgccatgtccatggcgtcctcgtcctctttcgccgattaaaaaaagaagacgcgacatagacatggaaaacacgtttgactcgtactacatggatgacttgacgttacgtcgcaggaggggaaaaaaaatcttttaactcgtcgtaagaaaaaacacaagtggaatacagaaacacatttaaagtattaaatatatattatctaataacaaaataaattaaagattttgccagaaaactgtgagacaaatttattaagcctaatgaatccatatttagaaaatgtttaatgtaacaccacattatcaaatcatagcgcaattatgtttaaaagatttgtcttgcaatttacacgtaaaatatgtaattgattttttttcacgtttaatactcaatgcatatgttaaaacattctatgtgttgggtaaaaaccttttttttaaaaaaaaaaagaagaatggtactagtcgaccagtgtacgttgcatgcatttgcccctatctactgatcgagtgaatattttgcccgtagtttcgtactcgtgctgtgcatcggattagtgcataagtactttctaagaatttcggattggccctcttgatgatctctcgctttctccatagctgtacaagcctgttcgatcgctgtaccgatagtaacactgaaattgcttcgacgtgatcatagtcttcattgccaagactgtcgacatccctatatctgtagattgacgtcaatatatatggatgggagtcttaatttcttgatgttgttgtgctagctatagcttccaacgtctgcaaaaaagatgagtcatgttaattatggtggtaatgggggggtgtaaagtgtaaattaaccttccaaaggaaatgtgacctgaaaagttgatgacaagtgaggctcatgctttatatcctacttacctgggtccaaactggtaaagtttatggcatattcaggttaatcttttgtgttatgttaacccaaaaattaaaagagaaaagatcatctcagctgccaaacgagaggctccggagccatccgtacaaatgagcttttgaccgtgcgtatcaacttaaatgagcttgacaaggagtactagtatgaattgggtgcagcagttcagtgtactggtgctccggcctgcactacagtactcctatgtactgtatgtactgtacgcgagcaagttgggtttatttgttgagaatgataaagagtgggagtatatgcttttatttaccttgggtttattaggatagtagactttgtaccagctagctgctctattgatcaatactcctatgtttgttcccagaagtgcagatgaacagtaaattatcagcagaagttctactaattaagatatggaccagtctgtgtacactctatacagctatattttgttgtgtagccgtatttttcttattaaaaatttggaggatcaagactgagattagggacagaaggaagttgtttagatggaatctccctattttaatgagtaagtacagttgcaacaaatatcctaagacatggagcatggtagctggatttcatcagctagcaaacatatccagcgcctactatcagaggatgattttctgtttcccatcactggcctgcgtccacgattcctgtcgcgtggaccgagcttaaacggggaacatgggcttgaaaatgtggtttcctgtcacacttagccgaactaaactttagacaagcttgactatttgtgtctcgacgtgtttcacggttatagcatggcatgcatgtcgtgccatggtatacgtttgattagtcctctttactctttactatttgcgatagtactctttttaatcacagatagtatttgatgtttttgataaaatttaatcaaactctttcaacttttaactattaataatctcttaaatatttagttttaaaaaatgatgtgtagattcgtcttaaaaactaccaccacacaatattaagaaattataagaatttatacactataactaatataaaattaacaataaaagttaaattaaatcttgtcctgtaccccttttttttctttttgataggtcaaacatcaaatatttgtagccgaagacagattgaccatctcatgtcaaattttggtagatgagttaatataattaacatcagttttataacaccaaaatccgagtcacatgtctgctacatgcatatggctcactgagaacgtataataggagttttgtacaagactactgtagttattatttcaaaatccatatttttctacctctaatactaagggcttattcgtttctgagtttggtaagacacccatgaaaactcattaacatatgattaattaagtattaacaactatataaactaaaaaaataatttatttaaaatttaaaataaattctatatagaaatatttagaaaatatatcatttagcaagatgcatgtgaaacgtgccaaggaaattatcgtttaggttccagttgaatagcatgattgaaaaacaaagtaatagaaaaaacacgggattctaacatgaatgtaagtgtaaaataaagaaatgaaaaacatggaaaaaatataggaatgatcgtttgattaaaccacatgaaaaatgtatgaatcagataagagggatagactcaaagaattttttttaagtggttgaacctcctgctaacttttgttcaaaatctttataggattacttatttcataaaaattttaaagaataagatatgattaaatcatttgttacaaagattttcatacgatcgaaatcatccaaaaaaattattttttctgaacagatcaatggtatatgtagctaggtggcggtccatcaggtggaggcggtggacggcgtccaggaaggaacccggcgccggcgggcgggacagcgcaggaacagcaccacccccttctgaattttccacgctcaacagagccgggggagcagcgcgctggcccaccccgctgcgccaaaagctgcgggctcctcctcctctccaccctctcgctctctgccgacgaccaccgtacgtgcgcccctcctggccatcccctgcgctgcgccaagccaccagcttgcacccgttcaacttcaactcgccgcccatggctggccaccgcgcgctggcgtggctgatgaattcgcagcacgcacaggcacacagcagcggagcggcaagcctcttagctattgcttgactagactagctaccactcgcttctgttccttctgtacccgcgcgtgcaggggcatgactgacgacgagtcatgctcatctcgtcgcgtccgtctcctacagctacagccttattcctcccgttcgatcggttcgttccatgccgcactcgcgcgtgcgtgcgtgcatacgtgggcggcatgtgcgactggggcgcccgtgcacgtgtgcgatctgtttgcggtgcacatacccccgagcgtgtcctcacaaagctagggattcggatggccaatcatcagggtttctgtggaggatcgccttgaatttacctgtgcctttgtaaccggtggtaccacacgtactagtgctactactacttccggccacggcgttaactgttacatgcacgtgtctgctgcacggagcacatagtagcctcctgtttggttgtctacacggagtggcatcaaattcagtttgattatcttatgaagaaagcttgtagtaaccccacaattgatcgatcccgggtttctcaagtccaagccgatgcatgatagatcgagcaaatatatgccagtagataatgttttcgagcaaagggcgaagaaagttggcagcccaaagttgggcaggttcacagccacaaaagggagaagcacgatctggaaaaagctacccacaatgttgggcggcacactggatcagatcagcagtcggcccgtgtctccaagaaaaaaaattgaaaaaaaaaaagatcgatcgatcactactcatcgagagcccacgaggccccaccggccactcgcgcagtcgcaaacaccaacaccaacagatcacaaaatggtgatccatcgatgagatgagagggaaaagcttgtgtggttttttagtatggtccccgtattgttgaacccccccccccc

SEQ ID NO: 48283 - DNA, 27219 bp, Oryza sativa
  unsure (1)..(27219): unsure at all n locations
accccccccccccccggggcggtcgaggcaagttgccgtgcaccatcccccaactttagcggcaaaactctgaatgattcgtccataattcacccagcacacatcagtgagaagctatagcttagcctgctgctccaggaggcagcatagatctccgtctacgtcccgttttgctcttttgctcctggaggcagcagctgcaacattagtggtactgatcctagctactccagctagccatgcatcctccagaataataataatagtcaaaattctcctattgccacaacacatacggctgttggtctctttcttcttacaacctccgccccaaaatacccaaaatatgagttttagatttgacatactaggtattaaaaaagtaggtaaaactaaacgtgtaattgttgtgattggttaaaagagaaggtaggtggggatattaagaggtggaagtttgttattgggtgagaaaaaaaataagttgttatattttttagataaatgttgaagtctataagttactccctccgtcctaaaatataagaagttttagagttggacacaattattaataaagtagttagaagtgaatagtggagggttatgattggatgagtagtggaggtaggtgggaaaagtgaatgcactactggagaactcctcatatctcccggttcgcaaccccctttactcccgggtagcgaaccgggagggagaatccgggactaaagatgtcggtttttaatccctgttcaaataaccgggactaaagatgccaggccagcatcgatcgctacttttttttattgcctttaacattgaatattgatttcactccatccccaaatcaccccaaataaatcatcacagattacaaatccaaatcacataacaaaaattatctccaaatcctcaaatcgatcatctccaaatacaacacaaattctaaaaaattacatcacaagttctacaaaaatcatcacaaatacatcacatgaatacatcacacacaaatcaaatgcatctcagatctccaatcacaaattatatagaaaaaatcgctgacccgccgcctgccgccctcccggcctcctccgcgcgcgcgggccgccgcctccgctgtcgccagctcctcgccggctctatgagaaaagaggataaaactgtgagagagagagagaggggaggaggaggaggaataggaagataaggagaggataagagcgaggaggaagagtagatagaaatttttgaggatacgtgcaaagggattatatacggtatattgatttttactccaggttggttttaccaaccgaataccaatcgggattaaagatctctataaactttagttccggttaggaacaacaaccaggactaaagttaagatctaccaactaggactaaagatctttgaggacctgatagcctctgacacgaggtgaacctggattaaagatcacatagtccccttgcacaaataaacctggaccagagatcatttttagtcccggcttttcaagcaaccggggctattgtggaaatcggccgacccagcaaagatcacttctccagtagtgatggtggagggttgtgattggttgggaatggaatgttaacggatatgttattatattttgggacagatgaagtattataatttggaacagagggaataactcccagtcaccaaataacaatgtttccgctcgcgttgctctgatttaggagcagcgaaaacaataattcgagctatcccaggaatctcctgtggatcgccattactactcccaggaaggagtacgtctcaataacattgttggtgtactacctccattccatattactttttaagtttttgtttgtcaatgtttgatcattcgttttatttaaaaagttttaaaattattatttattttgtttgtcatttgctttattatcaaaagtactttacatatgacttatttttttatatttgtactaattttttaaataaaataaatggtcaaacgttacaaataaaaagtcaaaaacgtcatctattatgggacggagggagtagcttgcgttggtctgctagtactaggatctgcccaacagggaacgtaagcctagtttgctcggtgacgcaagccccagtagcctttgtattgattgtacaagtagtacaggagtatacggagtactcctatatactagcactacttctacagtagcagtattggtagtctaggagttagatcaatacaagtgattagtttgctactactcctagatgatatgacatgtaatagtccttcaaaggggaaaaaaatgcatgtttactggccacttttaagatgataaatttaaagtttagaacttaattttgaagtttcatgacttagctttaacatttggaccactaaaaagggtgtaaagtttttgcctaaatattactaccatatatgtttagctgttttggtcacatgtcttctattaaaaaaaattcgaggtcttgataatttaagtttgaaggggataattaatacttaccgagcatgcatgtatgcatccttgatcctactaggaatggctgaggacaacttttgtgcttgggagcttaagatgcaatgagccaataacatggcatccccatgaagaggcacgatcacgaattgtggatctacagcaatagcctcgctaaataattgctgcatacttgagaaccaacaccttatgcaatcccagaaagtgctcgtcacacaccacccaacaagcgagtcagccagcatccccaagggaaaggaaagggcaagttcagtggagatgtcccgttaacccgtccaaaaccacaactatctcgtagactcgatcgctttgcaaacctgatctgtgctcggggcatcttccgtttcctctccctcctggtgtccctttccttgccttcccgaacatgaacatgatttgataatgcagtggcattggttggcgtcggctcttcgtggttgatctagaaaaccaagaaaaaatgcgatgaaaaaacacctaaaaaatttaaaataaagtttgaaaatttaaaattttgctgcggtttataagccaataagcaacaaacgaatcaacgataacactttttatatctctctcgatttttccttctttcttttttcttcggttttgctatttcacttacgatagacttttaggtttttatatttcgtatgatgcacttacacttacacttaattactcctacatagcaattacgcttagttacagcacatttacactcagttaaaagtgcatcaaaactagaattttacaaatgtttttctcttaatttatggatttttttttccttttgggggtgtgtgttgaaccacatgcaccgcctactgcgtgcttgggcaggcacgccattgatcagtgtggttgtctttgagaaaaagaagaggggggatgggggaaaaccgaaaagaaaacgctctcaaatcgatcagtggtggctgatgggtcgatgccgtgcgtgcgtgcgtgcgtgcgtgcgtgcgtgcaactggagtatgtgtagtatggtggtggtgcggtgggggcggcgtggtgatcgatcggccaacttttggccaggtgcgcggcgcagtggggggaagcggcaccgcgggctgcaggcacacacaggctttggctgctgcgagtgtgagaccccaacatggcaacgcatcgcatgcatgggtgcatgggcctcctctcgcctgcgctgcgccactgcgcccactgctgctgcttggcttgcctgggggaggagaggacttgccttggcttcgccttggcttgagttttgggattagcgctacctccgtcatatcgtagatgtcgctttgactttttaattgtaacgtttgaccattcgtcttatttaaaaaattagtgtaaatataaaaaatgataaatcatacttagaatactttttataataaagtaagtcacaaataaaataaataataattttaaaatatttttaataagacaaatgatcaaaatttataaataaaaattcaaagcgacgagtatcatgagacggagtaagtagaaagcaaaagtagccacccaccaatccaccatcactataaacccgccctctgagatctgctccctcgtctgcaccgcaatgcagtccatccaatgacgcactgcgtttgcaacttgcaagtcgcaactacatgctggtccttgtagagagagaaggagagatggaaatggtggctaaagaacaaatcatttacctctcaaaaagaaagaacaaatcaatttttttttcatatcactactactatagtagaagtagtacaactctatacatggatgatggatcgtccaagctttggattccagggcaccgtcggatgtgccccgagcacatactatcagcggaccaaatgttgtaccaacgtgatcgaggtgtgggtcacccgctggcgtggcggcgatcggcttccgcttgccgcttgcgctgtgcgtgcgcgtagccgggccgaggggcaccaccaccattgttgcggtcgagagtccttggtggtaataatggtggccggagaggaccagagagagatgttgcactgcatcccctctggccccctgcatcgtgagatgacaatgcaatgccaatgccattgccgccaagtactactgctactgctgctgctgctgctgctgctgctgctaccggggtcccccacccagccagcctgcagcctgcccctgcttccgtgttgcattgccttctcctatgtggatgggagatgaaattattcccatggctccctttttccgatttactcgatatagagaaatttacttagggtgtgtttagttcacattaaaattagaagtttgggccgtgtttagtttctccctattctcaactttctatcacatcatatcacatcaaaaactttcctacatacataaacttctaactttttttttaaactcccaactttcttcaaacttttaacttttttcatgaactaaacacacccttggtttaaattggaacaatgtgacggaaaagttgaaagtttatgtgcgtaggaaagttttgatgtgatggaaaagttagaagtttgaagaaaaactttggatctaaacttggccttaggccttgtttagttgggaaaaaaatttaggtttgattgtcacattagatatacgaacacacatttgaagtattaaacgtagtctaataacaaaataaattacagaattcgtcagaaaactgcgagaagaatttattaagtctaattaatccatcactagcaaatgtttactgtagcactacattattaaatcatggcgcaattaggcttaatcgattcatctcgtaatttacacgtgaactgtgtaattgtttttttttctacatttagtacttaatgcatgtacctgaacattcgatgtgatgggtggaattttttttcttttgggaagtaaacagggccttacacgatcgactagctcgaagcctcgaaggcgaaaccccacgctgtcagtgtttagtgcgtgttattgcctctgtttggcttactgcacgctgtgttctggttgatttttatgaggtgcgaccaccaccatcttgtacaactaggagtttgtgtgtaaaccgatggattcagactacgtgggggcaagtacagtctgtacagattgcagaggtgaaaaagaggagagaggagcgagagtctgcactgcttaagttttatgggacaggagagaagagctttggctaaataggctccacagtgctggatcgagatctaataactttacaggcctaatccactccacgtaggtaaggatgcccgttgctaagattaagatttagcggtccaaccaagcacatatatatagttatcaaaaaaagcaaccatatatacgtacactacacaagtgaagaagtgtcgtgtgatactcgaaacagcagggcagcaggctacagcgagcagctgtagtcgtacgaccagcattggtcaggtgttgctgttgttgagcttatctgcatctgcttgtagttcccgttttttggcccaaccagtggaaaataccaagagaagagaatgcgaataggcttattttgggccgagccgctcgcgtgagaataggccgaaaggccgccagccagccacgcgggctttgccgttcggattcgtccggctctatctcctctccccctctttacgccgcctacgccgagggcttgcctttgcctgtgatgtgctcgggttcaacttgagggagcgaggccggaagaaaccattaaccatggagccgcgcgcgcgacgggcggcctcgccggctaatcccctgcacgcgccgtcgattcacgggtggtggttgatctggtacgctgtaccacgccgttctctgctccttccgtgtttttcctctgcactgtagaacggtcgacaattttgtgcatgagcaaaggagaggcctatccagaataggtcatagctttttttaaaaaaagaaaaaaaaaggcttgggtactacaagttcccttctaaacttctactcgcttcaaaaatattttttttaaaaaaaaacctataggaaaattgtttcaaaaatcaaattaatccatttttcaaatttattttagctataatacttatttattcctgttctaataagtatcctgttttacctacacgaaaaagagttcccaacctaaatctttcgaacaaatatgagagaacagcatgcaacgtggaagaaatcacccctgccaaagcactgcagtgccagtactgaatgctggcaaggtcaaaccatcagccaaatgaagacaatggagctactacaagatcataaaagataaaaccatacagcaatttaccagtataggctgaatgaattccagaacaatgtaactggccataccatctgtatctgactctgatatggcggtgctcgcattctgcagcgctgcataagaccttgatttctcatattttacatgcagtgagaaggatcagatgtgaaaaatggaaaatggacatataagatagcactagctggagcaaatcactgaaaacaaatgccccacaaaagttcattcataccatagcagtagctgaaattacagaacatacaataaatctgtagaaaagccggttatgtaactgctagggtgttatcctgagggtttaaacctacaatgcattttttacattgtggtgatcttgcaaccaccttatgaagaaaggaaagaggatgatatgaactattacttgaagggtggcatgagaaggaaattgaactcttggcatttcacgctatgtaaatattatttacagaactaatcatcttaagaaactatcaggatggatcttgatcgatcaaactgaaaccatttaagaacttgactgaaccttaaccttcagcgatatggtcaagccattcgactagctgctgcgatgttggtcttgacttaggagcagcagtcacacaaagcagtgctatctccaggattctgatcaactggctttcattctccttgtcatatatggttggatcaaatacttcagtttccctgtcttccttcttcatctgaagcacccaggacactacatctctgctcccttttggcctgcacatgtccacaggccgccgcccagtgagtagctccagaagaacaattccaaagctgtacacatcacccttgtaagtagccacaggtgactgcccatattcaggtggaatgtagcccaaggttcccactacatctgttgtgacatgcgtctcgtatgcgcatatgagccttgccaacccgaaatcagccaaatgagcttcaaagttctcatccaagaggatattgcttgacttgatatctcggtgcaatatatggggctcacacgacaggtgcaagtatgccagcccccttgccgatccctgtgcaatccgtagcctcttctgccaatccagcagggcaccaccatcagccctctcatgaagccagtaatccaagctgccattctccatgtatgcatagatcagtagtctgtcattgcctatcttgcaatagccttctagcagaacaaggttgtcatgctgggcacgtgatagtgtttccacttcagcttgaaactcccgctcaatctgagagtaatcgcctgaaagccgcttgattgcaactctcctcccatctggtagtgttgacttgtaaacaagtccaaaaccaccacaaccaactatataggcttgatcaaagttgttggttgacttcaatatatcttcaataccaagatccttgttgttctggaaaagcagcaccaagcttgagttcggagactctgagcagtcatcagcattcgctactgcctttggattatgctcctgcattcttgaatgaataatccttgatataaccacagaagcaatacacaagacaaaaataacccccactgcagtaccaagtccaagggccacaagggttgctttgttcttcttacgatgtggtgcttccgtatcaggagaattctttgtgctggaggaattccgaggaaagtgtagtgcgtgattgcctgcaaaatcctcactagtgaacgtggagaattggcctcctgccgggatatctccagacaaattgttgtacgaaacatcaaacttggacagaaagttcagcttcgttagagatgatggtatgctcccactgagatcattgtgggctaaatccaatatttccaagctcgacatatttgataactcatcaggaattggcccagaaaaattgttaaagctcaagtccagcacatgaagcttcactagacggccaaaggctggcaatattggcccaacaagcttgttatttgagaggatcagtgatgacgggaagctactgagttggttgtactgcaagcctttaccagtggaagtcgaattcttcttgacgaataatgggaggtctcctgttgacgcctgcccacttgagccattacttgaaattaaactcttcatctgtgtaaaggttgcaggaagctccccactgaatgagttgttggacagatcgatgtagaaaagactgtcgaggttgcctaaccatggcgggatctccccatgcaaattgttccatgaaatatccagcacactgaggctcttcaagctctgcagccaaggtggaaccgtgcccaagagtgcacagttcgccaggacaagaacctgcattctcttgaacccttcgatgccgtccattggcatggtttcaccaccacggaagttattggtgagcaccaagctagttaagttgggcaggtgctgcaagacttgcaatgctgatgacaagttggtaaaaccattccccgtaagagaaaggtatgacagtgatgtcaaattcttgaagctctccggtagctccccctgaagcttgttccttgcaaggttcagcgtcctcaactcagtgcacgaggcaaggcgaggcggtatagcaccacgcagcttgttggtcccagcatcaaagttgttcagcctcgtgagcaatctgcagtcaatggtaatctcaccggacagcgaattgttcctcaggctgaccactctaagcatcgggcagctcgacagggatagaggcaatgtgccattcaattggttggaagccaagtttaaggactccaagctcctcaatttcccaaacacatcagggatattgccattgaacatgttatatgacaagtcaatctgcgtaatctcagtgaggttaccgaggtcgtcgtcgaggctgccggagagcttattctcctgcaaacttagttttctcagcgctggcatcatgtacagatctttggggaggctcccagtaaggccattgccatcaaggaagaggtcgttgagcagcttgcactgaccaaagccggccggcacatcaccagagaaggcattcgccgagaaccgcaggaccttgaccggcgaagcgcagagcgcggtgacgttgatgccgccggagaaggcgttgccggtgatatcaagaaccgtcaggttcggcgcgccggggaacgcggggtgcggcccggtgaacccgttggaggagacgttcaccacctcgatcgccgggaagccgcccgccgggaacgcgccggcgaggccgttcgcgctgaggtcgaggcgccgcaggctcggcagccggccgagccgcgccaccgcctcgccgccgcgaagcgagttccgggagaggctccggttggagagatccagcgccaccaccctcccgagatcacaggacacgcccgccacgagcagcaggcggcgtcgccggggccccacccgaccatcccggcggccttcgtgtccaggccatcggagaaggccaggagcgccgccaggtcggtggggtcgcacgtctggctctcggagcggccgccatggacgtggagcagaacggacaccaccaagaaatggaagaagcagtagtaacctctcatctccgccgtcgacggaatcagaaaatgaaccccttcttcctgcagggcatgaacaacttcaagaatccaggaaaacaactcacaccaccttgcaacgaggcagcatgaatctaatcaccaagaacgaacacgctcgcaagagtcaagactcctcctctgggcaagaaatccaggagcgcaagaacgggaaattccctctcattccgtccgccacatgagctggatcgcaagattgtgaggcgccgaaagaggaggatggcatcacaggaggaagaagaagaagaggaggagagtgggggaaagtcagaggagagaaagagacggttggttttgactccaatgcggctctcatcagcagccgttcttcttcctcccaacctcttcaccagatttgtttattcattcatcgcaaacttaaaaaaaatcaatttcctctctctctctctctaaagctttctcgtgtcctcttttctctcactcgcagactcgctcactggtaggccgcaccagtgctagttgcgcatttgatatggtgacgcaaagcaaaggcgggggaaatttaataagcggcgcgtattttagtggagaaaatgggtgaggaaaataaatgccgggtacttcgtgggctgcttggactttgaagagagatagactgagggggtgttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttacatcgaaacgtttcaacaccagtataaaatattaaatataggttaaaaaataactagttgtataaaatacgactaatttatgagacgaatattttaagtctacttgcttcatgtcaacacccgtataaaatattaaatataggttaaaaaataactagttgtacagaatgcgactaatttacgagacgaatattttaagtctacttgtttcatgttttgacaattttactaatgatggattaattatgtttaataaatttatctcatggtttactgacgaattatgtaattggttttctttgtagtgtatgaactccccatataacaccttatataataccttatatgacacgttaaactttacaccttgatctaaacaccctctcttgggccgtgtttagatccaaacttccaactttttccatcacgttaatctatcatacataactttttagtcacatcgtatcaattttaatccaaactagtaactttggaagtacctaaacacactcttgaagaataagagaaagagaaaggggcaggtcagagtcaagtcgatggcgactgcaacgggtggagcaattggtggacgggttactgttaccactaagctacgagtaacgacgggtctgcgctgcaacatcaatgcgtggatggatggatccgatgctgctgctggtggtggtagaactgtggagacagtagaggattatttttccccgatcatttcacacatattaatacatagtaataaaaagactacaatatatgtattttggcctggtttagttcccaattatttcttcaaactttcaatttttccattacatcaaaactttcttacaaacacaaactttcaacttttccgtcacatcgttccaatttcaatcaaatttctaattttgacgtgaactcaacacactctttatcaaattatattgtaactattctttatttatctattttcaatgtaattattctctgttttcatagactccaatgtaataactatttaaaaataaacttatttttggataaatgggagaaaaatgaatttactatgaagcgatgaactaagtggtagtaactgttcacttgctcagtattaatatgagcttttgcttacgctgggagaaccaagaacagtggagtataatgtccatcttttttttttaagaaaatgtcatgatacaaattcctgtgttttaaagaagaccaccattgttgttggaaaatatgcaattttttatgtagttgctgaaaatgttcactacatgtatgcacaaaatttactgtggttttagacctggtttgatgctaaattttgccacacttccgatcagtttttcttcttttgggggaatcgtatttttttttttggattgacaattgtgctagttcttttcattttcttcactggataattttttcctaatgctgtatgtttggactacatgttctaagctactccttccgttccaaaatattactaaaagtttttgttggatgagatatatcctgatactatgaatctcgacaagtaatatgtccaaattcgtagtgctagtatgtgtccaatccaaccaaaactttttatattttatgatggagggaatattccatatactaagtatatttttaaaatatttaatttatcactatgacgaataaggccatgtttagattccaacttttttttcaaacttccaacttttccgtcatatcaaaattttctacatataaactttcaacttttccgtcacatcgaactttcctacacacaaattttcaactttagagtcacatcgttctaatctcttcatacttccaattttggtgtgaaactaaacacaatctaacctgtttcacgctgtcttagttaatggctgccagattaatcctacattgacgaattgatgagatactagtactacgttaaacgctatggtcatttgcagaatactcctactactctatcctaaaaagaatccaatcctagtaatgaatctgaacacatatgtgtctaggttcgctgctagtattggttttttttttatggaggggtacacttctagtacccctggtacgtactgctgctcctcttttggttttgatatggacctttgcatgcatcactgaattctcttttccatccgctgaattttgtctgcgtgtaggtaatgctcgtctttatgaatgtgcagaattttaggtgaatggctggctagttcagctgcttgggacatccaagagtaaagcatccaaaggcaaagtcagagctgtgtccagcgaaaaaaaaaagattaaaagacgggtcgtgaaattgaaaagatgagaaggaatgaaatggcaaaaggaaagtaaagcgggaaggtccaagctaggcagtgttaggctcagggttttccaaaccaccgaaaccgggattaagcacggttaccgcgcggtaaccgtataaaaccgtgtaaaatttatcaaaaatttaaattattttttaaatttatttaaatttaaggaggttaccatgatatttctattaccgtacctcgcggtaagggcggttaccaacggtaatgtaaacgctggttaggcctaccaattaccttgctggcgatgcaaagattttactccagctggtactccaggtaacaacgctagataggagtatcaaagttgtagattctggtacagtacgcgaaaaattgtcctgaaaacatatgctactccactattcaacttgttgtaacgtggaaacaaaaacagcaacagcctattcaggttgtgtgtttgtcgtgttgttgtggacgataagcggaggacaaattatcatctgcatttggctagctagctgtccgtgcaacaaacgaactgtagacctaaccgatgctgctaggtgatcactctgtcagtcacggagacagacttggttgttactctaccggttgttggattttctcaaccatctttgtggcaacagttcgttgataatcatttttttttcctttggagaaaaaaaaaaggggaaaaaacgcattcctactttggtcaagcacgctcgtctacttggcgcatgggcttaaacgccttcgctgtggtgaacagttggacgtacgcatggcgcgagacgccgtggcgtggcgtgcgcgtgccgacgcgtggagggcgttttccgcgtgcgaacgaaacgctcgctcgtgcgccgcggccgccgcgccgcgcgccgaggcgaggcgagcgagcagccggcgcgcgtcgcgcgtcgcgggcgcgtatgctacgtatgttcagttcgacgcgcgcgttgcgcgcgcgcacgccacctcgtcggtttctttccgcgccaccgctcgcagctcgcctcggtggaggggtggatctcggggcctatatttgttctctgactcccatattcgtcctcggattcctcctctcgagtcctatattcgtcctctaggattccatattcatcttctagggtttcatattcgttctctggaatcccatattcattttctagggtttcatactcctcctctcgagtcctatattcatcttctagggttttacatgagtcagctcaacccatagggctcggttgtttgagctcatttcttaacgactctgctcggttcgttagcgctaacaagctataaaagattaggttggtttggaagctactcttttttttcacattataaattattttacatcttttgatcaattttttttaagtttgatcaagtttataaaaaatatactaatattttcaattcaaaagaaacatattatcaatatatttaatattaactttaataaaactaatttggtattatacatgttactattttttttataaatttgatgaaacataaagaatattgactatgaaaaagtcaaataacttataatataaaacagagagagtagctagataaattcgttaggctatcgagctatacctctaagtatatatgaagactatgagttcaaatcaatccgaatcacgagcttttaagtttttttttgtccacacctacctcggtggctggcttggctttgctttttccgcctatattctttgctccgccctgcaagcaaagcggcttctcaaattgcccatgcatccgtttccactggaccttctcctacgcaaattgctcatgcatctgtttccactagaccgggcacgttttcgcgacccgtttttggaccgattctctcgtccgttattttcagcgaatttctctagaaacggcgactgcgattcgggccgtcctatttttactcggtctgaaactaagaaacacatgcatggacgacgttgctagctaatactaatatttagtattacacggtttgacactatatattcacaacaaattaagacgactgtatatgaaagcgattaaattagtgaggactcagggtcgacccggttcttcatttctttgcatcttattcaccagaatattgaaacggattgtttgctcatatttcaaatattatgttttctttaaaaacttccctttagcttagaccatttattttaactatctattaaatttatttcttaaaatatttaatatatttaatttatcactataatcgagtagatatataattcgtagcaataatttacctaataatctaatcaaacagctagctatagggaggatcaatggtgagcatgcatttttggtttttcttcctcttcttattttttttagagaaaatccttcctcttcttttttaaaaagagagcaaagcattagaatttggccaagtggctatatatgaaagagcagtagagtcctcaatgcggttggcaaggtagctttgttcacacttttggaaagttatatttggggcccttgatatcttgagtgtagcccagaaaaggccatcgtttctgtttgactcttaccttggttcgttaaaaaaaaagcttgtgtggcatttttcaaagccaattagatggcaatttgaccattaaactttgttatcgctttgtgccaaagtatactaactagtgtctcaatattagtagtaaccaattgtgtagcgagtcacaagtgacacctcaaattaaagttgtgtcctactagtagctatagcagccaacatcctatatgctgtgcttgctgtgtaagcaaacatctatgcccctttttctatgaacaactgaactgaactgcagtctgaacatatatgctactatgcctcaaatgctgaaacattgaagaattgaagcaaagccatgcttactgctcaagttatacataggtaatcaagctaggtgtttcttacaccgaggtgaatattaataacacgttgacgcagcttaacatccgcggcgtccgtgacggccacgtcggggacacatgatcatgacattttctgcaattttgacccagaaaatctgcagaattcagccaaaagcaagagcctactggttgctgggaacgagacgtgtgtttaacgtttatgcatctgatactagaatatggagtatagatcatatagactgaacaagtacagagaactttgcattctccaattgcagaaaagagagatatatgtgcattgctgcattgcttccatggcaagcatgtttccttcagctttccacgaaaggttaattactgcactatctagctactagtattagtataatcaatcgcagttagctatctctaagctcactggatggtgtgttaaaaatggcagcttggtgctgctgctgcgttgacgtcgccaagtcaatatctcgaacgtggtgtaaccgttgtgctagctccgataatactatactacattactaatataatcgactagctttgcctgggatcacggttcagaaagttcagaaatgcagaatcacatgcagttgattaatttaattaattaaccttcttcttctactactaccccaatagtatcgattcgaagaacaacctggctgtcgatttgcatgcagatcgtgtcctgttcccatatggtgatgacagtgagaaaagggctgggatcatacagtggtcagtggagttgctagatcatgtcagaccagaactgcatgccaagaagatagtgcaagcgttgatcctgaaaaagaaaccgaatagattatccaagttttggtcgacacacatgaccaccaactcctcacctagtcaccttgttctgcccccacacaatacaagtcaacttcccaacttgttttgttgatgagcaggaatccaattattatggcatgatatattgcaaatcaatataggatggaaaaggctattacatttttcgattttccttaatttgtcaagaacaaataaagaggcaagattaactaaggacgaggcttgcaaggaattcatcagttcagagtgtaacagtggcagaagagatcgattaattaaatcccctaaatcatgcccttgattacggtaagaaattaattcatatgggtggatcgatcacgtacgcactaagccagtctatgcagagaaacatgccaatgcatgctagctgaattaagctttgcattgcatgtgagtatgtgacgccaaggcaggcactttgagctagctagatgagacattagctgctaattaataacttattaaaactaagtagaactggttacagctaatatttaagctcagttctcacccattaacaattagggtaggttgatccgttaggtgcaaacccacaaaattgtcaaaaccaaaacaagattcgattcatacaaaacttaggtttctatatgcccataggactctaaccaagaaaacaggacgacaaaaaaatcagataactttgacttcagcgccagttagttaaacctgcatttttcatacatggaatctttaatttactccatatatatatatatatgcataatactacatcattaatttctgttgcttgcagtatcatacagttgaaagcgtctttttttctctttttgaaaaaaaggttcattttacttccaaactatttctgttgaacacttaacccctaagcaatttttttcagcttattttacaccctaaattatttaaagcggttcaacttgctttctaataatatttatttttttaatgaatggactggaacggccaatacatgaatgatatgtgataattattcgagaatataaataaataaattaactgttatgaaactgaaaggtggatttaaaacatataagtataaaagaacatatattaaaagttcttttaaaaaaggggaatttgcaaatttgccaccggttttttcaatattacaaggatgccactcgaatgatagttctagtggcatttttgcaattttctagtgacagtcttgcaataatgatttaaagtagtggtaaatttgcaattgcccctttaaaaaaataacataccatttagaagctcagaaaaagcatgctgccatttgcattctcctattacgaacaggttataaataatctagaagcaagaagagcttgaagtaaacgctacattgaaacgtttacatctgaaagcgagatgaatttaagtttagatctgcaagacggcagcaagttcagtcaacacatgccggcggcgcacgtggacagtcgtcgcacgctgcatgcgatggatggttaatttgctcgtcatttcgatcgccagccacactgccgctggagctaacgtagccacgtacgtacgcatcaagattaggagaataatctctcggacaaacggaagcttacgcgaaaattttgaccaaaacttgtttgtctgatctgcatatgcacttggcagctggtcagtggcagcagtcgtagtcggcgatctaacgatgttgtggtctccagcgagtcttaattagggggaaaaaatgatgagatcaccagatcgatcagacagctgctgcttaatcgttcattaaaataccagtcattgtcgaacaagtacaggttttagtattgcaaatttagctggattttgaacttgatgttgagagggaaagaagaaaatttgattaataaggtctgagtttatttcaaggaaggtatatatgagaatcgtacgttggaccggctgtacgttgaaggcttgaaacgcgttgagccgctcacctatatgtccgtacctaagctctcttctgtcaaaacattatctaagaaatttgttaattataggtttggagaaagaataatgtttatgcaatttatgattgatggtccttaatactctctatgatctctcttttagcgtttgagtgtgtgtttggctgtgtgcattttagtgatgccgagtttgggagtgctctcggtgtaattggatcacctcgatgtatacttgactgagataagtgaagcttctattattataataaaacatatttgtttttttaaagggatgtatttctttaaagaaaaaagaaaacaagaaggagtagaccactcgacagtcctatccagttccaggtttttatgttttttgatgggtagtaagaaagacctcgaccaaattcagttaaaaaaaaaaaggtcacgaagcctagcctctcgacatgcagaatccgctctaactcgtgctttgagctccctgtctcatatatgatgttgttcaccataggtcatttcttaacacaagttttttttttatcaatggacatggagtgatattttttaaaccaactccgtgcaaatttaactgcatttaactacctctaatttaaatcgcatgaaatttagaaactaaatatattacttaggtgaaaaattaaagccgtccattttttgaacttatcaaattcaaggtggaatcatgtattacattaggttcatctctcaatttaaagcatgtttgggaagaaacatatttcacaaattgcacagttaagggcctagctagcagcagggctccttcagaacatatacaaaaatttcaggatttttacacgaattacttcaattttcataaaaggaatctctaaaatttctccattccaaaggaagcctaatattgcgcggaatatatgacgaatctaccctcctaatttgttgattcgagaccgaatctcacaagggaaaagaaggaaaccagagtgattttagatatgggtccatgaaaaaaaaagaactggatggatatatatagctaggagcatgaatgagatgggcctctgcatttggcgtactagctattagctgcaggtggtggtggtggttaagtgtcagcctttcaactttttcgcaaagctaagcatgcatgcctgccttggtgtggtgcctagtagcacagtaccagtgatgatcctgttcgatgaacacgagaaaccggccggccatggcgactgttttcgcgtcaatgatcatcattaggatcgcttaatcgccagggattaattttgacgtgcatgcccaggcgaccaccactgctaatgcaagcataggttaccacttgtgtgttgattccaaattgtgccatttccacttctagtgccgtgcatttattcatgcctgcatttcactttcacttcacgtgggttccttgattcgttgctaattttctttaatttgccacaggcaagtgtttctttttttttactgtttagtgatttgctatatgttcaaactgtaattaagccgctggtcaatgttttacagttgcagctgttcaaggtttgaaataatgatgcaaaccaattccagctgaaaattatgcgtgttctttcaagcttcagaagttcagattctgggtgctgggccatcgatcaaaatcaaccgtacgtttccaagaaagttttagttggaccatccaaaggttcttgttcttgttttgactttggactagaaatgccggggagaaaatggagtatgtgattctgttcctccacttgcacagcatttctacttctttctgaaagaacacagcatttctactttgttggagtgcagaccacgacatggttctcctgatagcatcgttctcctttttttttcttttttggggcttatcacaaaagaatctatagtgcacattgtgactgctcaattcatcacaaagtatttctgttggttattatgatagacattttccagaaaaaaatctttaatcaatgctgatcaatcatgacagactgacagtatagttttgagttttcatctggtgctcctcttgtttcatttttttatgcttattttatccattcatcttccacaaagcttttatccagggaagaccaaattgcagggtgacatacactgacatgaggcgacaccactagcatcatcagtggaggttaatgctatctgaactgggactcagatgtctgatgaatctttacaccccgattagtggaggttaatggtgcaggcatcctagttaacaaaaaaagtctactacgatcgagtaatcatatcattctttgacaggcaggtcagtgtgcctactaattaagcaagggagacatcacctcaaagtgccacgattgccaggcagcgaaaggaggaaagactcatcaaagtgccatgtgtgtgtgctgcttggcactcaaatggcctaaaggctagactggcctttccagtgcaagccatcatgatccgacgtggcaagcagcacgagatggtatataatggctacatgctaaatgctcaagccttttgtccattccatttgttgctaggctcgactagccttttgctcaatcgaatcatttctcaaactactaggcttttatatgattaaattctggatgggtatgtatagactatagagaatgccctccgctaaaactgtgaaaaatagtacttgggccgaaatttagatggaaatcctgcccatagtctacatagagaatagactggatcccaggcaaaaacagcccaacacaagcctatctatcaatctatgccaaccaagcttgcatattggcatctcaaaactactatctagcactacccatatattccaggaacactaaatgtacactagagtaaacgaaagattaaatttgacatgggaactaggcaggtatgtatagctaactggaaaaccggcaacacaacccatatggacaccgaagcaacacaacccatacggacaccgaggcaacacaacccatacggacaccgaagataccagccatgacaaagtttactgccagggatgtgcaacgattcacgttcaagtcgacaaggtgacaggtaacctacaacaaacgaatccatccaaccggtttacaccacctataagttaaacggaccgacccatggaccatggtacgacggtaaacgctttttgggcaggacggtgtataacattcacatcacatgtacagcactagagaacggcccagcaaaaagcaaagagcgatcagcacaaggggctgcaacatctacctgcccttctctcgaagagttgatagggcgacgatggtatcagctgcccgagcgacattgctgctgctagcatcgtctggcccagacgattgactgtgcactccactctgtaaatgctggccttttgactccttaggtactgcagtcaccaaggaagcatgagagttagcaaaaaaacaagtgatgttaccaacaatgttgttccatggcaagagtttccaagcaccgtactgggtgtgggagcattataccccttggtgactgcattaggtgcttgagagtgctggctttctgagaccatgcctgctattggagatgcatcgtccttaggctccttacttgatgctggagggtcatggacattcggtgcaatactcagagatagagaaccacgggcctcagtggccaaagctttaggatttccatgccctgcacgttaatgaaagcattgattatctacattttgtacacaagaataacccttgaagtgctacagatgatctgcagttggaagagggtaaacctggtgcatgtactggacgtgcggcacctgatgtcccatcatggcctttacctgaattaagaactgggctttgttgtgatgaaatactcaatgaaagaaactccttgtctttaggtgtcactcttggtgcagaattgagaccttctgcacctgcacatttggaatttcccaatgccaaactaggaacaaaagattcaccgccctttggcctgataccgggaggtgtcactcttggtgcagaattgagaccttctgcacctgcacatttggaattccccagtgccaaactaggagcaatagattcaccgccctttggcctgatacccggaggagtcactcttggtgcagaattgataccttctgcacctgcacatttggaatttcccaatgccaaactaggagcaatagattcaccgccctttggcctgatacccagtggagtcactcttggtgcagaattgataccttctgctcctgcacatttggaatttcccaatgccaaaccatgaacaagagattcaccgccctttggcctaatacccggaggtgtcgctcttggtgcagaattgagaccttctacacctgcatatttggaatttcctaatgccaaactaggaacaagagattcaccaccctttggcctgatacccggagcaaaaatcccacaacttttagaggcattatttggttctgtagaagcacgacctgaaggtcctgtgcttggtctaacagaattgcaaacttgcgctgcgagagatgctgattttccagatggcatccttaaaaggccattatgagctacaggtgccactcttgataccaatggatcttgccttttggcacaatcagtagcaatgtttcctgataaaacggtttgtataggagaatccctcactttgggttccacacttggagaagccccatgtacggggccgacagaagtagaagtttccggcacaccttttggtgccagagaatcatagcccttggaaatcatgcctgttgcaggagtatcacatcctttggtgcaaagactggtgctgttttcagctactgcatttggggcatgagaatcaccatgcgcaacactaacaattaatgaacaattcccagtttgatccaaagacctgtcttctgcagctgtcctcgcaggatcagaagatgctattttgccagcagatttataccataatgatggctgcaacagaagccaaggacacaatggcatcagaagaaaggtgcagttaatcacaccagtacagatgcagcaacagctatgtgaaatatgagtacagataaactggtacagtaaaaataagaggatgcctgaaacaagtgaggaaaatttccaaataatttatccaaacatgaattcaaaaggcctgtgcctgttttaggcatgtttggctgctttgagagttccctatatttttttcaaggccttgctagtttcctagcccctaccaattttcttattactcgtttaaaaaatttagcagatatttctttatttgacaaatatgtgtgatttgataaacaatgtgataataaaccatcttataaaaattgcaacacctgaacaaaaacttcctaaaattgtgcctgttgtcgtatgcaaacttgtccataatgtattaaaagtatatgagcattaaaagtatccttagtatggatgtgaactgagaaaacaagcatatgtcaccagaaattgtttcgaaggataacagcaggggacagccgacttacacagtaatgaagcctcttcaaggtttccaaaagcaacttctctccaactaatattatcatttgctttaccatctcctcacgagttattttgttttcctgtcaaataaacaattaaaacattttagtacccatcacaccaaccaaccacacagccaatgctaataaataaacacagtgtaacttgttggttagttagtaccttcagctcttcataatgatggaagagcaattcccttgctaccgatgatatattttcttgaatcatggcaaaaagaactctgaaggatatccaaggggaagttggtccctcagcatttccactcattatctgcataaaaatgtacaacaaagccaagatcatttgtcatttaaagaagggaggaacaatctgtagtgaaattggattgctctcagatcagacttctattctaccactgttagcagtacatgcacatctagctggaaaaccagagtgtcaatggaaaagaagaaacgaagaaaactaggttgcctcacaggtacaagagtagaaatatccaccgcaacttcctttggtgatgggtgaaaccataaacccttcaaaccaagtaaataatctgaaaacaagtgaaccaaaaaatatatcactccacctatatcaacaaaacatgataaaaacctttaactattatttatcatcttacttcgaactttcgaggaaagcctgaaactaacaagatattctaaacgaatatgggtgctaagatgagatggccacatgacgtagcactttggatttgagcaatcatcaacaccagaatcatatatgtcactgcttggaaaagaatcttgtgatccaggcatgacagcctccatgttccccaaaatcaaccggcagagcaacatatattgcactcctttttcgtcaacatcacaaagaccaacactgtcaagcaagatataatgtaaatacataaacaattaaaatggaatggtcaatacatttttttaagtttataaaaagtacctggaaaatgctcggtcttctggtgaaagataaacaccagcactcaagcctgccttctcagcaggttttccattgttaccaaaaccattaattaggatcctaactatgtcattcttcctagatcccagccatccataccttacatttgcatcaccacgttcttccttggtggacatcatttgtttttcaaaagcttgaagtctacactgtgcagtgatatcattcggagagtagcggtggatgtgcagtatattatttggcgttgcaaatggacccatgccagagaggaaaaggtcctgcgcaaaaagaaagccttcactgcctcgttccacagatgcgatctttttgcgtaatatgtctgcagtggcaggcttctgtggaactggaggactagattcaaggacaacttgcttcaccacttctggtggagaatttgcaaccttatccaacattattccctgtgtggcgccctcaaaatcaccgcctactttagccacttcatcagcttcctcatcaaagaatagagaaggataaaagcacttcccagtgtcatcaaaccatgccacagaccgctgctttctagattttaggttgaccagggtcatcgacaagaaatcaacaagaacaggctcatcgtccatcacagcaacaacactagatttattgcttctaaattcttcaatgagagacttcattatctgctcaggaaaattgtgccaagaaccctgtttgtaaaacataacacggctgggcactccactttttaggtaattgacacaatcactggcaaggttaggtcgagtgcaacagcatttgcagcgcttggcagatgaatcagatgatggtcccttctcagttttgatgcgacgagacttgcactcttttgacaggcagtcatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48284 - DNA, 34582 bp, Oryza sativa
  unsure (1)..(34582): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccatccaactcgcaaattgtgccaacaaaacaactcctgcggtcctgcctggtttatgttaagatggaaaagaagagtgaaaaggtacagctgaaattactgaacctccaaccataacttgtacaagctgtaagtaatcaggtctaagggtgtgtttgagaaggaggggattgaagagatacgtaaaacgaggtgagccattaacacatgattaattgagtattaattattttaaacttcaaaaatggattaatatgattatttaaagcaactttcatatagaaattttttgcaaaaaaacacatcgtttagtagttcgggaagcatgcacgcggaaaacaaaactatctttctctctttctcctgcgcttgaacgcagcctaagtgatgaaaaggaacaaaagggggactacatctctttgaaataaaacaacaacaatctatttgccgaaaactatcaactttatttgtaataacacactcgtccatatccatggacaaacgtttgtgctgaacttccattattcagctcataaactaagaagcccggaagctggtggaaggcttagccaagtggtgaaaaaaaacatcgatcttgcagagtgcacacacttttcatgatccaaagtactaaaagcacaaataactggccaattctgctttgtaataggcacagataatcgcttatggtaaacagatgaaaacttttgtctcctcaatcagaaaggtcgtgtagatggttggcattatcagtcccgatcaaacgattgtacatgcacaatcacttgcccgatgctttcaaactggcgtcttcccttcaggattgcctttgcacaattaagggcacgtcgctcacacgaagctctcttgctggcatcctcaatcgactcaaaatcctcaacatgagcaattccaacaattctcctacatatgtatggtccaatttagtaaacagaagtcgcttgaggatcatgcacaaggcatcggatacagataaaaaatttgaaaatggtgtttaaatgtgattttaagttctttacacttagcttctcacaacataatatcctgaattgcctcaattcaaccatttatgacggttttcagtcatactttatgcttgtcaaaggtggtcttctggaacatctcttttaggacaccacatactgacatacatttatgaaaaagaagtgctgcatcaaaattgacatcggaaacctctacttttggcctaaattagcgtgcctttgagttccttacagttaaaaagggcaggtctagtatatcttcatagtctagacgtaaataagattcaacaaattaacttagtagtatagactatataattgtactgtttaatattagagtatatggtagttagagtcatattaggatatgattgatttatgtggattttttccatatctgtaatccttccttatctcatgtatctatatactggcccctgaggctctaataccatgttaaatataatacttccttatctctaccctatttatttcctatatatgcgggctcctaaggctcaatagaatgtgtccaatattcgcagtaatctcctcttcctatactattcaacatttatttacctgatcatttttgctgaaccaaatccaagactgtcatgaaataggcttgtcatgtacttcttctgtgcaaggcacaaaagctctgagctgttgtatatagggggcaggtatgcttccccattcccatctttgtgtttattccataattcgacaaacttcttgtggaacaaattccatgaatcttcaattgtcttcaagatccatttcttgtaagcctgaaaaatatgtacagtcatataacttattttatgccccgtgatacatcatgaaaataccttctaaaatctagatgctgccattgcactttgccatataacttgtcatttctgcagttcccattactcagggacattcaagtgatgagtaaggcaagttattcaacttattgtctgccgagcaccctcctccctctgttacatacggcatatctcaacaatatcaattgctaattattctataggatacaagtacacaggaagacatgtggttgccattatcttagcaaacgcaaaacaacttaaccacccaaaaagaaaaactatctttttgtcacataaaaaaaaaagaggacatttgtggaccaggtaaaagtacacactttcatttactattattagccaataaatccatacataccttacgatcatttgcttgatcagcgtgtccatcttgtgaaaaatatgccaaaatcaagttccccaggaaggccccaatgtcgtaacccattgggccatagaaagcaaattctggatcaatcacttgagtagaatctggtgtcaccatgatggaaccagtgtggagatctccatgaagaagagcctgtgctctctcaataaacctgcatatgcaaatcatgtccatcatctccaatatgaaaagaaaagaaaagcgctggtttaatctggaaagatagttacattgatttcaattcagcaatctccaatttaagctcagcatcctctcgaaccgctgcagcatcattatctaggaagggtgatgtgcaacgattgtatttggcgagcatgtatgggtctgagaacacgacttgctctgtgagcctacacatctccacattatcgcagtactgagcaactgcagttcacagaacacaaacattccatcaatttggttatcatttttctcccttttcatagtcacagaacacaacattctatcaatttggttctcatttttctcccttttcacaggcaaaccaaacctgtataataaatcaaccaacctcctttcttgtgatcagtggtggagttgtagagaagggaggtgaagaagagcgtcttggccatgtaatccgccatgtgctcggcgagcagcgggtactcgacgccagcgatgaggcccttgcggaggatgatgtgcggcggctcgatgtagcgcatcccgatcagcgacatggcccggtcgaagtggtagacctcggggacatggtccgggcagaggccgcggtgcttctgcagcgcggaggcctcgaagtaggcgcgctccctcgtcatcggccacgaatcccccacgcagcggatgtacggcagcgcctggattgcagcgtcgtcagcggaggaacggagagagaagatgcgtacatgtgtggcggcggcggcgcgtggaggagatagggacctgcttgatgacgacggagccggcgtcggagaggacgatgtagacgaagttgaggttgccgtcgccgacctccttgatggtgagggcgtcgaggctgccgccgaggcgcgcggcgagggcgggcgtggccttgatgtaggccaccagggacgcctcgtcgagcgggcggaagccctgctgctgctgctgctgctgctgctccgccgccgcggccatggccggtgcgtgtgtggccgtggcgtcgagttgaccgatgcgagcgccggcggcgaagtggccgcgacccgcgagaggagtggggaatcgagtgcgcgtgtgtgggaggctgcgctgcgcggaggtgtgtgggttttgtaacagctgctgctttcgcggaagggggcggttctctgaacctggacttgttattggtacaaggcggattcttcagttgagtcgtgtcatcagtgtgagctaatcttgaggagttcatgctatctttgagttttcaatccaggccgtgtttagattcaaaattttttaaattttttttaactttttcatcacatcaaatatttagacacatatatagaggattaaatatgatgaaaaaaaacaattgcacagtttgtatgtaaatcgcgagacgaatcttttgagcctaattacaccatgatttgacaatgggatgctacagtaaatatttgctaataacggattaattaggcttaataaatttgtctcgcagtttacaggcggaatctgtaatttgttttgttattagtctacgtttaatacttcaaatatgtgtctgtatccttaaaaaaattggcacacaaactaaacacatcctagtatactgctaattttgaactgaatgtggcttctggtcattggatttggtgaattttcctctctgttccaaaatataccatcatttatgttatctctatattaccactccatctgtttcatattgtaaaaattttctacaattgaccattgttaatgaatctagacataacatccatataaatatgggtaatgctagaaaattttataatatgaaacggagaaagtattaaagttgagtcatcctccgttcatctccttctcccaccgctcgtgcagtctatttgtccgctccttctcaaatcatgtacacaacctccgtatgatacggtactttatcctcaattaccttcctagccctttcttactcgtctcaattgtatgttcgatctgttataatgcatgaatatatgttgctaataaatctgaataagtgtttgttcacttatagcagtattttaggacggatgaaataaataaaattgttttctcgaaaaaataaaaaaaaactaatgaatctttcactcatgcttcaggctaccaatggtggtgtgccttcggttgaagttggaattttctagcaaatcaaccataatcgaaatgttctcatatagatatatagaaacatgccatgcctacataatttttctgaaaaaaacagctctaagataaggaccatatattcatttgatagaatgaaacggttactatgttcgtttgtgtgtttattagaaaaagaaatttattgtgatattttagaggattacaattcacaattattgtgtcccttcaatgaactctgcgagttgataaggtagcatccgaacgattaatcagttggtacgcatgttccacgctgttcttttcaacaaacagggagaatatatcgactgtgtttggccccatacttcggcttgatgtcgccgtcaatgctagcatcatgtatcttcaaaatgacatcatatccaaataaaagcagcatgaaagtgccagtcctccatattaaacggcatgaaactagctcacaagacaaaaatcattatagtattctcatgaccaagcgaaccatagtgagaaagttgacaaactctattatattcaccggatgaactagaatgttcaaagtatagataggtcttttggagaacttctagcatgtacagtttcttccaaaatctccaattccctaaataatcatattatgagattttatagctatagaatccagaaaaaaatgtgtaaagtacacgggcggtccttaaacttatagcggtgtgtcatctaggtcattaaactctcaaaatgcatatccaagtcacagaacttgtcatagtgtgtcatctaggtcccagatcaccacaaatccttcaggatcctacgtggtgcggatgtggcatgtcacacgaacatgatgtggcataattttgactgacaaataggacccatttaaaaattttatttctttcttttttttcttctcttgcattttcctttcttctcctttgtctgtgacccgagcaaaagagaggggaaaaaaacaagaataagaagaaaacagaaaagaaaaagaaaagaagaaaaaaaaggacatgtcacgtccatgtggcaggtcacatcagcgccacgtaggatccaagaggggatgtgtcgatttgggacctagatgatacactttgataagttctagggcctggatatgcattttgagagtttgggggatctagatgacataccgctacaagtttaagtaccgctcgtacactttactcgaaaaaaaatctacgaggaagctaaggaaaacctactttgtagattaaattctgagaaatggaaatctagttgtgagagcataaaaaagcagggaaaaccagttttttagcttttattaagattcttttgaatctagataaaaagttaaattgtttggggaagcttttgccattcaaccgactgattcttacaaacttagccaagtggtgaaaaaaaaacatcaatcttgcagagcgtccacacttgagcatgcataatgtatagtagaactagtccataaagaatacaatatttcattcagccacctaacaacattgtagaactagtccatatcaagcaaatagcaaaagtcacccataaacatatgagttgcctatatagaataaaatatattatttatctctgctttctctctccttctaatactactaactacctatatatattacatccttcgtttcacaatgtaagtcattctagcatttcccacattcatattgatgtccatgaatctagatagatatatatgtttagattcattgacatcaatatgaatgtggaaaatgntagaatgacttacattgtgaaacggagggagtatgaaggttacaataggtaaatcccacatatgtgggtccatctgtatggactactttggctatatacattgttgttgcccagcccacatataaccggccaatttgctttataataggcacagataatcgctgatggtaaacagatgaaaacttttgtctcctcaatcagaaaggttgtgtagatggttagccttatcagtcccgatcaaacgattgtacatgcacaatcacttgctcgatgctttcaaactggcgtcttcccttcaggattgcctttgcacaattaagggcacgtcgctcacacgaagctctcttgctggcatcctcaatcgactcaaaatcctcaacatgagcaattccaacaattctcctacatatgtatggtccaatttagtaaacagaagtcgcgtgaggatcatgcacaaggcatcggaacacagataaaaaatttgaaaatggcgtttaaatgtgattttaagttctttacacttagcttctcacaacataatatcctgaatagcctccaatttaaccatttatgacggttttcagtcatacttataatcgtcaaaggtggtcttctggaacatctcttttaggatagcacatactgatatacatttatgaaaaagaagtgctgcatcaaaattggcatcggaaacctctactttggactaacttactgtgcctttgagcttcttacatttaaaaagggcaggtctagtatatcttcatagtctagacgtaaataagattcagcaaattgacttagtagtacagactctacataattgtactgtttaattacctgatcatttttgctgaaccaaatccaagactgtcatgaaataggcttgtcatgtacttcttctgtacaaggctcaaaagctctgagctgttgtatatagggggcaggtatgcttccccattcccatctttgtgtttattccataattcgacaaacttcttgtggaaaaaattccatgaatcttcaattgtcttcaagatccatttcttgtaagcctgcaaaatatgtacagacatagaacttattttatgcctggcgaaacatcatgaaaataccttctagaatctagatgttgcaattgcactttgccatatcataacttgtcatttctgcagttcccattaagtactccctccatttcatattataagtcgtttgacttttttcttagtcaaagttctttaggtttgaccagatttatagaaaaaaattagcaacatttacaacagcaaattagtttaattaaatttaacatagaatatattttgataatatgtttgttttgtattgaaaatgttattctatttttctacagatttggttaaacttaaaaaaaattgactaagaaaaaaatcaaacaacttataatatgaaacggagggagtaatactcagggacattcatcgtctgctgagcaccctcctccctctgttacatacggcatatatcaacaatatcaattgctagttattctataggatacaagtatcatgttccaaacttctatcctatcgaaattagtacacaggaagacatgtggttgccattatcttagcaaacgcaaaacaacttaaccacccaggtaagattacgcactttcatttactattattagccaataaatccatacacaccttacgatcatttgcttgatcagcatgtccatcttgtgaaaaatatgccaaaatcaagttccccaggaaggccccaatatcgtaacccattgggccatagaaagcaaattctggatcaatcacttgagtagaatctggtgtcaccatgatggaactagtgtggagatctccatgaagaaaagcttgtgctctctcaataaacctgcatatgcaaatcatgtccatcatctccaatgaaaaggaaagagaaacgctggtttaatcaggagagctagttacattgattttaattcagcaatctccaacttaagctcagcatcctctcgaaccgctgcagcatcattatcaaggaagggtgatgtgcagcgattgtatttggcgaccctgtatggatctgagaatacaacttgttctgtgagcctgctcatctccacattatcgcaatactgagcaactgcaattcacataacacaacatgccatcaattcggttctcatttttctcccttctcaattttcacaggcaaaccaaacctgtaataaatcaaccaacctcctttcttgtgatcagtggtggagttgtagagaagtgaagtgaagaagagcgtcttggccatgtaatccgccatgtgctcggcgagcagcgggtactcgacgccggcgacgaggcccttgcggaggatgatgtgcggcggctcgatgtagcgcatcccgatgagcgacatggcacggtcgaagtggtagacctcggggacatggtccgggcagagggcgcggtgcttctgcagcgcggaggcctcgaaataggcgcgctccctcgacatcggccatgaatcccccactaagcggatgtacggcagcgcctggattgcagcgtcgtcagcgaaagaacggagacagaagatgcgtactacatgtgtggcagcggcgacggtggcggcgcgtggaggagatagggacctgcttgatgacgagggagccggcgtcggagaggacgatgtagacgaagttgaggttgccgtcgccgacctccttgatggtgagggcgtcgaggcggccgccgaggcgcgcggcgagggcgggcgtggccttgatgtaggccaccagggacgcctcgtcgagcgggcggaagccctgctgctgctgctccgccgccgccgcggccatggccggtgcgtgtgtgggcgtcgagttgacttgaccgatgcgagcgccggcggcgaagcggggaatcgggtgagcgtgtgtgttggaagtggctgctgctcgggtgggatttgtaacagctgccgtttccgcggaagggggcggttctctgaacctggacttgtttttggtacaaggccaggattcttcagttgagtcatgtcatcatcgtgtgagctaatcttgaggagttcaggctatttttgagttttgaatatattgcttcaaatcttgaactgaatgcggcttctagctattggatttggtgcttttcgtgccataccttctccattttaaaatgtaatagcatttctgatataattttggataagtgtttgttcacttaaagtatgatgagataagagttaaaaagatcagaaaaattaaaaattaaaaattggatcacttcaggctagctgccaatggcggtgtactggcgtaccgtcagttggagttggaattttctaggatatccaccagactcaatatggtgtactgaacaaaatgttcttctatagataaaagacgatatttggattccaaacacatttttaaaaaaaattgtaagcgcgttagatattgaacacggggtctcaaaattgaaatcacacattccattctataagtgcatcttgttcttctatatatagatacatgccatgactatatagttttgctgaaaaaacaggtctcaggtaaggaccgtatattcatttaatatgaaacggttactgttcaggttcgtttgtgtgtttattataaaaatagaaatttactgtgatattttagaggatcacaattattgtctcccttccacgaactatgtgagttggtatgggctgtgtttggatccaaacttcaatcattttccatcacatccacctccacctgttatacacacgtaacttttcagtcacatcatcttcaatttcagccaaaatccaaactttgcgctgaactaaacacagccaaggtagcatcggaccgattactcggttggcgttggaacgggtactcatgttccacgctgttgttttcaacaaataggaagaatatgtccatgtttggacccataattcggcttgatttaaacatgtcgtcgtcaaatgctagcatccactaatctgttggtttggatacttgttttcttcgaaatgacatcgtatctaaacaaagcagcatgaaagtgccagtcctccaaattgaacggcatgaaactagtagcttgcatgaccaaacgtatttatggccatgatatatttaagagaaaaaaatcattctaaacagtatatatttactgaatgtactagaaggtccaagcacataattactccatcaattttaaaatataaggattgttacaataaataatttatttttttcacttcagttgttagcatttgaatttcgaattacttgtatttcttttgggaaattttgtaaaaatacactcgttatgatcaaaattacacaaaactacaaggattttgacacatagcacatgacccataggtactatggatataaagttccacaaaaccacattgtaaccaatttgacatactcatatatcaaatttttaaaaggccatggatgtaacatttatatgatggataaataactcataaattcgagatgcgattgtataacttaaaattatggtaattcaaagttagaatgataaatattgtgttttttgaaatgaccataatacatatgtttatgtgctaaaaaatcgtatgtttttttaatttactcaatttgttctaaaatttagtactagataggacacatcatagtactataaatctcgacagaaattcgttgggtattatatgctctatgttcaaattcgtagtactataatgtatcccatctagttataggttattattatttgtgattaagaggtagatcataatacgggtggttaaatgaaatttacttattctctctttccaagcatttgattagctttaaaattattgaaatgatgggaatcacaaaaatcagtgaaaaataagaatattatggtgtaaaatttaaatcttaaaagtatagaaatggaaggagttattccaacaccatcgggcatcacttgcccgcaaaattgcaataactcaccataatatttcaaaataattcgacggaattcattcgctcgcgccgtctccgaaaccgaatccatttcctgatccagcaaaggacacagagagagatcccatctcgtcctcgtcgcctccgcctcgtgagctccactcacctaccccacttcctctcctcgcttcggccgcggccccaaaccctaaccctccccgcggcgatcccgatggccaccacctcccgccgatccctccacgccctcctcggcggcggcgcaggtacgcacgcgcattcccggcgctctccgatccgggtcgagaatttgggttcggttttctcctcactcgtgttctctcgtctcgcagtcgccgacttggtgctgtggcggcggaggaacgtgtccgcggcggccgtggcgggcgccacggcggtgtggttcctcttcgagcgcgcggggtacagcttcccgtcagtcatggccaacgccctgctcctcctcgtcgccatcctcttcttctgggccaagtccgcctcgctgctcaacaggtgggtttttgccctggctctacagcaccgcgtgtttctgatctcatgtagagtcgcgccgcgccctgcggccctgattcgctgtagttgtaactgcggtgttcactgtaatgtgtatgaggttttgctgaataatgtggactttcttttccccaaccgtttggttgttgcatctttttggcttcaagaagctcactgccaaactgtttcatacactaacttgcttagcatttttgaattacgggttgcagtaagaaactaaacttcaggccagagcagtttgtaattggaagtgatccgatgatctcctaagattagagattgttcaaaggtttgaactctgcatatgtcggggtttcctaattatcccttttcctgaaacctgcatatttcgtttttattacattaccaataatgcatctatccgatcccttatctacaaagtaaagaggctgctttactttaaagctaagccgcgatagcagttcgataagttaattctgctagcatgtgtcattttctctagagcttgtaactgtgctatatggtctcttctgcaagcaatccacaaggtttttttcctagatttacattacatggtcaatcaccgcgcttgccattccttatcggctcatttatgagtttgtgttccccatctgacttgattgttgcctagaattgatatgcatttatgcagtgtctctgcgattgtatcgctaaaccgaaaaagaaagagctgtttttggcactttggttgttttatgttgttctctgtgactggcattgtacttccattgcccatatcatctatccaagtttgacacaaagttgtgatttttgcaggcctcttccaccactccctaaactagaggtctcagatgtggttgttgagaaagctgcagatcgggctcttgtatggatcaacaaggtgttggctgttggccatgatattgccatcaagagagataggagtgtttttataaaggtctctctcttatacacacacatccatgcccactagtacacacacaactgtacgtctatatggctgtacctgcctttgtatgctttcttcttatgccccttattttgtttggtcatataggttatattgattttatgggtggtttcatacattggaatgctcttcaacttccttacgctcatttacattggtgagtactactgaatttgtttctctttaacttcctggacctattcatgtatggatcaatcgttcttttatgatagctcatatgtaataattgtatcattctggcttttctctaggtgtaatgttttctctgttagttccaccattgtatgagaagtaccaggaccaagtcgatgaaaagattggtatggcgcacagtgtactatcaaggcacttagataccatcattagcaagactggagaatcaaccaagcaaaagaagactgagtaaccggtgtttttgctacattgggtgagcttctaagacggtttgaatcttttttactagttcatggtatactctaaatccaacaaaccactaatagcttttgtgtttcacatatttagtatgctacacatttcgttaacatgatagcatggacaacatttttgtttaactcttgcaatctcaagtttacataatgttgcaatagttcaaaaaacctttaagatgctataacggcaatgccagtggatctttgttactcgaaaagtcccacaaaaacctaagggctaagggcagcaaagatgagataaattctcgttgaacaaatggatagagttacttctcaccgtattctgtatttctgttgtatttttctaaggcaaaaatggtctttcttagaaaggcgaggcagtgatgtcctccctttgttaataaaaagagaaaccaccagcccaggaatggcattcaaggcactctaaatacaaccaagtaatcactttcagaagtttgtttttctggagttgaactgttaccacacatgaaatttacaaatgttctgagaccatcttctgttgttcctgagaaatgatacttctctataatgatcatcttttgtcttatcaggaacctcttttgtcatatgtggttggtcatgaacctcgtcagttactctccatacctgtgaaccaccactggaaatattcttggatatcgaagatgtcatgtttgactgctgatgtagtttacatgcactctgttcaatttgagaaatggaatgctttgtatattttttcaagtaacatgacacatgctgaggtttatcatgggcacatatcttgtggataatgatatatacttttcccctgaaatcattttctgtagccggcatatacaaatatgttggttgctggtgcactaaaccgtttttttagtgttcttgattctcattgttaaatagttccctaataaactttagtgagctcattcgatgccaaactgcacacatgcatacctgaatctttggtaatcgtctagggccagccatttttctctactacttatgaaccgttgtgttcagtttttactattctggtgtattaatttgctgcaaaacttatgtatcatgtaagtattttgtgttgtgtaaaatcgctatgctagaaattaagaaaaattaacaagacaagtcagagcaaccacatgcatatttggaaattctgtgcagttcattgtagaaacaaattatgcatgagccagccttgataacatattttcaaacttaagttgtctgctcaggctccagtatgcaacacctctctttagaggggctaaggccattacgggcaccagtggacaaattggcttaggcatatccgaaaggggacgcctattggcaattcaatatgtgtgagcattatggtacaagactaccagtgcagagcctttttgggacactaacataaaaacttgggtgggtatccaaattgtagggtcactactcactgggtcaagcagataagttctccatcttccaacattctttttctatactccacagtacacatatctgcacacttatttgtgatatggaatatagtaagcattattctggcaaagagaagacaccttttttttttggtttgctattatgaatcagacggcaaatattgcttccggccgagtcatgtcatgctgacttcatgtttagcaaacgctaatatgctatatgaacatatctttgctcctggcccagaagatgatgatgttccacttgctacatacacacattgtgccttttgtcatgccccagtgccccaatcatatactaccggtatgtacagactacagagcactgagcccggtcgtgaggcagcctctgccctcctgccgaggaaagccgacgctattgccttccccgcactgacccatcatcaacaactcaactcaaaatcacaaaacgccttgaccgcacactgccatactattatgtgtgtattcacttcgcgagctaggcacgtagccacttcgccctggaatcaagtgcacgccccgctcggctcggccagtggtcgcgagctgcacgccgccgctgcctgcacgcacgagcgctgcttcatttcttcttcttcttcactcctaccgtcgatgacgactaattaaccgccaaccccactaccgcctctctctttgctggctgccattgcctcctctcttccccggcaaaacaacttctctcctattcccacctcttttcacccataaagcggaagtggatttttgtcgggacatcctctcgttttgtgcgtatcgtttaaaaagttatcaaaatttttttaaaaaaaattatcaagatatatattgtgatcaatatatgatatatcttttcgcaaacatgcaagttaaaattcgacatatgtaatttgaaacaaaaataacaaacaaatttaaccgtaaattacgtgttcttttcacagttaaatttgctatttttgtttttacttgtataagttgaatttgaatatgcatgtttgaagtgacatatcacatatagggtgtgtttagttccacgctaaagttgaaagtttgattgaaattgaaatgatgtaacggaaaagttgaaagtttgtgtgtgtagaaaagttcgatgtgacgtttttgggattcaaagtttggaactaaaccgagccataatctgctacactaaattttttaccacctccgtcccaaaataagtgcaaccatagatatccgtgtccagcgttttgactgtccgtcttatttgaaaaaattataaaaaaaataaaaatattagtcacgcataaagtactattcatgtattatcatctaataacaataaaaatactagtcataattgtttttcaaataagacgaacggtcaaacgttgagcatgaacggtgttaaaactgcacttattttgggagtgacatgtaaaaacgagatgatatccccttaaaaaatgaatatagtttttcccataaagcacgctccacttgtgctgatccattccatgtcaatggagttcatggagccatggacccatctcctcctcctcctccttaaaactcgtcttcccccccacgtctcaccaccatctaacgtgcgtccatggcggcggcttcaggccataatgcgcgcctgcttgcgctcgcgctcgcgctcctgctcgccgcgctgcacctgcacggcgtggtgtgtgaccccagccatactcacttcgccatggtgtcgcgcaatgcgccgtcgtggaggcccgatcgcggtggacaagggaaggtatcggcgccgtcccggaggacttcctgaacgagaacctgcaggcgctgtacccggtgatccaggcgttcaaggcgaccatcaccagcgacccgcgcggcgtgacggcgtcgtgggtcggccccaacctctgcgacagctacttcggcggcgacatgtacaagggcttctactgcgagcacccgccggcgccgccgggtgcaacgacgccgaaggacaacaccacgctcaccatcgcgtccatcgacttcaacggctacggcctcggcgcgcccagcctctccggcttcgtcgacgcgttcccggacctagcgctcttccacgccaactccaacaacttctccggcgaggtccccgacctcaccggcctcccgtacttctacgagctcgacctctccaacaacaacttctccggcgcgttcccggccaccgtcgtcccgctcggccgcctcctcttcctcgacctccgcttcaaccgcttcgtcggcacggtgccgccgccggtgttcgacctcaccgtcgtcgcgctcttcctcaacaacaacggcttctacggcaacatcccggacaacttcgggagcaccacggcggagtacctggtggtggccaacaaccagttcaccggcccgatcccgcgctccatctacaacacgtcggcgaacctctccgaggtgctcttcctcaacaaccacctctcgggatgcctcccctacgagatcggattggtggaggggctcaccgtgttcgacgccggcggcaacgacatcaccggacccatcccgctctccctcggctgcctggggctcgtcgaggagctcaacctcgccgggaaccagctgtacggccacatccccgacgtgctctgcgcgctggccaagaccgggaagctgcagaacctctccctctccgacaactacttccactccgtcggccgccgccattgcctcgagctcgtccggagcaaggtgctcgacgtgcgcctcaactgcatccccaacttcccccaccagcggccggcgctcgagtgcgcccgcttctacgccgacccgccgcagcactgccccttcgtgccgcacatcccctgcgacctgccgggcttcaggccgccggcggcggcgttgccttcggctgtggcagctgaagaaggcggcggcggcggaggtggtggcaactgaactgatcagcgatcaccaactttgtcagcgttttgtcgttcagatcgcatgattccaaactttgtaactgttggtcaataaacggaaaacggcctaccaatttgtgccgcaaatctcagcctgacgcattgctgacaacaatctgatatcacatcgcaataagagggaaggatgcaaacacgaacattcttgcatccttccattgtatccttacaagtaatcagtgttctgaaattcactgatcagatgtactagttgtagctatatttcgacagaagtgaataatgagaatttggaacggtaaaacaggatcttcgttaatgtattcttgagatgataaattatatagagtacaaattggagaagataaataagagtacaaattggatcgagctatgtacacagatcactgtaagataaaaggcaggcagtagagtaaataagctgtcccctcaaaatgcgacaacgatatatggaggcacggaagcagaaatttcagaaaggctccacgctgcctcatcccctctcctcgccgattacatgttatcgatgagctcatgcggtgttcagcttagcgagcgtgcgcttcaaagccttcacgctcaatgggctgttcttgctctgcacaattccaacaaaaggaaggtcagttcgtacgttcaaatatcttgcacaattccaacagaagaaaggtcagttagtgcattacagttatctgaactatctttggagccaaagcaaccttaatgtctagttttttcagaaaaagcatgatgacaaatatttgctgagttcagatcatgaaagcctcgtgccttttcaaaaccgtatagcttgtcggagcagaatactatgatgaaaacaatctttggaatagaatgtaggcagtataaagttgcagtaagaacgaacaagaaagcgaggagattaccgctgagcaggttccagcccgggtgttgcagacagggtagtcaggcgggcagcagctggcatgatccttgcagcaggttgcaccttcaactgggcaacagccccaaaccaagcagagattcctgaagccgaatgcgcagcagcaggtgctgcccgctgggcaagagaagttatcatcgcagacatggtcaggggcggatgggggaggtggtgttggaggagttggaggagtcggagatggcttgggtgggtttgctccgctcttggtagggtatgatgccatcatggcaatgccacacttccccgtggtcacattgatattgcgctccatgcgaacgtatccagactcaccccacttcgggccccaagagttgcggacaatccagtagtctttgccattgtcagtgccataaccgacggcaaccacaccatggtcaaggcttgtgccacacctaccgctgaagacgccctgtaatgtaaaaatcaatagttgttacgaccaaaacctcctatatgcatggggtgatatctgcaagttcatttaccgaatgatagagctggaactcgcggccaccagcctcaatagcaacactgactggttggtgagcaaccgccttctgaagtgatttctcatcattttgaggtacatcctcaaagccatcgatgctcacaaccttagcattttcctaaaacaatgcacccgttgaaacattagcgatttgcataatgtgggaactgaaagatgaatgtatgaagttattcatcagaaaataagttaataccctgttgatgtcacacttgccatctacagctttgtaaggatagtcatcttcagtatcaatgcctccattcttaatgatgaagtcaaaggcatcatccatgagcccaccgttgcagccactgttctgtccattggttgagcattctacaagttcttgttccgacaatgtgatcatctcaccagtaacaagttggttgatgctttctactgtgcttactgcggagaaggcccagcagcttcctgcatcccaccattcaagaccaaagatgtcagtaaccatcaaaataactagtgtcatccaagagagcaacaactgcaatcataccgcaagcaaccaattgtaatatgaggcaagaaccctaaactgtttaattgtatcaatattatcaagatcaagatggatagtaagatatttgcagacatttgtttcacccctgtttttacccacaaaagcagtttgaagacacctgtaggctaatatcagcaaacagctcccagcacaggataaaaagtttgctcgactgaacacgaaaggttgataaggtgtgatatcccttaaaagtcttaaaggcccaaaatagttgcaatgcaaagcaacatcatcaaatcggtttaatgtcttagtagttggttacagggtcaccttgtccaaagtatttgactgatagatgcaccgaaaaagacctttaaaaatataaagacaaaagcagcacaaccacagaaacggcagtcctaaaatcaggaaaaaacaagctaagctaaactacaatcctggaaacaaggaaaccacactgagcaagtcagccccaaccaacggcgggctttgaatctgttcaagtccacaccgctgtcactgcacgattcacaagtcacagccgttgccaactccagaagcaaagaacgaagagaacaaataccttacacagttaacccaatgagaggattttccaagaatacatcctgcatccactacgtaataaatccttaccatagaattccaaacaattattcggtccagtaaattatcatcgtattaaaagaacaataactctgtcattaaatcagatatgctcattcaggggggaaagtcagctttagctagaaaaatgacccatcttttctagagactagacggtgtgtgactatataatcataatctactattatattatgtatatatcagaaggaaatctgcactgttttgcaagtaggggcaaaagattactagctgtgaacctgaattaactgttgtgaaattgccctacttagatccgagattagcgtgacaaatagataatcgcatctaagctttcaatggtaaataatcgcacaagggagatgagatgaggaaagagaagaaattccttaccgcattggccctggttcttgacgggggcgacggcgcccttctccctccagtcgacggactccggcagctcctccaccccgtcgtggcggtacctctccccggcggcgcggctcctctcggcgaccttggcgccgaggaaggtcgcgcggaactcctcgttggtgagatcggcgaagcggttcatcccgaggcggaacccgccgcgctcgtcggcgcgggcgttgtgggcgtcgacgaacttgaggttgtcccagaacacgaggaaccggcgctcgtgctcgccgccgagcgcgttgggcgagccgccgccgttctcggcgagccagaggtcgtacgcggcgcgcgcctcggcctccgtgggcccctcctccagcccccgcgccccgtgctccgcgttgtaggagatgatcgacatgtccggcgccgcggtggccgcgccgacgatgagcagcagcaggaacgcggcggcggcggcgcgggcggccatggcggcgacgtggagacgagcgtctctctccaacctcttcgctttcctcctcttttcttttcctcctttttttttccttcttcgttgggtttgtggttttttgggcttgataggctcgatgcgggtgggatttataggcggcggatgcgtgtttgggtcggcgactggaagaggagtttgggtttgggaattgggatgggatgaggtgagggatccaacgccgctaactaacaattctgatctgaattaggttgctaatcgtaacaattcctatcttaattaggagcgaaacagggtggatattctcccccgaataaaaaattttccatggcgaagtcgatcgggtaaaaaattaggaaccgaatcctcaagtaattagtactataatctagctcgtggtaactggtaagacacctcatcggtgtcgaccaaatccgttggatcgtaaataaacaaggcagattttcccccccccctccctttctcatcgggtaatttagaactgacggagcgtggggctcctcaccgggagaccgcgcaggcccccctttgccagttcggccgggggccctgggtgaggttctaagctcccaatctgtggaaggttcgcaagagcggaaacacacaagacacgggcgatgtatacaggttcgggccgctgagaagcgtaataccctactcctgtgttttggtggattcgcgtatgaagaagctacaaagtgccagtcagcccccgattcttctgggattgctttctcctctcctttctaagtgggcaaggtcctccttttatatcccaaggggatcccacatgcaccatctctccctccctttctttcaacttgacttctcttcattaatggacggagatttgtatcgctgccatccgaatcaccttctgacgggacggcccatacctacctccactttcaccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacatcttgcctgtaatggttaggatgaagcctggtatatatctgaccggaaccaacgtgtcatctccaggaggtaacacgccggctccggctagggacgagtgcttggaggctctcgtcctgactggacggggcgaggcgtgcgtcagaccgcctgtcgccacctaacccacgatctgaccggtctgtgactggtcacagaccggataaacgagcgcgctgcaccgtattacacgcggcgtgacgcgttcgtccaaaccgcaataaatgcggttaggtgagcgccgctgtgctcacctaacccatacacgcggcgcaaaatccacaaggggtcggggcgccccaaccctcggggccaaggcgggagcggtccgaccccctcggggagacaaagaggagggcgaacacaccaccctcgggcccgacccccccccccccggtgggtgccaggccacgtgggcgattgtgtctgcctcaagcctctagtcacgatactcccggtcccatgtcatcgacagtagcccccggcgttatgccggggcgattaccctcctcgagggaagcggtcgggcgtgacgccacttcctaaggcctggtgacaggtgggaccggtctccacagttgggcagaaacccatcagtcgcaaatcacgcacatcggcaacggttactcggctgtcaataatgaacggtctcttcaagactgccacattactcgagtaacgtgtgaatcgggacgtgccggttcgttttgcctggagatatggtgatggcgcttcggtcggcgagcgtaattaacgcgcgcacgagatgttccatctcgactgccacagccgcatatccacctcatgcaccgtaaacgggcgaatgggattagtggaagagtgggcgcgagaaacgagggggcaagatagtgggcgcgagaaacgaggagccgggcacagcgttggcaagggtataaagttgccgaggaagagatttgcttcctttctttcgccattattccccttgtcttcgccgcttgcgccctaactccttgtttcctgtgccctacctccgccacacgcgctcgctctcaaacatctcttcttccggcgtcatggcacggggctccgctccgcttgacggtagcgtgctgccgccttcccgcatcgtgagcgagagacaggccgggctgctgcgccgcttcatgccggaatctgcgaccggccgggagatagtctcgctgggcgaaggatgcccggcgccacgctacccggggcggtccgtcttcttcctcccttttgctatggcagggctggttccgccattttcttctttcttcgtggatgttctggagttttacgatctccagatggcgcacctcacccccaacgcggtaatgacattggccatcttcgcgcacttgtgcgagatgttcatcggggtgcgcccatcccttcggctgttccggtggttcttcaccgtacagccggtttcgccgccgtcggtggttggtggttgctacttccagccgcgggggccggtgctgaaccgctacattccctgcgtcctccgcaagaagtgggatgactggaagagcgactggttctacacccccctcgccgacgaatcgcgcctccgactcccaagccagcctccagcgcaggcctccaactggcgggcgccggtagatctgggagatggctacgacgccgtcctcgaccgcctggcgggcctgcgatctcaggggctcacaggggccatggtgttcggcgactatcttcgtcgccggatcgcgccactccagcggcgcgcccggggcgcctgggagtacaccgggtccgaggactgtatgaggacccaccagggggtccgatgggactgggctcctgaggacttcaagatagtggtccaacgggtgctgaatctcagctccgtggaggcatccctcgttcctcaaggagtcctccccctctgcagtgatccagaccgtgcctccatcttgaccatcatgcaggcggtcggggcatcggaggagcgggctcctcgaggccacgatggcgcggtcgggagccgcaggggggaacgatctaccccgggagggggtcgtgcttctgggcctcgcgacgggggcccggggagcggccaccctgccgacgcccgggggaagaggaagcaggaaggaacccctccctcatctcctccccgagggggcggggcggcgcgtgccagcagcaggcgcccggagggggccacgccgacgtcgcagcccgagggggagcggaagaagaaacggccccgcaagatgagggggacagaaccatcccggggaaaccttatttcccctccaaggtggtcgtttaaccgaccccctcgcaggttcgtcccacgcccatcatggccgtattcattcctttaacgcgagttttcactcatccatcttgttttgtcttctggtctttcttctgtttcagcgagatcccgtcgcgtccctcccgccattccaagtccggccagtctgagtccgaggacccggcgtccacagaggcccggaggcgggaatctgaccggcgagaagccgcagaccgccttcgggaagccgaggaggccgctcgggaggccgccctggctcgccagaccgaggaagccgttcgggaggaggccggactccgccaggccgaagcgacgacatcctctgaggcgacccgtgaaactgaccggcaagaggccgcggatcgccttcgagaagccgaggaagctgttcaggtggccgtccaagctcgcctagctgaagaagccgctcgggaagaggtcagacttcaccaggccgaggcggcgacgacttccgaggcagcttgcgacgaggccgcgggcgcatcgcttgggcccaattcctcgggcgacgcccaggataagctaggtccgggggatatccctgagtccggcacgtccattggcgggccgagccgcgcggcatcctcaccgagacggctcttccccacgccttctgctgctccactgagcgcagaaccccttctgcgggccttggccgtcgcaaacacgacggtgttggacgggttaagtgcccaagtggaggccctgcaagcagagcgggcggagctcgacgccgcatgggtgcgtgtcgaagaggggcgacgctcggtggaggccatggtggaagtgggtcgcaaggcacaccgtcggcacgtctcagagctcgaagcccgtcggaaggtgctggaggagatcgccaaggaggtggaggaggagcggggggctgccctcatcgccaccactgtgatgaacgaggcgcaggactccctccgccttcaatacgggagctgggaggcggagctagagaaaaaactcgatgccgcccagggggtccttgacgctgccgctgcccgagaacggcgggcggcggagaccgaggtggcatcccggcggcgcgacgaagcccttgaggcccgtgccatggcgctggaagagcgtgcctgcgccgtggagagggacctggcggatcgcgaggccgccgttgctattcgggaggtcacactagcggtgcacgaagccgcctgtgccgaagaagagtccgcactccgcctccgcgaggacgcgctcaccgagcgggagcgagctctcgaggaggccgaggccgcggcgcaacggctggcggacagcctgtccctccgcgaggcttcgcaagaggaacaggcgcgccgtaatctggaagatgcccgcgccgagaggaccgcgctgaaccagcgggccgctgagctcgaggcgcgggagaaggagctggacgcgagggcacggatcggcggggcggccgcgggcgaaagcgacttaaccgctcgcctcgcaactgccgaacacaccatcgccgatctgcagggcgcgctagactcgtccgccggggaggtcgaggccctccgcttggcaggcgaggtagggcccggcatgcttcgggatgccgtctcccgtctagaccgcgccggccggcaggtgggcctctggggcgggcagactgcgaagtacgccgccacccaagggggcctcgcccagcgcctctcggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccggaaccgaggacggcgcacgcgcgcaagtccgggacgccgccgaccatatcgtccacagcttcgagggttcggcccctcggctcgcgttcgccctcaactccgacggggaggatgatacggcggagtgggcaatagtggcgacgaggccggcgatccgggtgcgtcggagtgagcccccaggcccccgccaatctttaaatagtatcttcttttttttttaaggccttcgggccccctgcttgtatagactaatttaatctgcaatcaaataaagaggaaattttttgtgttaattctatttgttgtgtgtatgagacaaggatgtctgtgccgcggttctcttgtgtcttggcttgaacaagggctcgtgcccaggtcctagtcctcaaatggctcgggtcggggctagtgcctggagagatccacatgtcgagactggccaggccgggagcgtggtgaccgagggttatgggtgacccgattgtgggtttttgccgattctcccccggagttcaccacgccccggggcacggctcggttctgggccccgtttggcgattttagccgacccgagcccccgagggcaggattgaacacgagtgacctatttcaagtcaagattcttcaaaaggaaacaacagcacagatacagcctttaggaaatcgaaaatacttttattgaggtacagatataagagaaataagaatatgcatatgtggcagcccccggccaaccctgcacgcccgaggggggtgcggggttggcccaagcctaaatcctgatacccgatcccccttaggggtagaagcgacgaaggtgttctatgttccacgggttaggcagttctgcgccgtcgctcgtggccagccgaacggagcccggccgggggacaccaatcactcgatacggaccctcccacatcggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcctctaggtagtcgaggtcatctctacgaagctgatcttgatcagcttcgcagtacatggtggcccgaggggacctcagggtgagctcggatgggagaaccgcttccgcgccgtagacgaggaagaaaggcgtttccccggttgctcggcttggcgtggttcggctcgcccagagcaccgctggcaactcctcgatccacgaatcgccgtgcttcttgaggatgttgaaggtcttggttttaaggcctctgaggatttccgcattggctcgctccacttggccgttgcttctggggtgggcaggtgaggcgaagcagagcttgatgcccatatcttcgcagtaatcgccgaaaagttcactagtgaattgggtgccgttatccgtaataatacggttaggcactccaaaccgagctgtgatgcccttaatgaatttaagtgcggagtgcttatcgatcttgacaaccggataagcctcgggccacttagtgaacttgtcgatcgcgacatacagatactcaaacccgcccggggcccgcctaaacggtcccaagatatcgagcccccagacagcaaatggccatgaaagcggtatgatctgcagggcctgggccggctgatggatttgcttggcgtggaattgacacgctctgcatcgccggactaggtcgaccgcatcattgagagctgtcggccaatagaaaccttgtcgaaaagctttgccaaccaaggtacgcgaggcggagtgggctccgcattcgccttcatggatatcggcgagaagctcgacgccttgttcccgaggaatgcacttcaggaggattccgttagccgcgcgccgatagagggtcccttctaccagcacatagcgtttggaaatgcgccggacgcgttcactcccttcgcggtcctcgggtagagtcttatctgtgaggtatgcttggatctcagcgatccaagcaatcaatctaagggagctaggagcgctcccctcgggtcccgaggcctggactccgacgggcatcgggggcctgtcaggcgcgtccgtctcccctaaggggtcgggtcgcgccaacggctaggcaagcctttcttcaaaagcgcccggtggggtctgggctcgcgaggaagcgagtcgtgagagttcgtcggcaaccgtgttatcccgtctgggcacgtgccgaagctctatcccgtcaaaatggtgctccatacgccgtacttggcgcacgtaagcgtccatctgcgggtcagagcaccggtactccttacagacctggttaacgaccagctgggagtcgcctaacaccaggaggcggcagatccccagtccagctgccaccctgagtcccgcaaggagtccttcgtactctgccatattattggtcgcccgaaagtcaaggcgaaccaaatatctgaggacgtctccgctcggcgaggtcaacgtgacccccgcactagcgccctgaagagacagggagccgtcgaactgcatcacccagtgggcggtgtgaggcagctgtgaggggcccgagctggcctcggggactgagacgggctcgggagctggggtccactctgccacaaaatcggcgagggcctggctcttgatagcgtggcgtggttcaaagtgcaaatcgaactcagaaagttcgattgcccatttcaccacccgtctagtaccctctcgattatgcaagatttggccgagggggtaagacgtaaccaccatgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggtggggccgatccccttcgctaggggccacatccctggggcgctcttcgtccaagcggcctcgcgaggcgcgctcgtcttctgtgccgacgacctcggggtcagaggacgacaggggcggccttcccacagtggccccggggccgtcctgggggtcggaggctcctggcgtcgtcggacaagcgggcaaagggccaactccggtcgtcaggggccttaggccaccgttcggctcgggggtctcttctccctgctctctcccgagtcgagcgggcacaggattagcctcggggtcagagggtgataggtgcggccttcccgcagtggccctcaggccatcctggggttcgggggcacctggcaccatctgacaagcgggcagagggccaactccggtcgtcgggggccttgggccgccgttcggctcgggggcctctcctccctgctctctcccgggccaagccagcacagggtggggatgcgcgaatgaggattatcctcatcgcgctccacaaccaacgctgcactaaccacttgcggggtcgccgctaagtaaagtagcaagggttcatctggctccggggcgaccagaaccgggggagagctgagatacgccttcaactgggcgagggcatgttcagcttcctccgtccaggtaaacggtccggagcgtttgaggagcttaaataagggtagcgccttctctcccagccttgatataaaccgacttagggcggccatgcaaccggtgacgcattgcacatccctaagcttgctggggggcgcatgcgctctatagctcgtatcttctcgggattggcctcgatgcctcgggcagagactaaaaacccgagaagcttgcccgcaggtacaccgaacacgcacttatcggggttcagttttatgcgggcggagcggagactctcaaaagtttccgctagatctgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaacgcagttttttcctcatcctccctagccatgcgaatctgttggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttacgcccggccgcacggcgagacggtgctcaatcacctccctggggaccccgggcatatccgccggcctccatgcgaagacgtcagcgtttgcccgcaggaaagagacgagcgcgtcttcctatttgccgtccagaagaccaccgatccgtgtggtcttggacgggccgtcgcccagggcaatctccttgaccgggacctcgtcgcatgtgactatccgctgcctcggggcggcgggggcggatgtgccaagcctctcgtcgccaccctcgggcttggacgcgacggcgaggcggtccgcgcgctgctccatacaagcaagcgcgactttgaggtcgccatggacagagatggggccatcggggcccggcatcttcatctggaggtaggcgtagtggaccgccgccatgaactttaccaacgcgggcctccccaagaccgcgttgtagggcagactgaggtccgccacatcaaagttcacctgctccgtgcggaagttggcgggtccaccgaaggtgaccgggaggtcgatatgacctagcggccaagtgtgccccggcgtcacaccgataatcggctgggacggccggagcaccatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacactctcccccatcgacagtggcaatggtggccccaggctcttggaaacctaggtcatcatcgccgtcatcgatgtcctcggcgggggccttctgcttggcctcacttcgccgattgctggaaggaaccgccggggacttgccctctcggcgctcctgcctcctctcctcctcccacttcctcgtccgctcagccaaacttttgactgcacggcagtccgcgaggtcgtgaagggaagtgttgtggacgatgcaccacttgtcggttgggcgctccctactaggagcgccggcctccttctttttgtcgcccgcaggcctcccctttcgagtggcccgcgaagcgtcctcgacagcgaggacatgaccctcgtcgtcggtgtgggctgacctcttcttcctcctcctgtcacgccgccctgtctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcgattgtgccgcacaccccccctgaacgcgtaaatcaccgtgtgtgcagggatgcatggtatggtgttgcggacttgacagaaccgctgaatgtacgagtgaagtgactcatcatcccttcgctgtactgcgtgcaagtccgcttcctcacctgggcgcggatatgtgccttgaaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtctgtggtgaggtgacactccggacgaggaggcgccctccgttgcgtggggagcacgtcggccattacgccggcgctcgatactgatgcgggcatccggtcccccacgcagatcttcccgggtcagaggcgttgacgaaggagtggcggccgaatggcgaacagcggctgccgctcgccgcgccctccgtcttgacgacgcggagccggtggtagcagcaccagaggccttggtggcggaggaccgcccaccagcatccaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtggatgtcgaagtcgcggatccttcggccctctcgagcgccttctcccgcctaggactttggcgtggagggggcggtggagtacgagctcgacggcgtgggtttagctccccgtcgtcaccgctcatactcggggagaggtcgtgcgcctttgcttgctcggccattgggctgaacaggaaaagcttggcgaacacgaaagagtgcgagagctcagaagatcactcacagagccccctacctggcgcgccagatgacggagcgtggggctcctcaccgggagaccgcgcaggcccccctttgccagttcggccgggggccctgggtgaggttctaagctcccaatctgtggaaggttcgcgagagcggaaacacacaagacacgggcgatgtatacaggttcgggccgctgagaagcgtaataccctactcctgtgttttggtggattcgcgtatgaagaagctacaaagtgccagtcagcccccgattcttctgggattgctttctcctctcctttctaagtgggcaaggtcctccttttatatcccaaggggatcccacatgcatcatctctccctccctttctttcaacttgacttctcttcattaatggacggagatttgtatcgctgccatccgaatcaccttctgacgggacggcccatacctacctccacttccaccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacat

SEQ ID NO: 48285 - DNA, 3188 bp, Oryza sativa
tcctgcagccctatgtcatcggtatctcaatgacataaagaactcacatgagtcaatgacatgtgggtcaaaatggcatatcttaaattttatataatggcatggttccaattttcactttctctctctttctcatcacttagtagtatatagtatcctaatttaacatgtacttcatcggataagactctgactacttgctgagagggtaatctttgctttgaaacgctttacacctcctagaaaaccactaaataatactcgcgcgctgtaatgcgccggaagctaatcgcatgccataatattgtcaattgtcactaataatagggcaatactatcttcatttgcatcatgccgttaaagtgatcccgtcactgatggatggctgcggtcgctgtactgcagctacccatcgtagactggccggtgacgcacacgcggccatcgccgccgtgtacgtggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattaatctgacgatcaggttgtctcatgccccctagagggcttcctgcccaccttatataggatggggggcaggattacaagatagaaaccttaaccaacacggtatcggtctactttacaatcttatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgcagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatggccacaacatataatcagcctaagccataatattggtcaataaaaatgcacacttacgtggcgaaaagcaatgatattgtatccaatcaaatgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacgccctttaaaggatgacgcatataacatgctcccgagtaataaatcttccgggtaatatagaccaagcgtagctcatatgaatagcttctgatctgagtggttatcccttatgggatactctaaaatagatgtaacaattgaatcccgactggcgcaagtattcaattgataacccttacggggaataataaatagtccagtctttgagcatataaaatagacccatgatcatgaattcatgttgcatgtatccggagcaagtccaaattgaagatataatacttgtatttaagctagtaagcccctgagcacgtagtcacaattgttcatgatggtagctgacgcagttggcatagagacaagacaaccaatatagagagaatattgcccaccagaggtggcaaaaatattggtggtagcgaagatagtgataccaatcaaaagtaatgaagtcgcatagccatggaggcgaagaaaccagtcggcggcagacagatcaactaacaatgaagatgaaggagcccagcgataaagttgtgtagccatggcagcaaaataatcagtcggtgacagacgaggtagatcaaaggtgatgacaaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcggagatgtcagggtcgatgaagcagaggtgctggtgatgatgtcagtgataataatccatcaaattaatgttatagctgttgtagatgctttacttggaggagagttgatgttgttgcccaactcgtctaaaccgaaatatttgaagttgttgaagtagaatgtctgctccgaagcaaagatgaagataatgactcctggagttgactcgttggctgattaattgatttcttcagcttgacataaaatttgtcaaattttgagccttgtagttgtgtagtccccgactctttgattagttgggaaacaactgaacatagagtcgagaactgtagcctcttgtcgtcgaatagttattgcttgattgaagatatgtgttgaagatgtccaagtagaaatcatgaatgttggagagcctcttgttgtagtaaaataacatggcatcgcatgccgagatgtcgaggctcataaagacgtcgtggttggtgaagtagcaaaacttgcgaagtagcagcaatagagtttgccagtggggctgcaggaa

SEQ ID NO: 48286 - DNA, 801 bp, Oryza sativa
ggtgaagacgtagacgcccaacaccggcggcataagggccagccgtgcaggcggaaacaccagtcggcagcggcgaaggcaagccggtcggtgaagacgtagacgcccaacaacgacggcataataggccagccgtgcaggcggaagcaccagtcggcggcggacgaggcggccggtcggtgaagacgtagacgcccaacagcggcggcataataggccaagacgcccaacaacggtggcataaaggccagccgtgcaggcggaaacaccagtcagcagcggcgaaggcaagccggtcggtgaagacgtagacgcccaacaacggcggcataaaggccagccatgcaggcggaaacaccagtcggcagtggcggatgcggcggccggttggtgaagacgtagacgcccaacaacggcagcataataggccagccgtgcaggcggaagcaccagtcggcggcggacgaggcggccggtcggtgaagacgtagacgcccaacaacggcggcataataggccagtcgtgcaggcggaagcatcagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaa

SEQ ID NO: 48287 - DNA, 1157 bp, Oryza sativa
attcctgcagccctggccgattttgtaataaagataaagcctttacccatggttacccagcttctattgaataaattattgttaaacccgtgggaccaaaaacccaccaattggggaagggctttccggcccaaactgctgatcagaccgggccagataaggccactgccggtcagaccggccagatctggccgggtttcaccccggcggtcagaccgggactcaggccggtctcaccgcgcctatggacgccggtcagaccgggctctggaccggtcaaatcggcacaatagtgccgattcaggggatagattcaatgactaatgttagttatttgtattatcttagaacatttggtcctcctgtatctactgctgcaagtaatccccaagttcccccacatgttcctaatgcttataatgatgtttctagggggtatcctcctgatactaggcaaggccaatataatcatattgcgccacaacatcaacctattaggccaccaaatccaccaccaaatcaacataggccctgataatatagagcacttgattagtggaattattagggataaattcaggattgaagctaggaattgtgctaaggtttaccaaaagccgtatcttgattactatgataatgtgccatatcctcgtaattatagggttcccgaatttaccaaatttagtggtgaggatagtaggactacatgggagcatgtaggtcaatttttagagcaatgtggagaggctaatagtgatacttttaaattgcgcttattttctttgtctttgtccggtactgcttttacatggtttacttctttaccgacaaattctattcatacttaggctcaattagaatagatatttcatgattatttctatactggtgaaattgagcttaggttatctgatttaacatcggttaagcaaaagtataatgaacctatcattgattatgttaagagatttagagatgttagaaaccgatgttatagcttgaacataactgatagagatttggctgatcttgcttttaatggtttaattactcctattaaagagagattagatggccaacaatttattgatgttagtcaactcatgcaaaaggctctggctcaggaaagccgggttaaggataataaaaaatct

SEQ ID NO: 48288 - DNA, 1657 bp, Oryza sativa
aggtgattaccatcaaagtgggatctcatgatatgccaataccttctggagatggagttgggaagtcatcaagcaacaaatccgaaattgggaccagctcatcgcagttggccggtctaaccaggccctctggccggtctgaccgtagctctgcggaccggtcagaccgggccatcaggccggtctgaccaccgacccaatgtcggtctgaccggcgcttctagccggtctgaccggtggtctacgtccggtttgaccgggcttcaacgccggtttgacaggaggtttgaaaggagtagtgcaggggcttcattgtcttcaagcaaaatcaatagggggcattatttacctcctggaacagagccgaaacctaggtggatccctaaggatttaacggctactcaaaggagaaggttgcagcatcttcgggcccaagagataagagagaaaaaggccgaagagcaaagagataagaggttcaatgaattgcgaccaccaccttttggaggcataaatccgtagagagggaagaaccggttgttgtagaggagaaagaagaacaatcggttgctaaagatgagtcatctccaaaggaggacatggatatcaacatggtgtgtatgttgcctatggagttttgtgctatggatgaagccgaggttgctcaattttcactaggtcctaaagatgcggtttttgagaagcccgatgaatcaaaccgtcatatgaagcctctctatttcaaaggtcatgttgatgggaagccagtctttaggatgctagtagatggaggtgtcgccgtgaacttaatgccgtattcattattcaagaagttggggcgtgaggataatgaattgaagaagaccaacatggttctcaatggcttcaatggtgaaccaatggaggcgaaaggtatcttttcggtggagctcaccgtgggaaacaacacactaccaaccgctttcttcatagtcgatgtgcaaggtaactacaatgttattttgggtcgttgttggatccatgccaattgttgtgtgccttctaccttgcatcaatgtttgattcaatgggacggcgatgatgttgagattgttaaaacggatacatcggccgaggttgcaatggccgatgctacatttgaatggcgtcatgggaatatccaatgcttatcggggagggatctttctagctatgatttcattagtatctccgatggcaaatttgtacttatctctgtaaagccggctagtgtagcacggctaggctatataaatttgtataatgagtaaagaagctaatttagagtggttgcaaaagagggtgcaagaatatcggtctacaaagaacgatattggtgaaactattgaagattttgatgaagtagagaagcttggacaagggtttacatcggccgatccattggaggaaatagacataggtgatggaacaaagccaaggccgaattttgtaaacaaaaatatgagagccgattataaggttaaaataatcgagctacttaaggagtatgtggattgctttggatgggagtatcatgaaatgccaggtcttagccggaagttgttgagcatcggcttccaatcaaaccaggttttaggccttataaacaaccacctcgtcgttttagggctgcaggaat

SEQ ID NO: 48289 - DNA, 1493 bp, Oryza sativa
ttaactaactaactaacaaacaaatggttaattgaccactgatatcttttaaaccgttcgatcaagttggatgggactaatatatttaaatttaccgtgtaacatactttactaatattacttgtagatttatttataaaacaagagtagtcgaactaaaacaatgataagttaaattttgagaattgttactatgaaacagagaaattagaagaaattcagaaagagaaagagggagaaggagagcatgtagtatgatgattgcacatgtgcagtgcaggtgcagggccccagtgtcatctcctgcacttcacttgtgccatcctcttcacttgtgcagtctttactgtaagaattttcttgcaagttgagaagaaacagacaaggggagctcttctttcataccgttgccagcacggctattcaagcaaagtctctttgactttgacctccacgctggcacttgccctacgctttgctatcccgtcccaaacgtttttctcctgtttctacatcactccatcaaaccgcccgtctaacactccgaagtacataatccgtacttcacgtcgatgcctaaaaacgtactactcccccacattccaatattaatatacaacggactataggattaggtttttttttttaacagagcagtaatatacaaggttgcacttatattaatatggtgggattaagtatttataaccatgacttaaattgagatgtacataaatcattttcttatagataatggattgtttcattagtcaataaaaacatcctacacctttacatcaactcatcaaggatgcacacatgcagtaaaaataaaagtgaaagaaagatgaaaaaccgtagtaggtaacatgaacatgtcatgttgtctagcgatattttgctctattacaatcatgaagagaatatcgggattatatgctatactttggaacaacgccttcagaaataaagatcttttgatgatgtcaatttctaaaatgtatttgaatttaatggcattgccttctaaaatcaaagtgaccaaagaatttttaaacttaattttgatttattgtatttcaccgtagtttatttttttagcattgacttttaaaccacgaatataaatataaaagctttatctataaattatttttaatatctttgtttgtttttctatgacataccagcctagcttaactgcttaagtgctcaaccgatcagacacttcgtatccggctttctataacaagcaattgtccttttaccgttttatctgctattgcttgttatagccgttacgctgaatttaccacaggtcactcacgtatagatactaatactgtagagtgagctgtagtagcagtaaacgtcgcttaaaaggcgggaaaagctaccgttgcaggcaacaacactgaactacatgccgccaattgcctgtcttcttcttgttttaatcattcaatcacctcgtcttttcttgcttaatccat

SEQ ID NO: 48290 - DNA, 743 bp, Oryza sativa
acggaggcggcggcgagcatgtcgcggatactcctccacatgatcgaggacggctgcaccggcgacggcggcgccgggatcactctccccaacgtcgccggcagcgccctcgccaaggtcatcgagtactgcaccaagcacgccatcgccgccgccgaaggtagcagcagcagccgcaaggcgaaggaggagctgaagaagttcgacgtggagttcatggaggtgggcatcgacatgctgtacgacctgatcatggcggccaacttcatgggcgtggagggccttctcagcctggcggcgcagcgcacggcggagctgatcaagggcaagtcgccggagcagatcagggagatgttcgggatcaagaacgaccacacgccggaggaggaggagcagatccgcaaggagtatgaatgggccttctaggctatcagggtttaaaattgtggaacgaaattccagttttatcggaggggaccccctccgatatgatattatttcggccgaaattttaattttttttctttctctttatgtactaaaaaagatgtccgtgcgttacaacaggtgaatgatattttaatcttattattgttatggtttggctagcgtgaaattcactgtggaaattcccttggatattttttttagaaaatcatgagctgtaattaggagtctgacattaatcattacgagtctgaccttaatctcaagttagtatgtaaatttttttaaaaaatatt

SEQ ID NO: 48291 - DNA, 891 bp, Oryza sativa
acatcaacggtgctcatcagcttccgtttaggctgtttctgtcaaacagtggttcggttcaatggcttgttgggagcatacggagctccttcctgcatgcatgctaagataaattgggtgcaaaccaataaacatgtagccaacattgttcctgtaactactaagaattgtcgaaatgcaactagaaaaaagctagtgctctggcatctcctgatagcatagcaatcaccagtaggttcatgataattttcagatccccggataggcggatacgaactgcacctggcaggctagatcaccagtaggatattgatgtagttctagaatgggggtagaagcactgcatttctccataaagattattaagcaggattttctctgaatggttacaggaaagggatgaatgcagaacagagtcgaacttcactgcaggacaaacataagttgtgtctggattctaggaaaccgttattgggctattactagcatgcaggtgtttatgccattgcaatattgcatagctaggtggttaactacaagagaggtgatagtgacactaatggcccacaatcatcatcattgtcggcagttcggcacatggcatacattacccgtccagccagacagctaatctagtggcatgaccaggattcatctggcaaggggacaataagcaaaacagatgggccatgccatttgcacatatgtaggctgcatctgaggtagttttctatatggatttcaaagcagactacgttatttaaggacttctttagaacgcagttacaaaggaatagaaattttattagttagttcccacacaaaaaacaaaatctcatccattccattccaaaggaggcctaaactagtaccccaaaaatcctagtgggg

SEQ ID NO: 48292 - DNA, 711 bp, Oryza sativa
gcaaatagatcagcaattgtaaactttgtcaatgcaataagtagagcaattcctgcaatcattccaatcgcaaggaggccctgtagaaaccgaacaaaagttggcaaggcggttgacttcttcggagttgcagtaaaaagctgcagcacgatacagcaaaagattagcttagatgatgttgcccatataaattaaaatcacagaacaggtagagatattaagacttcaacgtaacaaaccttaaataggagcaccaaaacgagaagtacaatccatgagaagccataaacctatccaaaaaatgcattagatataatagaagatcagaaggatagatttgctagattgtagaagctataggaatccataccatgcagtcttttgtggtttataacactattgttcacataggaattttaaatcaggtgctccagacaaatgccaaaactaacaaaaaattctttttcagctaacatgaggcctcacagtaccaagtgtttcacattaacgaaaacacatgaatgttttttaggccaggaaagaagagctacagcatttaatactgcattcgacatgaatggaagaatgcaagatggaaaaagaatcaggcagacacgtgcttaactgcattttaacaaaggttttgatgtgacgaaatggtttgctaacatagcaattaaaaatttgcagtgcaaaacggggtgcaggaat

SEQ ID NO: 48293 - DNA, 846 bp, Oryza sativa
cgaaggcaagtcggcggtgaagtcgtagacacccaacaacagcggcataataggccagctgtgcaggcggagacaccagtcggcggcggacgaggcggccgctcggtgaagacgtagacgcccaacaacggcggcatagtaggccagccgtgcaggcggaagcaccagtcgacggtggcgaagacaagctaacggtgaagatgtagacgcccaacaacggtggcataataggccggccgtgcaggcggaagcaccagtcggcggtggcgaaggcaagccggcggtgaagtcgtagacgcccaacaacaacggaataataggccagccgtgcaggcggagacaccagtcggcgacggacgaggcggccggtcggtgaagacgtagacgcccaacaacagcggcataataggccagccgtgcaggcggtaacaccagtcggcggagacgaagacaagccggtggtgaagatgtagacacccaacaacggtggcataataggccggccgtgcaggcggaagcaccagtcggcagtggcgaaggcaagccggcggtgaagtcgtagacgcccaacaacaacggaataataggccagccgtgcaggcggagacaccagtcggcgacggacgaggcggccggtcggtgaagacgtagacgcccaacaacagcggcataataggccagccgtgcaggcggtgacaccagtcgggggagacgaaggccaaccggtggtgaaaatgtaaaccccccaccacggtggcataataggccggccgggcagcggaaacccccgttggcaattgttacaagccaaccggccggtaaattgttaaacgcccaacaacaggg

SEQ ID NO: 48294 - DNA, 910 bp, Oryza sativa
ttcagaagaaaataaaacggagctatgtcttttgcaaattaaacagcgagttctcaccacatacctaaggttcggggccagaaactcatgggtaacaacctcataaagctcacggagagctttggtaacaccacctgcacgatcagcagtttcatcgcgtatctaaaagatattcaatttaccacataagatttcttcatggtaaatttaccaaacagaaaaaataggaaataattaaacaagaaccaaggcacgatatctctctatttgcattttactccaaaataaagtgcaatagtctttaccagaagtcctgtcaaaccagtaagcctcgactggactaattgcagcttcttgagatttatggtcactaaaagtgaaccttgtgctatactttcattcagatcccgaaaaagcctttcaaccctgtacatgtatcaatagtatgcattggcattaagtaaagaaaacttgggggaaatacaacacaatattggtgtcagtatcagatatttcatctttcagtaggaaagcataccaacgctgcccttcaccatcaactaaagagtgaagaattctctctgcactgaaatagcattccttgacggcgtaggccatgtattcatctcttgatattctgtcccataactcatactgtgagtctttacaatctgaagcatagtcattcgccaacataatctacaaaagaaaaaaccaacagattcatagcaaccaataaaagaatatatatgcaaaaaagggatctatctagctaatttcaattaggataccttgctagtcagaagaaacaatggccactgtacaagtcttagattgccacagttacttggcatcataagcaaatccatttccctgaaagagaactttgcatgatactgaagcaaatggg

SEQ ID NO: 48295 - DNA, 939 bp, Oryza sativa
gtacactcaatgaagttcagtatgaaaaatgctggtccagcactaactaatattttaatggtaccaatgtctatcttcccatgatgaaaagctataatagttaggcactgcatcagaaaagagcacttttagcatcataaactgtattcagaaatgatacttggatttaagctatacatgtgtacaagtacgatatcaaaccactgacctggaacattaatattagaaaaatccaaaggcgatgaaaactacggtacaagtgcagaaaagtgcgatgctcaacaaagtttgtctttccagtctgtaaatataaaattaaaagcaaagttaagtgcacataaataaccataatgcaaacaagatatgtacaaattttcagtaaaataaatgtgtccatttccttctagtcattgccccagccttagtcatcggtaagacccaatattttacataactaagtttaatgcccgtaagtttgctatgggttaaaaatcctacttccatagcacagcaagcccttgtcacaaatcccaacacatgccacaccatatgttcttctatggtgactgaacgagctccgctttgacctctgttatgcctctacggccttgcactacctacatcttgccctcttttacaccgcgcacaacccactttggatccactgttagtggacagtgggagtgtagagcacaccatgttaccatcacaatcaccaagtgcatcttttaagtaataggcataaggataggttaggatgaagattgaacactgcatgtttacttaacagaatacatattcttttaatactctccttttcagtcaatagatacatacaactcctttttaatactgaggcttattgttctcactctacatattcattacatgattgcagtagggtacgtaagtgcccattttgtagcaacgactcctgtt

SEQ ID NO: 48296 - DNA, 809 bp, Oryza sativa
ggttttttccctttaaactgctgcttttatgctgtttcctattatatctcttgcttctctgtatttaatctcttgcatatatttaggtcacgctcctgctttaatcttggttggccacctgctgaaggttctaaatttttgcgcaagcctgctaagaggaaacgagtaagtagtcatccatagtattttagggctagcaatgtggctgtgtgagttgcaaacctatggaaaaatcagcctatgtgtgctttttgtatcatttgagattctcctttctatcagttagccaacagtactttcgcaccactgggattagtttccttagagatagattgtgtaacattattttttttccgtaatattagataatagatcagaatcctatgtattaatttggaaggttgtcggtttaattagtaagttagagatagggatgaaaacggatcggaaacggacggaaactagctttatcatattcgttttcatatttttttcggaattggaatcggaatcgaaaactcggatacggaaatgaaatcgaatattatcgaatacagatacggagcgaatatgagacggaacgaatacggtagcgaatatttaccggtatataaaaaacccctcaaattgagtttcttgatcaaggaagagatatcgcttattattttagttcaaaatctccaacatttatatcgtcaattttatagacggtcccacaaccatatgtgaaaattgattttcatggctgttcctcttaagagatccatatgcaaaaaagaattatcattttctattcccaagccctttta

SEQ ID NO: 48297 - DNA, 773 bp, Oryza sativa
gatcaatctcggtgatttcatcgattcaatctccaatgtcattggctttgtcgtttcactagttagattgttctctaactgcagactaatctcctattacctttctttttcttgttttcacgcaccggctgagatcaagacgaagtcccggtgtgtcttctcgtcgcccagtacgatctgtataggtaccggcgtaaccttcatacgacacgggaacaattcatgtccatgggatcaacagcaattgagtgcttcacatgcagatcaactgatatgcacggcttaatatcaaaccctagcttgatatatgtattacacagttaagcatgtaatattttaaggctaatcaaattatatttgtttattttgcatgtatactggagcgatgcatggttggtcgcatgcccaggatggcaattgagatcaaaaaatcgttcattaacgagtgatgggatttggcagtgctgcggttcctgacctccttgtaatttatatatttagattaattactaacgcatattaatcttctcatgattttttattgcatgtatggccgtcggtgcaatgcttcctactgtaaccatgttgccgagaggggtacgccaggacatagtgcgtggctcgactactgatgttgatgatgcagcgttcgctcatgccacacacaacacctctaaggccggttggctgcaccaagcccatcatgtcaacaaaatcagagagacgaatctacatgcaaatcagcctcgcttacaccattggcctattatgtc

SEQ ID NO: 48298 - DNA, 1457 bp, Oryza sativa
gtgttggtctgtgagggcagtctatgacctatgaaagctatcagatataagcgggcccgggctgggggaaggggggacgttacaaaatggtatcagagcccgactctcgcggtttcacgggcgcgtgtgtcgcagttgcgcaggcatggtgcgcatggctggtgtagacccggagtggttacacagcatggcacatgcgctggcactggacacatggacgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgctgggcctggagcaatttgggatgggtgaccgaccgggaacccgggtgcacatgagtgaggacaaagtgtgcagaaaagatatgtgttggtctgtgagggcagtctatgacctatgaaagctatcagatataagcgggcccggcctgggggaaggcgggacgttatatgacctatgaaagctatcagatataagcgggcccggcctgggggaaggcgggacgttacactgcctttgccgccgccgaccggtgtttccgcctgcacggctggtcttttatgccgccgttggtgggcatcttcgctttcaccgtcgaccgcctcgttcgccgctgactggtgtcctcgtctgcacggcttatgaagccgttgttgggcgcctacgtcttcaccgccggccgcctcgtctaccgctgactggtgtcctcgcttgcacggctggcctattatgccgccgttgttgggcgtctacgtcttcaccgtcggcctgcctttgccgccgccgaccggtgtttccgcctgcacggctggcctattacgccgccgttggtgggcatcttcgctttcaccgtcgacaacctcgttcgccgctgactggtgtcctcgcctgcacagctagcctattatgccgccgttgttgggcgtctacgtcttcacctccggcctgcctccgtctgctgccgactggtgtcctcgcctgcacggctggcctattatgccgccgttgttgggcgtctacgtcatcacggccggcctgcctttgccgccgccgaccggtgtttccgcctgcaccgctggcctattatgccgctgttgttaggtgtctacgtctttcaccgccggcctgcctttgccgccgtcgaccggtgtttccccctgcacggctggcctattatgccaccgttggtgggcatcttcgctttcaccgtcgaccgcctcattcgccgctgactggtgtcctcgcctgcacggctggcctattatgaagccgttgttgggcgcctacgtcttcaccgaccggctgcctcgtccaccgccgactggtgtctccgcctgcacg

SEQ ID NO: 48299 - DNA, 1284 bp, Oryza sativa
accgctgactggggcttccgcctgcacggccagcctattatgccgccattgttgggggtctacgacttcaccgccggcttgccttggtccgccgccgactggtgtctccgcctgcacgggtggcctattatgccgccgtcgttagacatctacatcttcaccgaccgaccacctcgtatgacgccaactggtgctatcgtcttcacggctggccacgtcgccgccaccgctaataggcgtcgttatcttcaacacaagttgtctgcgtctgctgccgactggtttcttcacttccatggctgcatgattatgatactattgattggccttatagtcttcaccgccagtcgtcttgtctactgattgactggtgtcctcgcctctacggctggtttataccgctaccactactgatggacgtcatcgtcttcattgctggctgccttgtctgacgccgactggtttgttgcctccacagctacatgtcttcgtcaacattgactggtgtcatcgtcatcaccagtttgcctttgccgccgcccatggcgtcttcactttcatggctggcctattttgccgcggttaaagaacgtctttgttttcatcatcactctacttcttcgagcaacttcatctttattatcttcggcaccggcaaactctattgcctttacttcgcaagctttggtatttcgccgaccacgacgtctacaagagcctcaacatctcggcatgcgtcaacaagtataatgccgtgttattttactataacaagtggtgttccaatattcaagatttttactcggacatcttctatgcgtatcttcactcaagcaatgactactcgacgacaagaagctacaattctcgactctatgttcagttgtttctcaactaaccaaagagtcgggggctacacaaatacaagactctcaaaattcgacaagctttatgtcaagatgaagcaatcaatcaatcagccaacgagttctatggaatctacttcgggagtcatcagtttggtcttcacttcagagcagacgttctacttcagcaactcttattattacaccggcaattttggcttcttcacgccgccacaatctgctccaaatttttccaagtatcaaagtttgagattctatctacatgtccgggagtttagagttatcaaccaatcagtcagttttgatgagttggataacagtatttacttttcttcaagtgaagcatttgcaacagctacaactccaagttttactaccatctttacaaatcaagggg

SEQ ID NO: 48300 - DNA, 2005 bp, Oryza sativa
cccccttaatactatacaaaaatgcccagctagctaggtgtatacgtatacacatttaagctagctgcccttaatacctaatgattcataatgtatagccttttatttcttttgtccaaatagaacactaaacaattcaagaaatgataaagggacccacacatctcctatgaaggtttctgtgtgctgaaaccacgctgtttcatctcccagctagctaggtcttctgatgatatgaatatgaatcatttggacgtggaaaccgcagataattcagcacttgacctttgttttattcttaattacgcatgcaccctgtctaatcatctttgacaggattccagtgtaaattatctgataggtgaatatcagatagctaagcatatatatgcatgttccacaaagttcagagagtttgcacgcgtcatgggtgcaaatattgcctattggccataaaggatgcatggaatcaagggatatcccaacatatagtgcatatataattaagttttaagatcgacattctcatcccaggcaacttcaattcgtctttaatcttgcaaactaattaacacacaatatacaaatttgtgttctcgaaggtacttcccataaagatcaattatacatggaaacgacacatatgactcctcacaaaatggatcaacatctgagcaatatagtgtaagtttcaaaagtcaatttgccttgtgttgtggatatgccattgtattgctaactgtaatgctcatgatctcccacaacagagcgcaaatggtgctaagtcaaccattcatgtgtatgtactatatatgtatatatagttactagctagtatacatatattcttttttgggaaaattggaactatgccattataattttgcaaaattttagatatgccatcctgacccacatgtcattgactcatgtgggtcctacatgtcattgagataccgatggtatatctcaaactttgcaaaattataatggcatatttctaaattcttttttagataatggatgaaactaatacactcatatactattaagttcgtttattagcatatgcgattataagttttaaggtcgatcaattatttttttcattaagtataaattgatgaattaattagttttctttagttcatctacttgcattctaaagcatcatctttgtgagagcaaattaactgaggttgcactatatttaattatttcccatgcatattcaaattaaattatatattcgcgaaaacaaatatcacaataaaatcaatattccatacaaaatggatcaacatataattagcttgagctaaaaaaatcagaattcattttactatatgtttgtggtgaatgctcctatatataatatataatgccaataattaatattgggtagaatttgtcactcccatcccatgcatacgcatatatatagctacgcatgcgtgcatgcagttttcacattttggtccttttaaaaaacttatttcgcaaatagacccctaaaaaaactaatcccagaaatggtcctttttagggcgccagagtggctggcgctgccatccaatgggacggcgcccgcctctctggcgccgtcctcctgccaccgtggcgcacgcgaaccgacgtggcaggaggagggcgacagcatggctggccccgccgcctccattcctgtccattcctgtttctctgtatggagttgcaacggtgtcatttttttttattttttcggatgttttttcacactcaggatcacgatacaaccaaccacaaaaaaaatttaaactcgaactaccacttagctaagtctgaaaatatctagcataccacttagtctactttgcaccttcactaaaattagactataactcttttagtaaaaccctttgatcagcatgttaaacataatgcactctaccactatatgaaattacttaatctaattcaaaatataaccacatgaaatgacatatataagttaaacagtacatag

SEQ ID NO: 48301 - DNA, 968 bp, Oryza sativa
caattaatagaattaatatagtatgcacaccacaggtggtatatagtatattaataaagtatcattaaaaaaagaaaagaaaagatggtgtcctttagtttgttctctcttgctaattaagtttcctggctggataattaagttgtcaagcgtacgtgtcaacgcactatattgtgtacgtaacatgacgtccaaatcatgcatgaacttacttgatcagagaggtgtttttcttgtatttttccaagtaacacgtcgccctcgtagacgcacacacagtagaaaatattactatcacatcgatgtactagtatatatgtatgctaatgtgctggcctttttcacatctatctttgtacagtatctaccatgcatgtctttatacgtagaaatatatataccattatcaccatcatccttgcatgcatccacggtacgttaataaaatcgtacgtagggcaaagttatataaggagtatatacgtacagaagtacgtatatatatatatatatatatatatatatatatatatatatatatacactgatccttatatatactagtagtaatatatatcaattcgtatgctatagtattgtgagcttatattaatataattgtgcatgagaaaaataatgtaattggggggatcctaaataaaaccccacttgcattgggccatatatgtatatgttcaaaagtcccaaataatttaaggtacagaaagtacggaggaaagaaaaacaggacacaataagcacacgacacccagagcaaatgcatatcgatctaaccttagctacctacattgacaacatgcttaagcaagctggcccctgctctctgctgctttccgttggttcgttggttgcatgagctaatggctaatcacgatggacgtaagtctttggactaattgaagtccccaaattgaaatcaattagtgccaggcataacagtcagagct

SEQ ID NO: 48302 - DNA, 1342 bp, Oryza sativa
catacaaaataccaaccagcatatatatcttcacttatattaatcaccccggatgctttgcttatgccacctctggttatatgaaatatgcgatcaaaaacatcaggatgtccataatgcattcgaaccctgtaataagaacaataaaacacaattaagttccttggttaaaaccattgtcacaggtttgttgcgggggaaaaaagagaatgtggtaagaatgagatattattccctgcaactagctaaatttgactcacttgaggtaagcaagaacacgttgccccaaagtaacaaaacttgtttcctggttagacataaatgatgcaagcgaagaaacactgcagcaggaataaaatataataggttaatacaaaaataaaagcaaaaccaaaagctagtgaataactgagagtagtcatagtaaggataccttcccgtgaacacatgttccctaacaccaagaattgttggagggcggattccatgcttaccacgaaactcttcaagtaaattcctcattttcattgcttcctctaagtagttatcctacaggagaaattttatcagccaaggatccaagatggtttctggtgcacagacaccttttcgaaaaagaggggagtgccaagtatatttcatctacgtagagcaagtataaactaatgtattgcatggaccaatggacaagataaggtagatgggtcagaatatgaccccatgttatttctccatatgagcctgggtcaatgatcctcacatctcttttgaatctaatctgcatgtcacatgttagcacctaaagatgtcctctacctcactcaatgaggtattgagtgtaaattccccgtggcccctggtttgtacacaatggatacctttctccagtgattttgttaatacttccatcacaaagaaaaaaacaagaactcatcttcatgtttagttgtttacaccaatttaccaagcatgaagaggacctatcaccgtcagaatcatggttaataacagcatgaattgtgaataatccaaatggcaagcagcgtactacatgagcatatttttagaatctatctcatagaattacacataagaatctagacaagctcgacatttcatgaggaatatatcaacaaaaaggataatgctactgtttttttgccgggtcggccaaaagatttggtcgacctaatttcattaaggaaaaggggagtggacaaggctactgttaatgataatgataagaagaaaacctgattcatgtcaattgtctgtattgcatctcctcgagtgaatataatagcagggtgctgattttcaggttttccctcgccgagcttgg

SEQ ID NO: 48303 - DNA, 1678 bp, Oryza sativa
aaaagtgaaggaatttgaaaaccgactcaaacacggatgacgtactaaaatattggcaaaaacattttcaatttttataatagtagagatttggtaatattttattcaaatttgaccaaattttgttcgaacttttggaaatttcggtatatagacaccctttgctagaaacgccgaaaacaaaagattgaaccctgccttttagtagtacttactaactacgtattactacactcttcatcctaaaatataaatatttataattatgaatttagacatgtatttgttcaaatttatagccaacattattatattttaggatgaaggcagtacatcatacaattcacaaactatagtagagttaatacctccgtcccaaaataatggtcgctttgacttttttcttgcgacatttgaccatttgtcttatttgaaaaattggtgcaaatatataaaaaaaataagccatacttaaagtgcttttgataataaagaaaatcacaaataaaatagataataattctataattttttgaataagacgaatcatcaaaagttaaaaaaaaacttaaagggacaagtattttgggatggagttagtagttattattcagaagtaattagtaattgattttgtgcaatttatcactcgcatgcattgccattgcttaattaccttgtcctaatttgtatttgcaatgtacttagactcgatattcgattgaattcatggaaaaaaaaggatgcgcacgtagcatctgatcggcaatcaatcaccaaattaacataggttatagagatcggacagcttcttcgccttcgtatcgatattttacggtgccgatcgaataaattattttagttaggattgaataaattattcggagtcatgtgaccccgggtaatcgaacgtgggaacaccactacccgtatccgatgggaaatgtagctcttgatgtttttggcgccaagatatcaatatatggccattatatatcccccatagaacaatcacatatactccctccgttttgaaatatttgacattgttgactttttaacacatatttgaccgttcgtcttattcaaaaacttttgtgaaatatgtaaaattatatgcctacataaaaatatatttagcaataaatcaaatgataggaaaagaattaataattacttaaattttttaataagacgaacgataaaacatgtgcttaaaaagtcaacggcgtcaaacatttcgaaacggagggagtataaggaaaaaaaatctaatacacttaattgtctctgtaggaactactagagggaattcagttctaataaatcgtcttggtccattataaggcattattatgcttcagtaataaatatccatataagtcgctgcctttctttcactacgctgacaaaaatgcaaatgtttttttgcttctggcaactgtgcttctgttccgcaactaaagctgtatcactatgtgctattttattctgttcttgtctgatgattctatttttatgggggaaatgagctggacatgcttgtttctatggtttacaactgttgtatgtctattttgtttatctctattagtatcaagagcaatttgccaatggtctatgttataatcatcatggtttatacatctttcctatgggattaaattgaatggtaatt

SEQ ID NO: 48304 - DNA, 1083 bp, Oryza sativa
caccgccgccgccacgcgcttcttcggcgtcgcgtcaccaccgacccgctgccctgcgccaccaccgagcgccgccccaccacccccgccggcactgtgcggcagcacctccagccgccccagctattaggcagcacatggcatggaaacgtagtaatccttcacaagaacatgccatgttttccatgttccatagctagctaagctttttagctttagcagcagcatggtgagtgagtgacaagattcatcggcatggtagcatctagcgatgcatgcaaagctactaacacagtgatgtttgtgtagccacagcgccacagatcgtgcagtggggccgtcgagttggggcggcgggggcgcacagtggcgccgccggcactcggcggggtggtggcgctcggcggttggggcggagtggcgtcgagtcagctgcggcggcggcagcgctcggcggttggggcggcgagctcgcctccccttcttctctttctactacaccataaatttttttaaaaaaataaagttagaaaaatttatgtatagaaatattatatataaaaatattgaattcaaattcaaattttaattggatatataaacttttgacttataaatattcgctatacaaactttagatgtgtaaaatttaggtgtataaacttaataaaagaggaaaagaaaaaaaaaacgatcgccgctagcgatcaatagctcagtaggactttcgaacaatttctccgtgcaaatcggttgctagcttgcttgacagttaatgtcatctatggcggcggcagaagagaagaagaagaagaagatgatcaaggtgatgagctccgacggggagaccttcgagatgacggaggcggcggcgagcatgtcgcggatactctcctccacatgatcgaggacggctgcgccgacggcggcgccggcatccctctccaagatcatcgagtactgcaccaagcacgccgccgtcgaaggccgcagcacggcggcggcggagctgaagaggttcgacgaggagttgatcgacgtggacacggacacgctgtaccacctgctgatggcggggaactt

SEQ ID NO: 48305 - DNA, 754 bp, Oryza sativa
tttagggtagacgtgtcacgctatatgagtgtacgccgatttttcataactttcatatacctaaatcaaatggttgagacgattattagtaaaagtttagtaataaaaaaaattagtccgtgtagcagtgctcagtaaatgaatgcaaactgtgaaagccgtggaaggggtcgttctccggcgatggctccggcgacggctctggctccggcggcttgtccttgtccttgatgagctccgccgtgcgctgcgcggccacgctgagcatgttctccacgcccatcgagctggcctccagcctgagtatgtccgtctcctcctcatcgtcgctggactcgccatcatctaatacttcctcttccttaccttcagcttcgccggcggcgtgcttggcgcagtactcgaccatctcagcgaggggtttggcggcggcgcagccgtcctcgatcagttgccgcaacaggctcgccgccctctccgccattgatgatatctccccgtcggagctcatcatcttgttgatatcttcttccgccattgatgacgacaactgtccagcgagctagcgaccggtttgcacggagaaatcaattaatggcatgaaaccgatctaatccgagtctaatttcaatgcgaactgttgcgatgaatccgtttttgaaacatgcacacgggtgcagttgagggatttgatctttcttttttttttgcggggagtggatttgatctgatcgagaggggtttatgtaaatct

SEQ ID NO: 48306 - DNA, 2799 bp, Oryza sativa
attcctgcagccctgatattttcccgtcggagctcatcatcttgttgatatcgtcttccgccattgatgacgacaactgtcagcgagctagcgaccggtttgcacggagaaatcaattagtaatatgctttgtcgatcatctattttattagtatatattaattaattgcatgaaaccgatctaatccgagtctaatttcaacttattacgaaatcgtaaaccaactgttgcgatgaatccgtttctgaaacatgcacacgcgtgcagttgagtggatttgctctgatccagaggggtttgttggcaacttttcgtaaaaagtcgacaagcacgatcgcagcaactaaacgacttgcggtgatatggagtcgccaaccacctcgatctagccaaaagctagaccaagatgggttttgataactaaatcggctagcggagccgatttctagataactacccgtctcgtgggcaaaacggaaggttttcaggacaaacctataaaggggtgtcgcactctcgcagcggcggcggacgatttacagcgcaaattgacaaagatggataaactaagagaaaattaaaagcaatatgaaaaacgattcgattgattgattgtagattgattagttacaattgaaccggccatgtcccttatataggggttggtcttgccctctacaggccctcctccacgtccaactcggggtagaaatcaaatgaaacccgaaacatgccttcccgagcaaggaaacctcgagacccgacgaaacacagtcggactcggacctgccggtcagaccggccacatgccgccggtctgaccagccctaaaccggcggtctgaccgcccaacgcacggcggtcagactggccctactcggaggaaaccggcagacttccaaattttggcaattttttctatttaatctttaggtgccaaatttgggtgtaaacacatgccccccctaccttttttatgaacaacgtgaatccaaaagcatagaacatgtttttggtcttagggcgataatccaattactggccatagcacctcctaagcgtcttgccaaacgctcgggaagtatttcttcaagtatttcccgttgattgctcgctgaaaaggctccccttgaagtgtctccaaaaaatatgcgttccctcgaacaatgccgcatattcgataaggaccttccctactaggagaccacttaccgaatttccaaaaaatatgccgcatattcgataaggatgccgatacaaatttccagtatcttttggtttgaacccaacctgctccctcattacatcggcaatcatatcagcccatgatgtttgctgaggtactccttgtgtttgttgctgcattagctcaaactgattgaactgaggagcaaactgaggttgaggcgatcctgcctgctgatactaaacatgaggtgacagaggctgatattgataattcaaatttcttccttgatagttctagaagttcggttgaatattacgtaccaaatgttcagggataatctgaggcacaactgattgatcggcctgtacatgatggaccaagtgttcagaataacttggttcacagtatgctgcattggccgattgtcaagtgttctcaatctcgctgacgcatgttgtaagttttgctgctgagtcggatgaactgtctgctacctcggctgtgcttgctgagtcggcaacggctgtgttgggtcggctattgtcggatttggcaagaacattgcagcaacttgctcctgagtcagccgattgacattttgcccagcatgttgtggttgttctctggtcaacaatctggggttaaccatctgtcttggtgctgattgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcttccaacttcgtcttcagctcagaagcactacacttctgaaaagggggaataatagcaaggctgagtacaaccaccgtactcagcaagccacaccaacgatgcggacgtgcaaggggatacaaggaggggtttgtggctatttgcataaaggcggttgtaaaacattttatttagcaaacagtaaaactgttgaataattaaagtgacattaaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaattccatcacgcccaccttggccacgggggctaaggaaagggtcaagtatacttcagatcaagcagttacccactcccggct

SEQ ID NO: 48307 - DNA, 887 bp, Oryza sativa
ttaaagtattaactaatactccagactgattgatcaggcatgttgcacggcatagtcgatcctatcttgaaaattattgaattgcagtggctcttggttgccatctgcaccaggtcttcaactgtaccatcttgaggaatatcacttttgttacctgagccagttgcagtacctttgtcaccctgagatgaacttgggctgacctcatcggctgcgaccaccttcaacttgtacttttgtacgatggttcctctgcgggtctcctgaaaagaatccatgaatttgttcttcacgttgctcatcatctgttcaagttcatccctttgctcagctgtcagcctatccaatgtgattggaacaatattggttgggtccacttcagctgatggatttttggcccccattttatttacgggaggtttgactcctgttcccggtgatggtggtggtttttcggccatcgggatgaagtcgttgaaaactcaggtcccaccgggcgtgccaagagagtgttgatgtaaaaacacgaggcctgggagatctgcttaactctagtgcaggtccaaaatcttgcctttgaggttcatgagcatgccagttgatttgatcctgcaatcaacaagaaataaagacaaagaaatagtagttagtccataaatgatagccgatcgaccagccgccgatgacgtatcatttgtactcgagccgatgtcatctttgcatcgatcggctgtgcgaggcaataataaagaaactaaatctattcaatcggctgtagatatcaatgataaataatcttcatgtcgatatatacttaaatcaagtaattgggatagatcggtcgccatgccgagacagtataaatcccttagaccgaaatatatatt

SEQ ID NO: 48308 - DNA, 1469 bp, Oryza sativa
gcaaatatcatcttctgtgaataaaaaaggaagaaccaactgatctacataaacataaagtacgcatggtttatatttttagcaataagcaagaagtacatatccaatcagcaagagtttctatttaagccccgggttaatataaagaatccaaatatgccatgagcgagggagtaagagaatataaccattgccctaggatcacaagaatttacttttggagcttgattgttagggaacaaatatcaaaaactgctctttaaattaatggatgtcacttattcactctatgcaacaatcacttagatcccctacatccatctcagtatcatctgcaagagcgccatcatccatgatatcatctgaatcttcacttttgacatccaatatagaatcagtagcactgctactatcatcattaccaaacaaatagtcctctgaatcaaacaactcggcaaatttaccaagattcttgatcctccctctatagctggtaagttgaagaactttttccttccacctcaccagtgggcacttttctatcaattttgtcccatcataagacttcgtcaagagcacgctaaaccgcttccccctctctatcacataaaagatgccataatgcttcagaagcagcctcatcaacttctgcggcataacaaactcacgacagaaatatgtgaggtgatcaatcaccagcctcttttccaacgtgaagttcagtacctcgtgcatcacagcaactgccctcttatcaaattcaggcgagccaggagtcaatcctcttgcctctgaataaggatataggtatgttgtcttctgaaactgctcggtattcccttttttcacataatgatgaacttttccgtagaatttgtagtaacttgtaaaatttggtgggaacttcatggggaatgatagtgagagctctcctggtggactgccaatgccgttagcatttgcatcaccagtcaatgctgctgtctttttctcgagctcggtgactgcccagtttgggttccaagagacaagctccaggtaatcgccatcctccaacctgaccaccctgaactgctcggggaacatgtgaacccatcgtgtcttgaaatcatgaggaagccccatgtcgcgcctgaaatgtgcaatcttgtcgatagccagacgacggtccaccgacatcatcagcagcctggtgacgtactcagcggccgtgcgcgagtgatcctccagcaggcgcgcctcctcctcgatgagcgcctcggcctgcggcgagaggcccgcccacatgacgccgcggctgtcgcggcagacctcgaagagctgcggcgagcggctcacgaagtgggcgaccttgttgggcttggtgagcccaagctgcgggcgcaggatctcgaggcgcttgagcggggtgacgtgctcctcctccttcttgagcgcgtcgaagacggcgagcaccttggtgagcacct

SEQ ID NO: 48309 - DNA, 843 bp, Oryza sativa
caaaatgctgagacaggctgctaacatgtacacaccagtggtctttgaaatttttcgcagggagtttgagatgtttgtcgattccgtgatttatagctgtggagaggatggaaatgcattcgaatatagagtagcagtaacagataggcctggggaacactatgttaggtttgactctggcgacttatctgttgtatgcagttgtaaaaaatttgaagcaatgggtatccagtgttgccatgtgttgaaagttctagatttcagaaatataaaggagttaccacaaaaatatttcatgaaaagatggaagaaggatgtcaagtctgcaagtacaggcaatcaagaacttctgaatggaggagtttcacaaattcccagctcttatttgaatgttcccgtgccatttatagatccacaacatgtgcaatcaaataacgagcttaaccatgtaagttgatcaaatataactattcattaagtttattttttatccttagtaaaggttgaggttcaatatgcgtgatcaactacaggacacttctgtttctaactcccaccagcaggcccttcatggaggtgcacagggaagtcaggtaagaccccttggtagaactgaactcacttgtgcaatacttaatttctaaaagcaatattggtgcttttgctcttctcatagtattttgtatgcaccgccttctgaggcaagcaatccattaagtttgtatgcactcaaattttgttagaaaaatattctcaagatcgccacattccatggttgtatacgatttgagaccactggtgacaaaagaatacgctcacatctttttgtgcatttctggcttt

SEQ ID NO: 48310 - DNA, 1652 bp, Oryza sativa
atccaacctcccgcaccaaatcccaatccggatcccccacgctaaaccctagctttaaacccccgaatccaaccaatccccgcgccgattcccgccatttcgcgcacctcgtgccaggatctgctcctgggcggcgctcttttagaaaaaaacctggcagatttcgacttctgcaatggagcccgtcgatttcggtgggggcaaaggttatggaaggaatctctgtctgagcaacgatctgatccttctggagtaaggttttgtgctgggtggatttgggattcgatgtggctggagttgagctcatctcggggagaagggattcggacggtgtttgatctttctgtcgtgattgctttgcttcgggtttgctcagcgctagaagatttgctcgcagaatcccgcgcggagttttgaagaaagcttggtatttcctggttcgttgtggtttgtaagcgatgcagttcgaggacgggggagatgttcatgttggtgccggtgagggtgaagatggtggcagggtcacagtggatgagcttaccaggtgaagaatttttctttcttttttatttttaccgtatcctacattcagcagttcagcatcgagatttcatatgtgcaatgtttgggtgaaaagctaacgtgccaagctagttataactgtagctagggcctaccctccataatatagttttttttttttgaaaccgtccctccataatatagtgacctagtaacggacgagacatttcatagtacaataaatctaacatgctcttgtctagatttattgtactatgaaatattgaaatgtctcatccagtactaagttgctatattattagacggagggagtacgagatatcacgagagaagagagctctggatgttagtactatttagtacccttttgcagttcttttcttttcccaattctagtcttctgtagttatggttaagcgagaccggattcaaatttagaagagtaacacttcctcaagtcagtattacttgtcgtttcagacagggaaatactactaagtgcaaatcaattccactacctgaaacatcatatatttccgtccggagggagtagtagctgatcatcaatgccttttctcagatcgggttatgaaagcaataaaattatcaaaggctgtctgtcggtccatgcatatggtggaatgttagtattgcacactgactacttagcaggttggtgactactatactactcagtactatcaacattcagcagcatgctggaaattgatacagatcattttctcttgaatcaaggactcaattattcatggtagtgagacgattcctaacttttatgttatagtttttcagatgtctacgttgtggcatcagtgcaaatgcgacgcctcatatgcgccgtggaccagagggacggagaactttatgcaatgcttgtggtatagcatgggcaaaggtattctaattgttctccaccacttcttgtttatactcgctccaattccaaatgtaagtcgttttggttttctacatgcagggaaaagtgcgaaaagttattgattctgatacccccatggataatgccatgtttgcacaaatggttccagaacttagcatggaattcgatggcggagataaagcatatgagt

SEQ ID NO: 48311 - DNA, 1817 bp, Oryza sativa
atacttttaattcaaacgacatgaaggtcaaagcccaaatgtaacaaatcaaacatacgggaaacatggattaccaggagaatgaagcagcacaaactggtaatccacaaccgaacatatcaaccacctaaaagcaaaatcgtcaagttacacgcaacagataaaaaatgcctattttttcaacagagcggatgcttatgagttataccttcataggtaggtctagccctgaagaggaagtatgcaatgatacacctagatcagccgatcctgtaattattcaaagaatcagcatttatgctacaacatggaattcttttggcaatcaactagtttaccaagcaaaagagggtagtcctctgatgcaagccacatagtccggaaggcaacacgcctcagtttcaacctctttatttgctcctcatacttcatcctatcaggtcctttgccttcaaaattgatattcatggatatcataacaatactcaaaaactggttactggagctaattagcagaatgcacaaaccagtgataatgaatagcatcttgggtagacaaattgcttcccgttcttgatatcaatccaaagctttccctcgtccattgaatcatcttctcctaaagttgcagcaacacgtctatcgtacataagtgctgcttccagaagtatgctgaaatcttcatctggtgtcctgaaatatgtggcaaaggaaaagattcttaattttactttcattttaaccacatgtgctgagtataaataatgatacaactaggatcacccagatcaagagaacagaccagcttgtgctgctgacaacaagagctggtctattaggcttcaagaaaatttcaccatcgacccagcttgtaaatacagtagtgttcctgtcttccacttctttctctgtgttgtaagagcaaacagtagaaactatatcaaagtgaaattttcttacagcaatcaaatatttagagtggctggagaacataccaacagaaatgcaatcgtcattgcccatagcactacaaatggaattccccaacctgctaaacaactatttcatctaatggtcagataggcagtacagcaaagatgaggaaataaatgaaaacagatgctcacctcatgtttctctgtcaatgaagcaggatggaaaaattcaggagattgatcgtaaagaactgttgcgctgaaatccaaccagttaagttaatataaactgtagctagcgacttcaaaaataaaagtagttgtgtgctaacacaacagccttaaacatgaaaagtgcctgaaagtttgatcttacttgattccccatttttgatcaagctcgtgtttcattgcttttgtaacacagaaggcaccatcagccatccgtccaaaatgcttctcgaacctagaatgcaaagaacacaccactatattaacacacacaatcagtatgctacatctagcagataaacaaacaggacaggaattaccagaagtagattttaacaatgatatggcttctgccatgagacaacccaagcagtgtatatccaaagttatgccagtccacaataaacttagcacctcttagccagctagccagttttacagcagccaatgttggaacagagggtggattctgttggacagaagatgatcgaataaaagaatcagttccatgctagtgtgtgagattttcgaattaacaaataaattgtaagtatcaaatagaaggatttctaggtaataaaagtccatgtcagttagtaaggccaaaagatacttacaaaatgacaaaacttcgcctaagtaaaggctgca

SEQ ID NO: 48312 - DNA, 1301 bp, Oryza sativa
atacttataattctaaatttaaatttattttttaataaaataaatatattttaaaagtaaattttctagttgattattgtgatttttaatcatagtttatcttaaaatatttatttttaaatacctaagaacatatataaaaaaattatcgttaaattattttttattgctaacacataatcaacaataggtcttgctattgcactacgtgtctacaggtctcatcttttcgtttatgtttatgtttagtagctaaaatttaaatttttaacattaaataaacattaaatttgaagctaattttgagtttttttatcgaaatttatttttcagtctttgtttttagattgctaagaacacatatataaaaattttattcataaattatttttcgtttacaaatatatcgtttggcttattccacgaataagctaacgatgggaccgtactaggggtgaaaacagtacggaatttttccggattccggtcatgttttcggaaacggaatcggccggtcggaattttttcggaatttctcggaatcggaatcgaaaacggaaatattttctcggaaacggaatcgaatatgataaaagcagtttccgtcggaacccggaaacgatcggaaacattccggaaaaattgtcggaatttccgaagttaaaaatcccatagattcaatagtccataatttatccctagcttcccagcccaacccaaatcgcggcggcatctaccctaaccggctaaccctataggagagagaccgtcagactcagaactcagacgcgactcgcgagttggaggctgagcgacggctgcggcgtccagatccctgcatcgcggcgccggcgtgccctcacgcccaccgcccgtggcgcgggcgccccaccgcccaatgctggtcgcctggccgactggcccccgcagtcctcgcccccaccatctagcgccgcccttgctcttcgtcgtttcgccgccggccaccgccaccatctcgcacctccgccggcctgctcggtccccgccatctcaaggcgccgtcccaccgcgtctcgccgtttcaccgtcgccaccaccgccgccgccgacggaacaaccaccacaccgacgaggcgacgacgacaccaccactgcagtctcttcctcactgccaccaacgccgacggctcctcgcctcgcagcagccagcagcccagcggcagcatctgagcaaccagcagcagcaggtgtatatagtgattgactttgcacttttactaatgctctatcattttttttgaaggctatggaacggaaca

SEQ ID NO: 48313 - DNA, 1380 bp, Oryza sativa
ttctattactcacgttttatttccatttcagaaattaaacaaaaagctcaagatttatcgtacaattagatgaattaaaacggtttttcagatctctagcataacacctgttgctaggataagatagataggaaatattttgacattcataagttggagtacttacttgttttttttttggataatgggaatggcttctacaccaacgggggtgtatatatatacaaccattggagtacttagttgttgggctctcatatgtttagccattatcggctaaccgatttactaattatcttggtatccacatcacttgcaacgagtttcacgaaatatttgcttgaatttgacttagcaacggtggtaggctccaatgatatggctcctgttcaaagtttctcctcttagttgtatccacaatatattgttgacgtacaaagttaaaggtaactatttacacgtacgcaacattaattaatcatggaaaaaaaagaggaaatatgcattgtattggaattaagtagatgttctgagtgtctaaatacacatataatgcccataattatatttttttatctattgaaccttttaaatttttattttttaaaataaactatataccaaaacttccaaaactaatcttttggccacaacagctaggctagaataacaaaacaacatgcctaattttgtttcatcatgccgacttgactgacgtgacaagggttttgtgacttttgtcataattaaggcgtggcaaaacaccgggggcgtaccatattgttgtttcaccgcttgacaatcaaaagcaaaagcaaatagcttgattctgaaagcagattcgtagaaacgaggcatggtttctaataaaaaccaaaagttagcaatgaagctgcttttgtggggtgatgatgttgatctaaaactatcactagaagtattatataaattgcacatttcgcatgtttcaaaatctgaattcacaatcagattttaagaatccaactcctgaaaaatcacaatccagagacaagattgtgacaataaaaaacaaaaataaacggaataatgtaagtaatgggtttgcaagatgatgtgttcggttatgtgcgtaaattaattatggaacggtcgttcagtgcatgcatctcccacagccaaaaattaaattttaaaacatggtattagagttcattttaaagttttttcatcttagttcattttcagtattgacttttaaattactaagaaacacatatgtaaaaggtgtactcataaattatttttagttacttttcttttacggtttatctccatacagtaaacgatgagaagcttagctgcttgccttttcagaggccaaaacgactaattaaactg

SEQ ID NO: 48314 - DNA, 1096 bp, Oryza sativa
cattcatacctagcagcagaagaattatagtgctctataaatcatagaacaaatcaccaagcgtaacgcagatctatttcacacgagtgctctataaatcgtggatcaaattaccatgtgtaaagcagaatttctcaggagtgctatgtaaaggttgtgtttagttcctgaaaaaagttgaaagtttggggaaagttggaagtttgaaaaaaaaagttagaagattatgtgtgtaggaaagttttggatgtgatgtgatgcgatggaaagttggaagtttgggatagttggaggtgaactaaacacggctaaaatcacagaacaaaatcaccatgtgtaaatgcaagaatttcagaacagtcgaaggaattttatatcattaatcaattcagtccccataggaatcgaaaaaaaattcaaacgggatacaatatactacagtacttgtcagatccatacacccctctctagtcctgatctaccgactcaaggccattgcgcttcagtgaccgtgcttaattatacgccgcgataactagggtaactgctaatcacgaaatcttcatacttccatggtaatcaactcaaggtcaggctcggcgaaatcaactcaaggccgttaatgcgacgagaaccatcttccaactcgaccggccttgcagcatcggctaccgggtgaccacatggcgatcaatcgatcgagctctcaattctcaaatcgcagacgtgacgtcgtggcgatgatcatcagcgcgagtgcatgtgtccaaggcttcccagcgcgagccaatcctcgcgcctctccacggccgccttcgctttcttcgccggcggctgctcctcctccgccgccgcagcacggacgacgtacgacgaccgcgcggaggcgggggtggccttgcgcttcgccaggaaccgcttcagcgacgccttcctcgcgatcggcatgtccaccagcgcgggcggcgcctctggcgcgccgccgccgccctgcgccgccgacgcgaaccgcatcagctcggccgccatggccggcgtgcagcggtcgatcaccaccaccttcccggcgtagaagatcgtgaactgctgccccccg

SEQ ID NO: 48315 - DNA, 889 bp, Oryza sativa
tccctgacgaacacaccttccatccatgggaagtacttgggattttggaacaggcgaacgctggcagcagtctgaccttggggcaacgggttgtacagcagataactgtgcagaatctcatgtaatcgtggctatgtgacgggctgtgatcgccagagtttttatcacgcttattgtattgtttccgcaaccgctagcagtagatgcggcagccagttgtctggccggctacccaacgcttcaagccgaagacggtggcctgaacctccctcggggaccgatggcagccggaagatggcaggaaatacgacgacgagacgcatctcgtgcccgcgatcaattggatgccggaacgcgtgttcgcgaccacagctgggtctctccaagtccacgggaaccatggggggctagcttatagctctcgagtcacgagtccagactcgatcatccacaaccgagtatggaatagtaggtagcagagctgtccagaaaaacgggagcacatgaacgtcgacgcctcctgtttgggcctcacaagtcgcgtcacgttcgttgggctctcaggtttttggtaagacgggacaaacgttccgcgagacacacagctaggtacacacgtactacgtacgtagcgtcgtcacacgcagcacggctcctatttatgtacgtaccagccgcacggccgtacaatacggatcacaggatgtttgcctcgtactaatgtactccgtactgttcttcggaggtgctaccgttcataaggaaaaaaaatggagaaaaaattatgcaacttgcggtagaacccagtcagtgtctcatactttccctcgcgaagagggaaatgagaaccgtactcatttgcgaattgcgatgcggattcaactagctg

SEQ ID NO: 48316 - DNA, 1750 bp, Oryza sativa
tcctcgcctccggtcaccaccgcctgagctcgaaccagcagcctgagctcctcctgcagcctgtcgagctcgtcggcgcccgccgccgccgtcgtccacggcgtgccagaaccatgacggcccttcggtccccctaacgtgcctatggacagcatcgccgccgcccagccgtcgtcgagctcgtcgccgttccggtggagatcaccggaggtatgagcgcctgcaagagatcaaagattcagcaacaattacgtgactgaaactctgaaacgctgggaattctgaaaggagaaaaaaaaaaccatcgtcacttacgtcgagatgacactgcagtgtgatcttgtttcctcgtcccgtggagccttgtctgcacccagttcagagcctgaaaccgaagtagaaccagcagcagcaacgattgctgaattagcatttgtcattcgatgtaaaaaagttcagaagaaccagagaatcgagtgtgtaccctcatgagcagttctcgtgacctcttgtgtgcgagttcagaagaaaaatgtggatgaatggactcaatgggaagaagaagatggatgatgatccaagactccaagttcactatatataggggtaaactctgatcttgttgcaactttacagaagcatgcgtatgcaggattggagaatgaagaatttctctctgactactacagtgtcaaggtgattactgtcacatctcacaggaattatggcagaaatgcagagctcaaagatgaatggcagcttggtactccttaacattccaaatagggatctggcctagttgaggagagatgaacagatattccatgtgaccaaattactcaggagatttggttgatatcttatcttaggataggctcatggccactgccatgtccagcaaactaggatgcaattttatatatcttgagctgtacacattcccagttgagcttgattggaagcaggacccagtaccgatgaacaaaattcttgattgcagctgagatgaaaagggaaagtcagtactagagggggaaattgcaccgagagccgagaaaagaaacattaagatagatcgcagtatggtgcttccaagaagcattgccgtgtgacaaacttagccacataaattttcaagtgtttgttgccatatcatgtgtttgctgtgttctgaaattgacggtttcatactcaaatcaggaagcaagtaagcaggatagtgggagttcttgtgtacttttttcggcgatcagtgtggaaaatctaatatgttgtattctgatgttttctgatatattggatcgaccctctcatggggtatatataggagtacataggggatagagacttggagtataggattctatctctaggactctatcttatctctaggatatatctaatctctatatttgtatttgactcttatctctaactaacatattatacttctaacattccccctcagtcgtaacgggagcaaagctaacgattgcgactggatttgaaatcttctatttcttcatctctcggagtcatcatcatcgattgcatctctgatggtcgttcctccacctggtgcctgcgtccccttctgtgtcgtcccttgactctcctctattccctcccgcagtcatagcgggagtgtcatggatgatagcgatgacacggacgcttttgactggagtttccatcaatgatttttgttgtagatgttcgtcgatgtagccgatcatgaagtagccgtggt

SEQ ID NO: 48317 - DNA, 711 bp, Oryza sativa
tatttctttttatgccacatgtagccaagcctcctcttgctctatacaggttcaaagtacgctaaacacaacacatacgcatatatgctctgacttttcaagctgaagtgttttatatgctagctacgcgttccacttgtcaatctcttttttctactctgaaactgcgcagagatgatcactccaacattttgactgtgtacttgaccatatcaaagtgctagcttagtatattaattccttttgtttggccatcaagttagtaattaattccaagttgatcatgcagcaacaaaaactatctgtcattaattctgaagaattattaatcctttaatttcaagcttgttcagttctgattgattggtttggttgcaggtgagggagggcagccgtgcacgatgctggtgaggaccctgcattgggtggtgccatcctactcaatctggggcttgcccttcttcctcttctactccactcgcttctcccagctcttctacgagaggcccaaccagggcatcttcagatcactcctctgccgcctcatgaccccattggtatgtacatactcactcgatctactcatttcacgtgaacatcttatcagaaattaagttcagaatgtgcatgctcaagactttgacaatattattttgtttgtagtagctagctagcttgtcagcatcataatttaccatgtttttttttggg

SEQ ID NO: 48318 - DNA, 711 bp, Oryza sativa
attcctgcagcccatttagcaggcttactattatatttgctctaacccaaaaccaaccagaccattttcccagcgttgtgatttgccccattcgcacgccaccaccaccggtggatttacaccgcatcgctgcgcggccgcacgacgcacgtgatcccccccacgcagccacgctgcggaggcagaggtagcgcgcgccgccgccgaaacaacccaacccaacccaacgtcccgacccgatcgaacaaccaccgcgaaaacagcgagagacgtgcggcgcgtgcccgcaatttctcgtctttttttccgcgcgggcgccgcgcttccctccgctcgcgtttcacgtgccgctttcctacccgagaaacaaagattatactaggcgtttaggcctcgtcttccttccttccacatgtacacctagtatataacaagagggagacaggctacagattcacgggaaggtttcgtcctcgtttcgtttcttgcagcaggaagccaaagtgtatttcccgagctttgatgtgagctagctgattttgctagagctacaacatggccggtagtagcgagcagcagctggtcgccaacgcggcggcgacgacggtggccgggaacgggagcaggttcgcggtgacgtgtggcttgctcaggcagtacatgaaggagcacagtggaagcaacggcggcggtggcttcttgccggcggtg

SEQ ID NO: 48319 - DNA, 704 bp, Oryza sativa
cctgcagccaacctgggcctccgcgacggcgacctggaggcgtcgcgcgccgcgctccaccgcttcggcaacacgtggagcggcagcatctggtacgagctggcgtacctggaggccaagggccgcgtccgccgcggcgaccgcgtgtggcagctcgccttcggctccgggttcaagtgcaacagcgccgtgtggcgcgccgtccgccgcgtgcgccgcccggcgcgcagcccgtggctggactgcgtcgagcagtacccggctcgcatgaacgcttaagctgcagtggtaagtatgcagaggctaatgaacggaaaattactgcaacgtcaaaagacgggatcggcatgcgatgccggttaaggttcaagcttgattaatttgtgttggtgtattagcaagtcggtttatgagccatagactaccataaaagttgtgcgagacatgtgtactgaaccagtgtacgcgagttcggtgatatgtgaacttatctacgtttgattctattatttatactgtcatatgctacttgaattaacctggtggctgtttattaagtgttgctgcaatggactgatagttgttcaagtatatgtgttttatttggtccctggactagcaagatagggagcatagcacacatttcctttttttaatagagtaatttttacaaaacttaatatatttttatcaaactatcacaa

SEQ ID NO: 48320 - DNA, 2761 bp, Oryza sativa
attcctgcagccgacttggagtggttacaggtgtacaagggattaataaagagatcatttagtaatgaggagttagtaattaattgttgtggggggagcggtggcccaccggcggccggcgggtttgggggccgtggggctcgccgtggataggacggcggccaaggttgatttgaatagactaccgagatgtgagatctactactctcttcgtaaaaaaaataatgaagaaatatgacatattctaaacaacgaaacaaatctgaatagaaatttatagaattaggttgtatcgtatccagtactaggatacgtcatccgctcctaggttagtatattctgagacggagagaggatacgtcatccgctcctaggttactatattctgagacggatagagtattaggttggattttttaggacggagtaaacggtttacgaagtgatgtgaaatcgttgtgatccatttgccagggccctgaaacaaacatggttaatgattgtccttgtcgaaagcattcgaggtcatacacgttcggctaggatgagcggttgtacggagtgccaggtgaaagctgttctactactcccaaatcaacatgaggctcgctaatcatacgaatttgaattccaaaacaacaacaaggctgtgtttagattttaaaaaaatttggcaaaaaacatcgcatcaaatatttagacacatgcatggatcattaaatgtggacgaaaaaaaccaactatacagtttgtatgtaaattgcgagacaaatattttgagcctaattgtgtcctgatttgacaatgtggtgctatagtaaacatttactaatggcagattaatcaagcttaataaatttgtatcgcagtttacaggcggaatctataatttgttttgtcattaatctacgtttaatacttcaaatatgtgtcagtatacataaaaaaaattggccaactaactgaacacggcctaaacttgaaagttcaatccatccaacacatcataccgtgtagacagacaaatcagtctgaggaaaaaaacgagacatattatttacgcatgatcaattccagtattatatttttcctttataaaaataccggggaaatgctgctatctgggtgactggacgggggagcaaaatcgggtgctccccccggccccgctccccgcgcgcggccatgcgcctgcatgccgctggcccaccatgtgtctggcccaccacagtgcctgcccctgcaacaaattaaccatatattttggaaactctctattaagaaaatttggtttatttttttccaccaaaaatatttaacctagtgcactcacaatgtttcactatgtatagatctaatgttgcagtaaactgagatattccattgcaacaaaaaaacccacatattttggaaaccccctattaagggaattcgttttattttttgttccatcgaaaaatgtttcacctagtgtacttataatgtttcactatgtatggatcaaatgttgcagtaaactaaaacattctttcgctatttgctgaaacattgtttttatataaggtgaaacaacacccgatttaaacgagtgaaacattttcgatgtacttagtgagacaatttcgatatacctggtggaacatcgtgcaacatttaaaaaaaggctaagttggttatatagcatcgaaagttcacgtttttggttttatagcaccgaaagttaccggttcactttaatagcatccaaagttcaccttgttcccatttttagcacttccatcaatttttccgtccgtcttaatcgttattgatccagccacacacatgatatgatatttctacccctcattgacatgcattatacttgtacttattaggggtagaaacgtcatatcgtgtgtgtgactggatcaagacggacggaaaacgatcgagaattgacggaagtgttaaaaatgggaacatggtaaactttgggtgctattaaagtgaaccggtaactttcggtgctataaaaccaaaaacgtgaactttcgatgctatataaccaattttgccttaaaagtaattcaataataagctaatttttttcatcggaatatatccatgtgtaatcttgttttgaagatttaattgcaacgaatttaatggtgcaatcggatcatgatttggataagtaatttaaaagaaaaatcagtttaaagtagttttacacgtaaatcggaggcgattttactccgaattgatcgggcgcccgagcctaggctgccccaaaataccgtttaggagtttagcaatttgctaacgaaaaacaagaaaattgtaagtcgtcgttggaggttagaatggggcctaagccgaagtgtcagatttggagcccatctggagaacgccgtgcatgatgggccgcggtctgtcatttatgggcctatctagagcggcccatagccccgataccgggccaggccaaagctgactatgtgggctgcatggcccactcgccgaatttcccccctctctctctctctctctctcacggcccatgtgctcgcaattaccaaaactttgcattgtggcctcgtcctgtaaatgacaagggatcagatcaagcgctgcaacacaggcacatggagtaaaactacttcaatctcaaccaaaatttatgaaaaccggtatttaatatatttttaaaaatataaaaacaggtagtatttgaaatctggagggcaaaaacagagtataaaacctctgatgcttttta

SEQ ID NO: 48321 - DNA, 6941 bp, Oryza sativa
  unsure (1)..(6941): unsure at all n locations
cccaagaaaagcctttttgcaaatgcagctagagtactttacttgactacctaaagcccctttgaaagcagagtcttcttcttcttcttcttcttcttcttcagttcatcttgtggatggatggatggaatctggattcccatccttgctccaagatgcttctttttcatcttttcccaactccacttttccattgtctttgacatcttcaagcaccttcccttaaaaccctttaaagctcaccacagtccacagcagcagcatagatccccctctaaccttatcccaatgcatgtgttttaattatagtactccctccgtttcaaaatatcaggatttctagtatttagtttttaatactcatataagcattccttctctgatttctacaattcccatcatttcaataattccaaagccaattagatgcttggaaagagaatctatgcaattcaaaatttaaaaattgacaactaaaatgacaaaaaaaattgccctaaacttagtattttctaaacaacctataaatccttaatactccaaactccctttgttttaaacgagacaacaacaacttctgagcctagaagtttattctttctaggacggatggtgtattttggaacagagcgagtagtaagcattttgttttgttttgttttctttagctatacctcttgtttgcagccagccatggcagtatctatctccaaatgattggcttgggtttatgagcccaagcttctgtctcctgcagtccatactctaggttccaagaggcaatgcgacaagtgattggtggcatgaggtaaagagaacagcagtaaggtggtgtttggttggagggactaaagtggggctaaactttaatccctctcacaaaaacaaaaacagtagtaaggatggatggatgcaatgtgtgttcagaaatgacagcagttggactctgaaatttgctgcaaaggtagctagtaggggatactcctatataaagtggtcacagaaagatttgtgccatactactccagtcaatgcagtgcagtactcatcttgtcatggaagttgggacactgcgtagcagctgcaggagtgttcaggtaaaaaggatttgagtcagagttcaggaattgttctcctgctagtagtacagaaactagcaatcctctgaattcgtgtgaagcaataagccaagaaagatctgccaagacaccactgcatatcatgatatttaatctttgcagaaaagaattggagatgaaaacgagcttgcaaaacagaaaagaaaaaagttcttcaatctgaaatgacttgacattgtcacacttcgtcagaattactgtactcacagttccatacttccatggcgatccattggccgatagcccgatatatcttgtgttgcaccgggatgaacaatacattggatggattgttcatggctccttgtggtacggaagaatcgattcgtaaagcctatactcgagaaggctgatctgcagctaggcaaagcatcaaacattgtacagtagaaaacaaatgcagagaaacttgagaacgaatgggttgggttcagaggcagccaagccaaaaacaccttgtagaagcaagagagaatcatgcagtagcatttcaggctttgattaacgtggcttagcatctttgatgtcggggaaaagatgggttgctaatctaatcaatgggattaaaacggtaacgagagtggttgcctggtcaggcaggttctgatttctgaaactttagtttgacaacaggtggcctacttctcgaagatgaccgtggaccagtgtttttttactgctagattactactgtactagattacactaatgtgaatgaggatgaaaaggaaaagttaatctcggaccatatgaggaatgttttactgctaatgcatcattcgttatctttctgaaaaggcagactctgaagaaactcgttctgcatcgaaccaaagtttctgatttgcaagtaatattcagtgttgcaagttgaattttttttagataatgaatgttgcaagttgaatacactaacacagtaatagatgcggataaattatataaaaccgccaaaaaaaatatttgaacctactaaaagagaagacttttaggcagacaaacaagtcagaacaatgcagtgacaagaagactagaaactgttcagagtctcctctgatgcagtttattcacatcggtttttacaaatgcatctgcttatgatgatcagcatctaaaaccgtcatcattatctaaaaaatctaaaaccgtcggagctcaatcgaatctagacctaaaattttcaagtcccagagagagagagagagagagagagagagagagagagagagcaatcatctcctctcttttctttaaccatccatccatttgcaaagcaaacaaagcaaagcaaaggaatgtcaatcgatcatagctaagctaagagctggaggatatgaggaacattcagaacccaaatccgaatcgacccaacaagagatatgatttttttccctaaaggaaattccctctcttttcgatctttccacttgcattttctcagctttgctgctcatcaatcagagaagaagaaacaaagttggatggtgctttactctaagaaccttaaccggtgacaattagcatcccgttggattcctaatgagcaatggccgttccttttctgcatcgctgcccacattgcattattctcctccttagcccccccaagcatatgcatgcaaaaaccgcggaataactaagggagggcccacatgtcagtgcgctctgttgctgtctacactagatacttacacacgcctattatagagacatgtctcgagcacattgtattctcagctgatagtgaatactgtagatctttttttaaaaaataatgggtatttcattgagtgacagaattacgggttgtttggttcgggaccttaggggttgtttggatgagtgccaaattttattgcccttgtagcgcgctttggcgacttaggactagttcggttatcagaagtcgggccatagatgttcaatctctgacaccctcttacaagactaagttattaatctcgctatacctttttaagtcattgatgtttgggatctagctagtttgttatagggtattttgtcgtaactatggctacaaccaaacaaatatttaagttgcttgcttaagctgagacgtggtaaaatatggcaaattatggacacaaaccaaaccgtcctatctttggcctcgtctgtatgcagggatgcacgtatgtaaatataaaagtagtggagtacattgtaaatcctggtgtacatggagttgtaaccatagttctacttttctttcttacttccatgtgatccggaacgattttccaagagaactgacaaaaaacacacacagcaagtagcagtagcactgtcatggatggaaccgaggcaaaattcagaaatccgaatagcaaacaccaccaaaaagtacacactcaacactggagaacaaaaaggaaaaacttgggggtaattaatcaaaacctcggtccatcgatcgatcagatcagaccatggaatttagagcagggcaatgcaggtaattaaattaaattaaccaatcaacaagatccatccatgctgacgatcttgttccagtacactcactgctcattggcccggaggccgaagagaagatgggggcaaagctcgctgggatcatttggtgtggaaaggcgagcgaaaaaaatgggaaaagaaatggcagctctaggactagtatcagctggtggtattgtatgcatgggtcggagagaaatgaaaagaggaggaagacgatgagggaggggaatattcttggcgtcgggccagacaaaagggatattcagaggacgattttggtcagggaaggcaggccaccactgaccaaaccacgcgtgtcacgacgacaaagttgcctcaacggctcaacggttagacccagggtttaacttatcactaatttttcaagtgaaaacagctccttactgatttgccaaaagctgataaaaaaacaaaaatattcgatcaataccgtacgaaaaccggctaacataaaccgatttttcacaaacgaaaacttagtgcaacatttctatgaatatatacaaaactttctatgagacatctttgaatttccgatcaaatatgagccactatgtatagctttgtcatccttcttgtaaaacatttacagaggcggggctcctattaaaaacgtcagctgtacgaacaaatcattttatcgatggaccgcttaaaaaggtcacatgtatatatcatttccacgcaagattatatccactagcggcttcttgtccacctgtggaaacaaccattttcacatgcctttacttagaggcgggcacaaaacctgcctatagaaatgcattatttagcccgcctaaaaaaacgtttaattccgtatgtgtagggataagtgtacatatcagaacaatttttctaatgctacaaaacatgtaccgcaaattctttaagtgcttgctccgtaacatattataagttgttttggttcttttagtcaaactttttataactttgactaaatttatcgagaaacaagctgacttttgtaataccaaatcagttccattaaatataatattaaatatattttgattgtatgtttggtattgaaaatattgctataatattaaatatgttattgagataccgatgtcatatcttaaactttacaaaattataatggtatggttccaaattaccctatttttaataaatttagtcaagcttacagaagtttgatgaaaaaaataaaactacttagggtgtgtttagttcacgctaaaattgaaagtttgattgaaattggaatgatgtgacggaaaagttagaagtttgtgtgtgtagaaaagttttgatgtgatataaaagttggaagtttgaagaaaaaattgagaactaaaccaggccttataatataaatggagggattacatgcctaaaaacatgtagcgtgagtaagaccaatgaattcatgcatgcatagacaacagatgtgcaagctagtgttcctgtacacacatgcatgtattggtctgtaccttgtacgcgaatattcttgtctctggaccatgcaaatgtatatgcatgcatatatatacttttggggcatgtacatgtacggtgttcaggtacgtagatgatatacgtatatacgtatacatgggctagctatacgttggatatatagcatgcagtacgacgactgcgaccatgccgttcgtacagagagagagagaatccatggaaaaggtagggattggagtcttgtacctcaagattgccccaagaaagcgaccaaccctaattattgcacagggaattcgatgcactaaaacacacacacacacacacacaacacctttctcccacctcttcttgtgtgtatgaactagctagagagagaaatcaagagagagagaatcttcttagcttcctccccaattcctaaaaagccaagagtagtagcagcagggagattctcacattctccttcccttcacccctctcttctctctctctaaaggacaccatgtcttcctttgtggtgtccttttgtgcgtgtgcttcatatccccctccaaagccttaagatattccttgcttgagccatgctgatatattcccttgtgaatgcaaagtgtgccagtcctcctatctatctagctatctctctatctacacacactcactagactaccatatgtgctataacagtgccacaacatgcatatacatgtacataaacacatgcatgtgtgaagaagaagagcacagaagaattttggagcttgtgtgtgaagggatgcagctcaccccttttcaaagcaaagagacctagggcatgcgatcttttttcatatctttggcttgaattatgtgtgatatatgcttttagtactgctttacccatttaattccttcctcctttgattaatcatgtaaagaatcttcacccattagaacatcaaccagtaaagagagagagagagagagagagagagagagagagaaaagaaaagttgattaattggcccttgtctgttggatgtgagaatctatgaatatcggtatcgataattcccggttgaaatttaggtactaatatagatttcttttgattttttgtaatgcaagttggggagttgggagagagagggtggtgtgattcccacagctaggtatatctggtgattatccccattgcaatatgctttaaaacccaatattaggtaaaatgtaaatattccccaagacacctagctgggttctcttagactcttgcaaggttctctttggactactttgagctttgagctcatctttaattcgatcccttgaatcagacgcaccccggcgttaagctttagttttcccctttttccctgctgcatttgcccggtagattcttagatttgttgtaaagttaaacttaccacagaaatgaggcaggcagcatcttgatctgtaaaaaaaaaaaaggattaatggcaaagaaagatacattgagatcatagcagctgatcagctaggctaaaacagtgtaatttgaacaggacaagaagacgtggctaacaaaagtttcagtttttcagtcacgcatgcatgctgaaaaacaaaactgcatgcatgcagtgtacaaacactgatcagagatattcagaaagcaggcagtacatatttgaatggagcagagagaaatctatatatatatatatatatatatatatatatatatatatatatatatatatatatatatatatagagagagagagagagagagagagagatctanagagagaatgcaatgcatggtgcaatatatgcaatatggaccca

SEQ ID NO: 48322 - DNA, 9771 bp, Oryza sativa
gccgcgctgccggagctcgcgctcgcgcccgcggagaaggcggcggacgcgatcaccatcgccgccggcgaggtcgacaagaagccgtacgcccacgacaacggcgtcgtggcgagatcgagagaagcccagaacggcgggaagccgccgtcgacgccatcggacgggcaggccgtcccgccgccgccacagccccaccggaaggcgcgccgttgctggtcgccggagctgcaccgccgcttcgtcaatgctcttcagatcctcggcggcgcccaaggtacagtacacctacacatgtaactcgatcaagatcgaacaccatgattacatgccgtaccaaagatgaaaagacaacaaacaaattaatcttgagcttgcgtttttgttttgttctttgcaaattaaagtggcgaccccgaagcagattcgcgagctgatgaaggttgatggattgaccaatgatgaggtgaaaagccatctccaggtagggtaattatcatctcatcatgcaattcatccatctcacgtacgttcttaattaaatactgtttaaattgatcattgactacaagacagtatgattaactgattgctagacatgaatgccataatgagcattttgatctgaatttttttttgtttgggcagaagtacaggttgcacacaagacggccgatgccgtcgccggcgccgccgacggcagcgacgccgcagctggtggtgctgggaggcatctgggtgccgccggagtacgcgacgcaggcggcggggccggccatctacggcgcgcacccggcgacgcagccgcactacacggcggcggtggcggcgcaggagtactaccaccaccaccaccaccacctgcagcaccaccccgccgccgccgccctggtgcaccaccgcgccgtagccccgcccccgccgctgccgcctcagcagcagctggcccctccctacagcgccaagtcgtcggcgtcggcgaggctcgggtccccggactccgacggccgtggcagcggcggcggcggcggcgccgccgcctccggagccggaagggacatgtccgagagcatcgaggaggaaggcgagggcgaggagcgggaggacgacgacgacgacgacgagatggcggcgaccaacaacgcccacgccgtcgacggcgacgacgacaacgacgagatcaacaccaccaccaccacgagcgcgggagcgattaactactaattaatcaaccaaaccaaccaatcaaatcaccacgcgtcgtaattaattactcattagtaataatactagctagtagcttaattaatcgcgctaatccgggagattaattagcgtcacctggaaaaagggaaaagtgattttttgttggcgcgcgcgcgcggagaacgggagccgagccgagccgagccgaccagagaaggagcaggagcttgagcttgtctcactcgttgatgtgatgcatatgtatggaactatggatcgatggataatgtgagggctttactttgcttttgcttttgctggtttttttttctccctcttgtttttcttccttttttgggactctcagctgttcctgatttaataatccggtagtactagtagtaaatatcaaaattatgtgatggtggagagattaaatatgagctagatgtaattgtttgggagattatgtttgttgttgttgttaagttgagaattgtgaagagccaccaataatgcataatgcagggtttgcttctgcaattaatgtgattatatgtgaatggttctaattaatagtagttgttatgttttggtatgcacaaatatagcatatgacattaaattttccaatgggataatgatatgcttggtggtaccaaggctgtgttcagaacctttgttccaacttctcttctcgtttttcgcgcccacgtttttctaaactgttaataggtgtattttttcaaaaaatttctatacgaaattgcttaaaaaatcatattaatcatttttttaaaaaaaatagtaaatacttaattaatcatgcgctaatggaccgttccgtttttcgtgtgcacagcttgtgctgggaacatagggttctgaacgcagcctaagtactccatccggcaaagattacttgatatttccgacagctaaaatccattaagcgcaagttattttgtttgtccgaaacgtcatatagtattatcgtccagggaatatattgcagctttaccgctgtagaagcaatcctgacactttgaaaagcaacagccgcatcgattttcaggaatttttgcgatggctattcagattcttgatgttttataaaagtctactggtcaaagttaatttagttctttattaattcttcgcataaataacacccttttcaccatattttgactataggagaatatttttggagacaaacatatcaactcggttgactcttttatttgcaagaactttgattattacacttttaaaaatgaactttgatgattacgcagtattacagcggttttagcctgcaatcaactgcaggcccatgaatacagttttagctatactagtgatggaccattatgggccaggccgtatttaacagccgtctcagaaaaggaataagtttatcatgacttcctcactctcgctcctgattgaattgcttccctcaaccgtaaaaccaggtataatacatctaccatcttcgaaaaccggttcaaattgacttctttgttggttttagaaacggtttctactgacgtggtatgttggcagcatcaacaggtagagcccacgtgtcagggctctcctttattcccctccttctctccctacagtgggagactgctttgtccccaccctcttctcttcctgcattgggagactactttgtcgccatggcccaggtcaacgaggcactcgaggaccaggcgcaggtggtggccttgtcggcgtgtacgacggccataatagccccaaggcggtgtagttgatcaacaagaggctctcctcccacatcgaaggaatcatccaagcgactatggtggcgagccaaacctagaaaggtgcagtgatggtgacgaggtaggagatgagaagagggtggcgacgcaagggttccaattgcatcctccaacatgtctcgtctctgctaccgtctatgacgagagagggtaccaccttcctcggctcgtcagtccgacttgccaccaccaaagccctctccggagtccagttcgccaccaccaccgtcctcttgctgttgaaaggtcggagaggaagaaaaggggagaaaggtgggttagcaaatgaggtaagttattgacatgtgggtcccaagcgctcaatcaacgagtcatccgtggtcaacctaccgtgctaggtgaaattgcttcccaaactattaaatgagtcgatttgcactaattttttttaagtcggagaagacattatacccgttgttacaattgagggagacgattcaataagaatcaagaaatgagagagagaatataatttatttcccaagaaaaacacatgcatatactactatttctgggccgaaacgagttgagcatgatgccctcatcccacctgtccgatcaaataacaacgctttatattcggcaccgaaagattgagaggaaaactaacatttttcgcgggtacgtttttcaaatgatttaacagtacgtttttattaaaaaattaaaaaactatattaatatatcttttaaaatttgaatacgctaactactcatcatttacgatcttctcacatcctctcctctcaaacaaactagattcgtcgctgcaacccaacggtctccgtactccggcgagccgccgtcccgctccagacgcggcgcggccgtctcctccggcgccggccaagatcgaggtggatagcaacactgcaacacacataactctagaagtaattaaatatctctctccacggccacgtgcggccatgtgacggcgcgacgtccctctcgtggcctcagccgccctgacatggcacgggcttccccgtgcggcgagcggccggccggccgcgatgcccgccgcggcggccgcgcgcgccacctgcgtcgcttcgtcaactcccccatcctcacctcgctgtaaccctcacagttgcgagataatctccgaaatgccactgctcgtttgtaccgagacgatcctctcacagtggcaatcctgtgataagtcactctgatcaggggcattctcggtgatcaagggtgtaaccctctgtttctgggtcacttcgtcgcaaagtcaacccccaatactatactagaacccttgattgattcgatgatgcagaaggggaattaaggtgtggaaaaagataatgcgggggaagcatccatccatcagtgttgttcagtggtggtagattagattccagctgatccaatctggtccgggaattttttctagatctgacaccacattctggtcaaattcagagatccatgctgctctagtctgtactagagccgtccttggtgaacagttcttcgacactcacctcactctcatcgaggtctcccagcttgaggagcactgaagaaatttctatgttgaggtcagtgatctgatcatctgatcatgcaagctgaacaggattagttagatatgctgcagaaattttattagattttttgcattcttctgcaagtgttactgcatagttgtgttcatccaagttgatactgatctgatcatgcaagctgaaaaggattagttttactgcattgttgtgttcatccaagttgccaagaagtgtgaagattttgatgtcaatcactcacttggtcaaatttgatccaaagcagcgttgctaaattcatctgagttcagattgcgagtttgtgacattgggtttggttttgcgcagcaatggtgtcaagaagtctgcagcttgtcggcgcgttgctgctgccgctgctcgccgtcgtgtcgtcgtttgatccgttccaccgtgatgcgaaccccatgggcggcggcgccgggcagggccccttcatcccccacgagtacgtccgcttcgccgacgtgaagcggcagtgcaagtccgtgctctcctccgcggcggagctcacgttcgacgccaaccgcgccaacggcctcatgccggagctgtccttcgtcaagggtgactggaagcacgacggcgacggcgacggcggcggcggcgcgccgctgctgccattcgacggcaccgacgtggcggaggacgccgccgccggggcggcgcgcgacccgctgccgctcgcgtcgttctcgctcacgcacgtcgacgcggcgcggcgcgggaggacggcgctgaacgtgagcggcgtgctcggcgtcgccatctcccgcaacggcaccgggccggagatggggccgtacgtgtcgccggagttcaaggtgtggcccgggaacaccgagctgaaggtgctgctcgagggggtgtacaccgagaacgacgacggcgagagcgtgctgtgcatggtcggcgacgccgtcctgccggcgcgcggcggcgacgccgccaacccgtggggctgggccaagcactccgaccgcgacaggttccagccgccgatcaccaaggacggcaacatcctcctcgtgctccgctaccccaagacgctgacgctgacgacgcgcgccgtccacggcgagctcacgagcaccaatggcaagacccacgccgcctacttcgacgccgtgcacctgctgtcgcagctcggcgcctactccaactaccagttcggctccgaggagctcgtcggcacggcgtgcaagccccacccgtaccgcgacgacgtcctcgccggcggcggcggggacagggggctgtacaagggcacctccttctgcggcatcctcgacaggttcacgtcggaggacgtgctcgccgtcgtgccgaactggaggtgcaacacgacggacgacgcgctctgccggcggctggggccgttcgagacggacaaggcggtggacgccaccgacggcgggttcgccggcgtcaggatcgtgatgcaggaggtccggtgcgagccgaggaccgacggcggcgagatctcggcgagggtgtcggcggtgttccgcgccgtcccgccgtgggagcacgcgtacacggcggcgaagcgcagcgggctcggcggcgcgacgatgtccgccgagggcgtgtggcgcgcgtcctccggccagctctgcatggtggcgtgcctcggcgtcggcgccaaggcgtgccactcccgcgtgtgcctctacctgcagaccaccttctccgccactcgccgcagcatcacggtgggccagatcaccagcatcggcggcggtgccgcccacttcccgccgctgacgttccagcggacggtgcacccgatggagctgtggagccggttcggcgtcaccggcggcgagccgctgagcttggcgtacagctacaccaagaccaagcaggccggcgagttcctccggcgaagcgagccgttcgacttcggcaccgtcatcgccaagtcgctgctgagctacccgaggaaatccggcgacgccgccgacgagacgacgagcctctccaacctcgccgaggagctcacgctccacgtcgccgccgtgccggatccgttcccacgcggacgattcgagcggccattccttcagcttgaggtgctctcgctcggatcgctcgtcggccgggcctcgccggcgacgtttccggggacgccagctgcggtagggcaaagcatggcatcatcatcgtcgtcgacgacgacgaagctggatgcgacggctatcctcaacgtgtcggcggagctgacgatctccggcgacgcgtacgtgaacgtgtcgacgctgtccttggaaggcgtgtacaacccggtggatggccggatgtacctcatcggctgccggagaatccaggcgccgtggcgagccttctcggcgatgggcggcgtcgaggaaggcatggactgctcgatcgaggtgagggtggagtacccgccgacgacggcgcggtggctgatcaacccgacggcgaaggtgcacatcgcgagcacgcgcggcggcggcgacgacccgctgcggttcaacgcgacggcgctccagacgctgccgatcctgtaccgggaacagcggcaggacatcctgtcgcggcggagcgtggaggggatcctccgcgtcgtgacgctggcggcggcgatcgccgccgagttcagccagctcatgtacatcaagtcccacaccgacgtgatgccgtacgtgtcggtggtgatgctgggcgtccaggcagtcggctacagcgtgccgctcatcaccggcgcggaggcgctgttcgcgcgcatcgccgcgtcgagcggcgacggcggcgcgacgccgccgccgtcgtacgaggtggacaagagccagctctactggaccatcgactgcgtcgtcaagatcctcatcctcgccgcgttcctcctcacgctccggctggtgcagaaggtgtggcgctcccgcatccgcctcctcacccgctcgccgctggagccagggcgcgtgcccagcgacaagaaggtcctcgtctacacctccggcgcgcacctcgtcggcttcgcggtggtcctcgcggcgcactacgtgagcgtgctggcgcggccggtgaggtcggaggcgtcgtacatggacgcgcgcggcgaggcgcacgcgctccgggagtgggcggtgacgctggaggagtacatcgggctcgcccaggacatgttcctgctgccgcaggtgatcgggaacgtggtgtggcggatcaactgccggccgctgaagacggggtactacgccggcttgacggcggtgaggctgctgccgcacgtgtacgactacgtgagggcgccggcgatcaacccctacttcgcggaggagtacgagttcgtgaacaccagcctcgacttctactccaggtccggcgacgtcgccatcccgctcgccgccgtcgcgctcgccgcggcggtgtacgtgcagcagcggtggaactacaagatcatcagcaagacggtgaagacgcagcagaagaagctgcagcacctcgggtcgcgggtgtacgagcgactgccgtccatgtcgtcggccaacttcgaggccgagctcgtcgccggcgtcaacgagggcgtcggccatggcctccgccgcgacgccagcttgagctagctagctacactgctacacctcatcgatcaatcgcctctcttaattactcagtagtcttctcttgttgctttcttaggtttttatgatgttcttcttcttcttcttcttcttcttcttcttcttcttcttcttctttatttcttcttaattagatcttcagattcttcttatgatatccaaatgtactctactacaagttcaataaagttttagtttcttatagctctttgttcacatttctgcacttcttgtgtgtgtgttcagcttatgtgacacaaagtgttcgtgctgacaaattactttccgatattgcgtgctcttggtgaacacattccaagtttccaataggtaactagacaatgatattatttgattattatagattgtcaacgatgctaagatgattaattagcagtcttcttgtttgacaattctgtcaagcaagcttgcttgctagttagttaattactacactgatttgtgcttaacttctgccaagtgaataactgaatataatgcacctagttgttggttggtgtttaaacaaattaagcattctacctacatgtaggtgaatgagagtgtcagctcgagtgatatctcttgctcctgctcctgatgctggatagccactgctgcctctgttgctccactgtaggaggacacctgcagctgatcggagctgccgcctccgccggcgccggcgccggctaaacgctgaaaacaatttcaagaagagaaacaaatgaagaaaattacagtgaccagttatgttgcttttttaaaagacaaaaacactttttactatcataactagtactagaacaatgtgatcttgacattttattattattccttttgctgttgctgttgttcagttcgatacagatagcatgcagtacagaccagcacactgtcatgcatagcactgaaaaggaccatagcagaaaacagagtttttcttttcttggcaattaacaacagagttactaaaagcccatctttttgcttatacttacacttatcaaccaaaatttaaattttcaactttatgattttggagtttttttttcatcgaaatttattttttattatttacttttcactaagaacacgtatataaaagttttattcacaaattcttttttatttgcaaatataacgtcaaacgatgggggccttaggtcaagagataaaagaaaatgatgaggaaataaaccaaattggtgtgccaaattcaagaactaaacacaaaatatatgttcttgtgtccaaaatgaatgcaaaagagaagacaagagatcgatgaactcaaattaacacacacgctctgacctcgtcgtggcggcgcgagacgttgccgtcgtcgtcgacgaggtagccggcctcggcgcagagcgcccggaggacgtcgttctggtcggcgtgcttgggcagcgcgtacccggcgccggcgcgcaggccggcgtagatcctcgtcgccacctgccgccgccgccgctcccgctgccggttgttctcccgctcccgcgccgtcgggtgccgcagcgacgtcgtcaccccgccgtcacgccg

SEQ ID NO: 48323 - DNA, 24805 bp, Oryza sativa
  unsure (1)..(24805): unsure at all n locations
ttttcatcccaagtactcccaatggtttcatgcccccatttggatctcctctctatatcaacagcctttctggttaagctagccttcttgtctccatgcatccagatgctgcaggttcagtagtgacagagacacagagtgagtgagtgagtgagtggagcctagagaaaaccagcttacaattgcatgcatgcatgaagggaattgatgctgtgcatgcaacagtccaatgccagtatgccactgtgctagtgtgcatgcatatgtggctctcattgcatatgcatgcaaaaatcataaccaaattgtatctcaggtgttgatctttcagtttcctatagcaatgcgtgatatttgaagtattgttagtcttagaaatttcaggatggctagtgtcatgaggatggattttcatctctcgggtggacatccacccgagtgtttaaaacagtttcccctagtgtcattgattagttgggtggtcaaaaggggagcaagaaccaccagattttgattgctcatgagacatgtgcattagaatctataaaattctcacgcatgcttgcttacattttgggggtcacggttcaggtgtgccacactcacactggtttggttgaactatgatgtgcaattgtgcatgcatgcatgccaactgagagcaccagccaacaccaggtagatgaaaggatataaacacgggtaagcaaaattatcaaggaagcctatgactaggcagacaagtatttaatttgagcaaagttcagcatgatccctagctgtatttactgaattatttagcagtttttcaccccacgtatatgtgagaggcaaatggccatctctgaatttttagattgtttttttggtttgtgaataaggctatatagtacattgcacaatgtacttatgatctgctagtgtgtgttggtagatgagagggttcttcgatgggatttaaccacatatgctgctgtgaagaggtaaagacaaacatagcaggacaaggatataaagtaaaaaaggagattaccacaccatgctgcttcagaagttcagacacgctctggctgctgcatttttcctgggccaatccaaacttcagtttagctcacctagctttcagtgttatacagaattacagtttactgcacgaagaaccttcatgtattcactgcacataggaggtttctaccctgcagtaatagtagtactaagtactgtaactttggttagtcagagtgtcagatgctcatgccaatcgatcttcatcatgttcatggcatgcacattgctctctttgcccacccctgctgaacatgatagagaaattcatcacttaccgtgctgccatttgacagaaaatatctcttcagctgatcagctcgccaggaaaaaaaaatctgagttgatttgctactgaactgcacagcactgtaatgataaattacacggtctctttgcttatagccttaatactgcagtactaggagtaacaacaactatatgcactccagttactacaagatcgaaccagtaatccggtataccgccaaaatcgccacgtttcacttcgggatttcgaaattgctctgaattcctgcgaatgagagaaccatttggcaatttttaacttgtaagcaggagcaaacgaacatatatgcaggaacaaaacatcacgactcaaaaaatgaaagatggtaaaagcctgaaatgtaatcagaaattgttctcttttctacttttctcttcagaagttcagaggaagtctctctctctctctctctctctctctcacacacacacacacacacacacaccaaatcatgtcaggaaaaaaacaaagcacattcccaactgcttgtccctgaactcccggttgatttgattctcctttcctcctcctgctccacctgcacctaggtttcctgggattacgcaggaatttactctgctcccgggggaagagaagagaattttacagctactccagtctccaggcttgcagcatctgatctgatgactgtctgtgagctgcagttcatccggcgtctcagtccaaatcgatccaatcaatctcattctcgtggctgttcttggtggtgatgattgggcgggaggaaattctcggcgccgcagccttcctcctcctgcttggaacgccgcgaaaggcgtcggcgccatgacgtctgcttcgtcagaatcgcaatggagagagagagagagagagtcgtcggctagctccatggatcgacgccgccacgcggactgcggcaggaaccctcgcttcgccggccggctccccgccgccggcctgaggaaaagttaggttttttttttggaaaaataatggattcttaagccttctacttttattttttttctaatcaaacttctttaaattaaaaaaatgacaacgcatacaacaccaaattaattttactaaacctaatatttaatattttgtgtggaattttttatatttttctataaacttattcaaacttaaaaaatatgaaaaaaaaaaaaaacgacttatatgaaacacttaggctgctttcgttgctgggagattgagagagaaaacacatctttttcgcgcagacgctttccgaactactaaatggtatatttttttggaaaacttttctatagaaaagttgttttaaaaaatcatatcaatccatttttaactttaaaataattaatacttaattaatcatataccaataacttacctcgttttacgtatctcttttccattttcctcaaacacagcttagggcttgtttggggagctttagattctgagaagcagttgtttggtagccagcttctgagaatctggaaaagctctgaaaccccgtttctccagcttctggcttcttaattcatttttcagaatatgtaactacagattctcagaagctgtgaactgtttggggcagcttctagcagaagcagcttttgggaaaagctgcagctgggataagctcccccaaacagggccttaggctcctcttgattcaatggtatgcactatgcaggtatattttcagcgcactcgaaacaagaaaactcagtagcacataattaattaagtattaactattataaaattgaaacatagatttatgtgattcttttaaacaatttctacatagaaacttttagtaaaagcacactatttagtagttcgaaaagcgagaaagttaaagtttggagatgagaaaaggtactaaggcctaggtactctataggcttaaatacgctaaataggcttaacatgttagcccagcccaagatgtttcctgcaagaaacggtgggcctgaacagagcggccatgttagtccgagaccatttgcgaattaatgggcttctctgaaactctgaactttttccttccttttttttttttttgcggggactgaaactctgagcttttgatgtgcttcttttcttctcgtatcctatcatcagttcagagaagttcaggtgcgtgtatcaaacgaagaagaacaggatcaccgtccttttctggtcgttccatcacacattcacattgccaagaagacattttcatcgcttgtgaactctgaagcctgaacatttactagtactacacgggcgaggcgatggttttggtttttgtattgttttctgcaggcagaaaacaggtctgaacttttcctgtcacgcactcacacgggaatactcctggatatatactttcagagtcaaagaaatacgagtatttgcaagtttgagccagtagtaaaatgatgaaaactgagacaagacccagcttcagccgataagcagtagaaaaagcaaattacaaacttggctctgattgtttgaaagctcgtgccggaaaacatgcctccgattgtttgatttgagactaataaaccctagaaaatgagtaatccatatgtaaaacttttatatatatatatatatttttaaacggtttaaaatccaacattaaaaggactcaaaatcaactttaaaactaggttctactgtaaacttcaaatttggctatgctgattagataactaactactccctccgtactaaaatataagagatttagggatgagactttttctaatactatgaatttggacatgctctttgtctaaattcgtagtattgtaaagtgtcacatttatctaaaatctcttatattataggacggagggagtatcacaagctaaaaaaaaatcctaaaggccattttggtttgatactaaaaacataccctaccaatttgttggcaaattaaatagtatatatgtattagtttggattgagactaaatgtttgttagtgcccctatcatatttagtcatattctaaaagtttctcaactataccgtgagaatttagctttatattggtagcgatctaaatgctagctaaataattttaccctaccaatattagaatttagctttatattggtagcgatctaaatgctagctaaataattttaccctaccaatattagaatttagctttatattggtagcgatctaaatgctagctaaataattttaccctattaatattttggtagtgccaaagtttaccaataaattggtagagtaaagaaccaaacaaaccctaaaatcaactctaaaattgtcagcactaaaattaagtttgaagattttttttcttttttgataagctgactagtctaggccctattgtttagattccaacttttttcttcaaacttataacttttctgtcacatcgaaattttctacacataaactttcaacttttccgttatatcgttccaatttctttaaacgtctaattttagcgtgtaactaaacacagcccctatgtctgatttggtgggcgttattagctgatgccttgatgagctgattaactagcattgtcacatcaaacctctaagcacagtgaggtcaggccggtcagtggggtgctcaactgcagcagcagcagctgaaccaaaaccaaaacagcccaaaggttcgtcagtattcgtactcttcctctagagagttcagttcacacgcccaagaagtacagtacaccatttgactgcaaaaatctactgctagtaggagtgtggtacttgctagtacttctacggctgtgttcgcatgtggatgatgggaacatagtgtctccgcacggaaaacggagcgatctattagcacgtaattaattaagtattagctaatttcttttttaaaaataaattaatttgatttttaagcaacttttgtatagaaactttttgtaaaaaatacaccgtttagcagtttgaaaaacatgcatgtgaaaaactagtgatttgggttgggaacctggaggtccgaacacacccgtaatgatgatgaattttgggaaatttcagcactcacaaaacactcgaaggctggaaattaggctgcctttggcagtgagctttcccaacttttacccatgttttccccgtgcgagttttttaatcggttaaaaggtgtgtatttttttttgaaaaaatctatagaaaagctacttttaaaatcatattactttattttttttaagttagctttagttaatccttaattaattatatgctaatgagctgtttcgtttttttatgttggagggaaaggttcccaactcagggcaaccctatgtttatgactttggccgtgtttagttccattttaatttttttaaagtacaaggacacacatttgaagaattaaatgtaactaataacaaaacaaattatagattccgcctgtaaactgcgagacgaatctattaagcctaattaattcgtcattagcaaatgtttactgtagcaccacattgtcaaatcatggcgtaattaggctaaaaaattcgtctcgcaatttacatgtaaactgtgcgattggtttttttcatccacaattaatgctccatgcatgtgtccaaacatttaaagtgacggaaaagttagaagtttaaaagtaactaaacacaacatttgttcaggaggatgtcaaaatcaacattattaaattttttattcttaaatgtttggcacattttaacggtaccaaatttcgataatgttggataagtttagttgatagcctgatcaaaatttggtagtattttttataggaaaaagtttttgaaaataccaaaatttactaaggtgtcaatgataataaattatttaatttgttactttaccaaattttgtgacacggagccacggatgcagtgcactactccctccgttccagaaaaagaccaacncctagtttccatgtccaacgtttggctatccgtcttatatgaatnttttttataattagtaattttattattgttagatgataaaacatgattaatactttatgcgtgacttgtctttttaatttttttcatagtttttttaaaataagacggatggtcaacgacacaaaaatgtagggtttgtctttatatatatatatatatatatatatatatatatacacacacacacacactaaggaagtaagtacgagtgctacacttgcctccattgaggatgagagctcgaggtggctagtagtcccagtgaggcgcatttctccaaatcctccaggatcacaagtggaacgctaagggcccctttgttgacgaaaaaaaaatcgaacacaccggtctgggagatctgcttagcttctgtgtaggtccaaagattgatgagatgcgggcgtgccagtcagtttgatcctgcaactgacaagatatgtaaacagcagatcaaaacagccgatcggctgacaagccgatggagtagttccagccggtagccaataatagccgatgccgataccagccgatagcgatagggtttaagcaatcggctatatgtccaatgtagataacgatataaaggcaatcggctgatgatgatgcaataaaataataatataatccagtataaaccaatcggctagcaatgatatgataaataagcatcgatccgaaggttaaagcacacatcggctggaggtccgatgtcatgaaatctacaagattagattaaacagtgaaacctttgttgtcatcggcgaaatccaacttatatgtatgtgtaatccttatgagccgatgcaacgtccagataactcaccggctgaaaccccgatgaaacccttattggcaatcaagaagcaggctagagattatggttctaagcacgacttagtagatcaaacttaaccgatgcagcactaagtatgaaaagaaacataatatctagatttttaggatggtaaatgtctgagctaatctaatctagcaacgcgatttagctgatatcggcagaaaccctaaaacgagaagcagccgatagagctaaattgatatgctaggactagattaatagagacatatgataaataggtaggcaaatatatcatccaaactagagcaatccaagaggtcgaatgtgctgatgcagccttgaatgacgccgatgtagatgagacaattgcctgggccgacggaacattggacttatcccttcgtcggagatcgaagacgatgcagccccgcgtcgggtgccaagttccgccggaacataaaaaacaaaagtagaagtaaaaagggtagcgatgcaccaaattgtattgatcgtagagatagattacatagaccccgggtgtacatatttatacccatgggttgatacaagtccttgtcggataagaaagaaactaacctaaagataaaaggaaaatataaagtccttatcggacactaaacacactttcctaaagataaaaggaaactaacaaactattcttaattaatagataaactgccatgccgcatcctttttaaactcgttcaattagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacaccctttgaatcacagggtagaaaaaacagaggaataggaaaaacacaggattctgacaggaattaaaatgtaaaacaaaggattgcaaaacacataaaaaaacaggaatggtcgtttgattggagcgcagtaaaaacgcaggaatcggatgagagagatagactcaaaagaatttttccaagaggttggagctcttgctaaatttcctccaaaatccacatgcaatgtgccattccataggaatttcataggatttggaaagcttcaatcctttgaatcaaataaccaaataggaaaattttctatataatttaaatcctataaaattcctatataaattctttgatttaaagcggtcctaagtaagggtggggaggttgctagctccatgtcgaacagaaagaagcaagagtctcgagtctcccactaggcgagggaaggagacacaggtggcacccctggtggccgcggaatgacggttgtgcccctggtggcgaggggtggcgtggggggcaggacggtaaatctgcagtggagggggaggcgactgggcggtgagctgatgagggaggggggcagactggtcgctgacacgtcgtcggcgagcgcattgaccgttcctcccctgccacccgccacgtggcccgtcgcctgtcacgatgtcacatgccccgccctactgtcctctcctgccctgccctaccggtacgtgctccgtctgtcccttaaaaaaattccatgatattttgagacaaatgaatactccctccgtatcaaatgtttgacattgttgactttttagcacatgtttaaccgttcatcttattcaaaagaatctgtgaaatatgtaaaactatgtgtgtacatgaaaatatatttaataatgaatcaaacgatgtgaaaagaataaataattacttaaattttttaaataagacgaatggtcaaacacgtactaaaaagtcaacggtgtcaaacattatgaaatggatggagtagtatttacgcttttaatcttaaaataaaccaagtcttgtatatgaaaataatactgatagatattatcttcgttccaaataggtactccctccgtactcatcaagatagtaacacagtctccaaaacacaactttgacttattgtttctataaaaatatttattgaaaaatgatatatgtatacttttatgaaagtatttttcaagacaaatctattcatatattttttacatttttaaactcaacaacttaagagttattcatgatttatatttctaaggtttgacttaaacattgtcctaaacgacttcctttgcgagtacggagggaatatccttttaggattcaatttttttccaaaatatttgtactctaaaatattacctctgtttcaggttataagaacggaggaactatttatcctatccatcttcttatattaaatttctccttgttataccctccaattgccactccgattctaaccatatcatttacagaaaagagaatattgagaagatacgcaaaacgatgtgagccattagtgcatgattagttgagtattaactattttaaacttcaaaaatggataaatatgactttttaaaacaactttcttatataaatttttttataaaaatacacgtcgtttaatagtttgggtagcgtgcgcgcgaaaaacaagttgttttctctctcgatctcccagcaaggaacgcaaccttagtgaagagtagtatagtattttaacttaaaccttaatttatgctaaactaacaaaaaaaaacaattattttgggatgaagggagtataacctaacggagatcctctgcagggtagtgctactcactgggcacaagggtttatgccttatagatccacgtgtcagtgaacagtactgcagagaatcctctttcaatataaccttattctactaagataagcatattatactgctgatgttggtcatcggagatgatcagcaaacatttactaaagtttcaaagaaggaaaagaataataaagctttaatactactactacacatttggtcctggatgaatggggaaattagggcttatttgaattaaaggatttttatgatgaggaaaaaaatggaggaatccaattcaaaagaaattctcctactatatgagcagtttagtttggatcatacgattgtttcaaagggatttcaagggataggaaaagtctctccacatcttcgaggaattctagcatggggtctaacctcgttgtttcgaattcttttgtgatttttaaggcatgttctctcctcctctctctagcaaattaaacatgtaatctcaattttctctcacccgttcgatatatccaaacacttgtgtttgaatgattcctgtagtttgattgcttggaggatttttcatgtcgtgacatttcaatcctaagttttcctcttcctgtattttgagtcatgttccaaaggaacccttaaagtggacttataactttcatcaatacatatttggtaactcatggtaaggagattggaaatttagagtaataagctaatgaagggattgatcctgtaagtttcatttttaatctctgtcgtttgataggagatatgagaattatgatgaatttgagtgagaaatgaattttaagtgatgatatactaacttatttttttctctcagttacctgcctctacccaaatattgaaaagacgagagttcgctcttaaaactcctcacccctcaaacttccatcatcttcaaacattccccctccctcctaaccaaacactccctcagcgttctgaatgcaacgtgctattcaattaatcacagaatataactttgactgacttacaaacttagtaccagaaggggataagaagtgaaatccgagtagaaatagggagattcaaaatcacatataggaaagtaagaataaccaacaccttcactcttggataaacgttgtcacaaaatacgtaccgtcaaattttaaaaccttaaatggccaattaataaaaacatcaaagttttacacaatgatgaaatatgtctgttatacctattgatagtgagacatctacatgattttctttattaaagatatgttggtgcaatctctgaaggtgctctatgcacaagtgtacatataagtgcatgcatctgtcatgtgttaaaaaaaagctcagagatgatgagatatgttcattacattaccaaaacaaagcataacaatgaattaagtaccagataaatcttggcaattgggctcttgaaaacctggtgcacagtctcatcatctctactgttctacagaatcacctcccttatcttacctgcatgacaaatgcctcgagaaaaaaaatatagccacgatggcagtagcgaaatatcgtgcaaaaggaggggcagtttcgaccgaggagctacagtgagccgcaagtacgcttttttctgcaggctcatcaatccatgcacactcattattagccctagaactgtagcatcatttcacatttattttctttctctctctctcggccttaatcgcatataacgataattgatatggataattggattggattatatgcagctgtatcacaaattcacaatcccacaatctcattttcttttttactcggtgaaccactaaaacagtgtgaaatgggcagctgtttggcgttttcaagaaagaaaatattgttaaactgaccttttttgacagtcatcttcagttttttttttttgtttaagcccttcctctcctcactcacactgccctgttcatctctttcttttttattcgattcctctattccattccacacgcattgccgctggtagtagaagtatagtatctctccgcgaccgaagattttaaaaaggaagcaatttgcctcttttttttttttggcgcacctcgattagtagtagattttagaggcgaatgtgagcggtcaaatccttcttttttagcttgtgcgcgttgtgttttgtgctctccttttgtcagttcctgaggcgctctctcctgtgcctttgtgtttagcgtgcgtgaccgcgagcgaggtcgaggagtgagagggagtgaggcggcggcggcggcggccatggcgcagcagcagcagcagcagagtgcgtgggaagcggagaagatgtgagctttctcctatctctcttctgttcttcgttgcttcatcattccttagtttgttattgcgatcagattggtttgatgttcttcgcacattcttttttcccttttttttatgttggtgaaatgttctccgttttgtcttgagatttttttgtcattccatttggttctcttggtgtccgcatggttatctttccccaagattagtttcttgttttcctctgggaggggtttcggattcgtttcttggcggtttagatcgtctttttttctggtgatttttgcaagaatcttgtccttcatcttcccttgttgttgtatttcagagggctgcagacgcttgagattctgtttgagttccctgaaatttctgcattttccgttctgcattttggtttctccttttgcaaaagccatgcctcttttttttttcttgttcctcttgttccttttatttttctcggatacagtactagtttggtttattgcttgctagcttttcaactgccttttccttttaccttgcattgcaactgccttttcatttctcgaaatttatttgctctttcacactttaatctgcattttacctttttattttctcatgaaaactttcgatcccctccttcctgttgctgctgtgcttgcatgcaaacccccatgtttccttttttacttattatatatccccgcactgaacttatccatgtctgttcttggaagcaggttggacgtgtacatccatgattatcttttgaagaggaacctgcagagcactgccaaggcattccaagcagaaggcagcgtgtcttccgatcctgttggtcagtgcatcaatttctgaattttgtcatactactgtagtttgcaatctttgctctttctgcattaggaccagatagtttgttcctcagactgccattgttcttgggccaataggatggttacaaattgatcatttgattagcttgattagtactacacttacatttgtgcatgtgcgagacacgagtattattagctactcgtaccgggcagatacaaaggaacaatactacagccacattgttttgtctgatttatgcatgccagtctctgatgtttctgcattgtaatgaatgcgattttaatcttcttgtactgaaagatgtcagcttttgttttgcaaaaaaagcaattgatgccccagggggtttcctcttggagtggtggtctgtcttctgggacatcttcattgcaaggacgaacgagaagcactctgatgttgctgcttcgtacattgaggttcttgtagcacatgcatcttggttattacttgtccttgttgtttgcttgcactcacttggtacagtggtttactgcttatcttacaataaacatgtgtaaatgcttgaattgtgtcagtcatagagatcatgttcactgtaaaaggatttagttttttgcctaaagcaaatggatttaaattccacacaaacattgaaaaccaaattcaagaactttccatgtcactcttgaaaaaaaagaagaaaatgcctaattcatctatgtaggaaaaacttgttatggtggatatttttttttaaaaaaaaaatcaaatgtttccccatatttccaaacaaaacatgctgcatcatatcacacaattatagaagaacatgtgtcttaatcattttagaaggtacagaatgcaaaacactttctcgtagaatacatactatgttgtctccagctattatcatctttaaaattcaagtaaaatttcaaagtcaacattttattatcaatatgattaattactttgaaggcaatggtcccttccctttgtagtaggccgtagctaatacctgttcattttctggtgattactcatttgaaactagccatttcttggtatatgatgcgtcaatcttattgcaaaatgctattttcatgttcctgatgttgttacacataaattttgtaacccagacacagtcaattaaagctcgagagcagcagccatcacagctgcagcagcaagaggctcattcccagcagtcatcacagcagatccaaatgcaacaactcctactacagaggcatgcacagcagcagcagcagcagcagagtcagcaacaaccacagcaacaacgccgccagcagaagcaacaacagcgtagtgaaagcagtcatttgccgacaagtgcacataatggtttggtttctgctgatcctccaacacgacaaagcacttcagctgcaagttctttgtctgcaaagatgtacgaggagagggtgaagaattctgttcaaagggacaccttagatgaagcacctgcaaaggtagtttcttcatggcaatgtgtattgttgctttcatgatctaaactctcataatatgaaatgcatatctttatactgcagcaaaggtttacagaaaatattggacaactgctggaatcaaactcatcatctatgctgaagtccgttgcaataacagctcaggcttcagggtaccaactgctcaataatgcttgctaatcatttacttctcttttttttttttttgggggggggggggagtgtggggtggggatgggaggtttggagcgcaaaataaataccatatcagtcttaaatacagcctataatgtgtgatctaataggatttcctaccatgcttgaattgtgtttaccgcctttgtttttacctaactattttgcggtcttcaaattgcaactttgaccattaattcttattgtacactaaaatgtgctaataaaaactattatattactttcatattattcacaataaatctatccagcatgtagtagctgtttgactaaatttccgtaatcaatgctatcttgatggttcatactgtaatggctgtttaacggcaattatctctagcttctgttttcctgttagcgtgtgtgtattgatttgctttgatcaattgtttttaggcaaattttccatggatcaactggtggcgtgtcaggtactttgcaacaggttcaggcccggaaccaacaactccaggcatcaacacaggtagtcttatttcagatgtataatctcatgcattattgtctataactagacgagtcaaatttgtttcaggaaataaaggtagacacaaatgctgctgtacacatgagagctgcaggggcagatggatcattaattggagtaccaggtttttttgctttgaactctactaatttttgttgtttctggctgctaactggaaattcttagacctgctgtactgtttattcatgtacttagtgccattgtttgataccctgttgtctggcaggcgctaacccagcagggaacaatttgacgttgaaagggtggcctcttactgtgagttcttcacatcattccttaactggcattctaagctataaattaggagcaagtttgaatacagcaccttctttttttttttgtttttatgatgttttaccatttgattataacttttcagggcttagaccagcttagatctgggtttctccaacagaaatcttttatgcagtctccccaaccattgcaccatctacaatttctcactccacaacaacagcagcttctgcttcaagcacaacaaaatatgacatcttcacctggagagatggacagcagaaggcttcggatgcttttgagtagccgaaacattgttcctgggagggatggtcaatcaaatgcctacacggaagttattcctagtgttggcccttcattgcaaaatatgtgctcacctgtgcagcgcatggagacagatatgctgatgaaggtaagtttcacttgtatgttttactatattcatgcatttatttatttgcgaggatacattggatgtaagtaatagtaccttgtaaaccaccgggttatgcataattttgttctcaattgatatcttatatgtacatagattatattgtttaattcttgtcagtgatcagtaatagaatttcatttaaatttatcatgcttgttcttgttatgttatgttgccaagtttgcataacacagtaccatttactttctactatagcatagtgattaaatcatgaaaatatcggtcttggtccttgtgtaatataatcttttgaacagaggaactcatactatttggatttcataatgatctagctgctattaatacatgctcacatgttttctgaagctacctttttcaagataacttctacatctttggttttcgaccttaacacctcgtcattatatgtagtagaagatagcagctatacagcagcaccagcaaagcagcaatcagcaacagctccttcagcattctttacttagccagcaaccaccaatctctaatcaccttccaggccagcaggaaaaaatgggagctggaagtgttactattgatggaagcctgtctaattcattccgtggaagtgaacaggtttcacttccttctacatatattcaacattaccaccttgatttgttactgtgcctatccttttgttaagacttgtatccatcataaatatattgttttgcaggtttccaagaatcaaaatgggcgaaaacgcaaacagccaatctcatcgtctggtccagccaatagttctggcactgaaacaccgcggtcccctcctcagaaccctcaactccttcatcgcaaagcccaggagacacaatttcaatgccctcgctgcaccacaatgctagcttatcaaaggctttagttgtttacggtaccagtacagcagggacaatgggatcaccatcaaatcaacttgtaagttacaactggttctaaatccaaacagctatggccctattacgtggatatattatgcatgcaacatagtttggaaatgtttcattgcactgatggtctgtttgatgcctgacttctgaacatctgataactcacactgcaggctgacatggatcgttttgtggaggatggctgcttggaagatcatgtggattcgttcctgtcgcatgatgatgcagatcgaagagatggcagtcgtatggaatctactaaaggtgtgataaggctaactgttttgtaacttatggctagttgaagttgaatggttggctttgacatattaacatcattggcagtggttaccctggccagtttagtcttgaatgtaattatggctggtgtaaatagtaccaacaagctgaactcacttaggtgaatttagcttggaaattgagcagttggtgcggttcaggctatggtcctgtgagaggggaaattatctaatatgtcatgtggtaacatatattggttcagtgggttagatttatgatgtattttgtagggaagtctaacatgaatttgtgttctgtagagctttgattctgtttatatgtcttaagcaggattcatcttccgagaggtctcttctgtacaagcaagcacgaacaaggttgtatgctgccacttctcatcagatggaaagctacttgctactgggggtcatgataagaaggtaagtgcacatgcctgggcttgttaagatgctcagcctagttgatactcttggaagtgggcaggcatatctttgacttcatggtgatattgaaatagatacttgcaatgtttcaatgcaggtggtattgtggcatgctgaaactttaaaacagaagtcagtattggaggaacattctcttttgataactgatgtacgattcagtccaagcattccacgccttgctacctcctcatttgataaaactgtcagggtctgggatgctgacaatgtaagtacataactgtttagttcttttttcctaccatctatttgcctcggtgattgcctctgtgttatgttgcaaaaacctgccaactagcactgaaaccatatcaaattgccatttgtatatttagccagatttttttaccttttgaactgccctttatgtagaaacaacatcataaagttaagtaggctataaattctcaaagaatacagtaagcaatgtccatctcaaggtcatatgtcgtgaatgatctacaacatcaattttgagattcataggcatggcatggattcattttgtagaagtggaacttgtttgttctctaggggatataagcatgatacttctgaactttcagattcctgggtaatgtcagtacttgtaatgttaaagctgcaagggcagcaaagtactgttgtgttttactgctcatcatattctaatgctgtcattgtacttttgcagcaaggctattcaattcgaacgttcactgggcactcagcatctgttatgtcactggatttccacccaaacaaggatgacctcatttgttcttgtgatggggataatgaaattcgattctggagtatcaacaatggaaacatcgtccggatatttaaggttactcagtttttcttattcagcattctgtcaatctggaagtgctgctttattgtgaacaatcctaacatttccttgacaaagcactccaacgtatacttgtagacttttctctttatagaaaatgtgcatgatgaatgtcaatctgttgaaaacatcctaaaattacgtaaaagaaaacatcctagatgttttccatacctacttgttaattggtttcaatcactgtcataacccctttgtagttaatgggctgttattaggtgtctccatccataatcaacaactggtctcaaaaggagatgccttgtaggatacactgtttcttgatttatttgtttccaatccctttgtagggaggatcaagccagctgagatttcaaccacgtcatgggggatatcttgcagtagcttcggagaatgctgtctctatacttgatgtggagactcaagcttgccttaggagatttgaggtttgtagagactttctaccttgcagttggcacgtgcattctgatcttctaaattcactgaggttccagtaacatatataccgaccaacaaatctatgtgcaaggatgtatttacttttcaaatctcgtttttagagtgagttttggatactgcaaatctatctatttattttgtaattagctttgtggtgttcatttcccttgatggttagttgtccttgcttggttgtttacatattttcaaagtcgcatcgtgctagctgtagccagtgttcacttccatgttaatctttagagtttccgagtgatggtaaccaatcactttaatctgtcctctttattgggaactgcagggccacacaaagcatgtcgattcagtatgctgggatcccagtggcgaatatgttgtatctgtcagtgaagacacggtgaaggtgtggtctgtgaatgctgggagcgatgatcgctgcgtgcaagagcttagctgtaccgggagcaagtttcactcgtgtgctttccacccttcatattcatctatgcttatcattggttgttaccaggcaagtactttatattcgtggatctcttttatgctcatgcgtcacgattcattcaaaactaatctgcactgatcatcctaattcctaagtagctggttaaaaatgactttttctagatcaactcatgactactcactcacactgaggatcattccacaacttgaatttcagtacatcattacacatatatcaagttcctcaaatattccttcatgatacacatgcaattattttgaagatttactgcaatgaaatacttttcctatttaagaacaagcattcggccatagagaccacttatgttttcaccgcggttcatgtttacaatgcctgtagtacgcttacctctggttttgtgtttgaatgccgcagtctcttgagctgtgggacatgtcggagaacagaacgatgacgctcgcagctcatgacagcctcatcacagccctggcgtcgtcaagctccggtttggtcgcttccacgagccacgacaagttcgtcaagctgtggaaatgatgtgctttcaagctagccgcgccctctaaccctcttctaaggatgggcctttttcttcctcattttttggtcacaccatcagctctgaagagctattgtgtgatgatggtataaacactctatatggtataatatcccccacaaagtagctggctactgaatgactgatgaaaatattgctatcctagtataccttttgctgaccctgggaaagtagcattttgtacagaacatgaactatgctttagtattaatcatagtctatctgaactactgaagtgtttatggtctgaattctaagaagttattctgctgcatctctgctatgaatatgaagaatgtgatgaatgtggcattctcgtaggaatttcaagggactttttttgtaagaagtatgctcaattccagcaagaaattggaaattttcttactgaattttacaaacgtggtttcgtcacggatgcttggtgtctggggaaagcaatgaatcggcatctctggcctgcaataaacgaatgtatttgccctgtttgcatgttcagtctttgcacggctcttagattccccagcctgtccaaaaatacccatgacacggtttgatcgatcgattgcaacacaaatctgtgaacagatcattggttcctgatcagagatgttcagttacttctctgaacattgatttttcttcttatcagatagggaatgtgcatctttctctctgatcttcagtttggaagaacactgcatcctgtagggctttcacaatgatagctacacctacatgggaatttttgagaagagtcatatgcatcttcatcagaatgatcagaggtaaatacaatgcttagttgttgcaaccatcatcacaggtttaacaggttctcagattctgttttgtttagtttaccacttgactttataggtttataacctggagaaaaatgtatttctcgttcataaagtgaggaggataaaatgccgtccgagtagatggaaaatactggtttagtaatccaaaataatctagaggttctaaccgtttctaaaacaggctgggtggaatgtcatctaatccaactttacaagaactttttatcggttttgagtagcggaaatgcctatccgtataattatcaggaggaaagcggcaaattccactctacattatttaagatcttgaaggtgtttggtacatcgctctagctaataaaatcttggagtagtagtgccaaactgttcttaggcggcattcgggaggaggggttgtgaacccttcatcctcaacaggcaaaacgaaaaatacgtattattgtatgattaattaagtattaacttttttttaaaaatgattaatatgattttttaaaacagctttcttatataattttttttaaaatacactgtttagcagtttgaaaagcgtgcgcgtggagaacgggagaggtgagttgggtatactggggaagaacacagactttgcaaaaaaaaaagtccccggtgtaattgggaaaaaaaatcattagggatagatggatgtatcattttgtttcacatatttatccctggttactattataagccgtgttgatattttatagccaatcctttttgagtttgatcaagtttataaaaaaatatagcaacattttcaaaacaaaacaaatatattatcataatatattaaatattagttttagtgaaactaatttggttttctttataaacttaatcaaacttaatgaaacttgattagaaaaaaacaaaatataatatcaaacaaagaagtactccctccgtcctataatataaggaattttgagtttttgctcgtagtgtttgaccactcgttttattaaaaaaatttatgtaaatataaaaaacgaaaagttgtgcttaaagtactttggataataatgtaaatcaaaaaaataaataatagttctaaaattttttgaataagatgagtggttaaacagtgcaagtaaaatcttaaaatcctttatattatgggacagaggggtagtatttgtgccttttctgaaagaaaatctaaaaacaagacaataaatgcgccggcaaaagccaaactaacccccgtgtttaaatcgcctcccgtacaagtctcctgcccctaccaataccaacttaacccctcttcttccatctctaatctaatcactcctcccctcttccaccctccccccacctcgtcgcctcgccgtctccacccccaaaaccctagccgccgccgcgctcctcctcctccgccgccgcccggcgccgcccgcggccatggatctcctccgctcgcacctccacaaggtccgcatcccggagcccggcagccgcatccacaaggacgagtgctgcgtctccttcgacaccccggtaaaccaaccaaccacccacccacccacccacgccttgtcccccccttcgctctggtttcctagggttagggttttgacgccgatttcgccgtgcagaggtcggagggtgggctgtacgtcgacatgacctcgttcctggggttcgggagggagcacgtggcgtggaactacgagaagagtgggaaccccgtgtacctccacatcgtgcagcgccggaagccggagcccgacgacgaggcggatcgcccgctgaagaagcccacgctactcgccatcggtatgagtgacagcgctttcccactgatcaccatcgtgtatttcatactgttaaaattgtgaacgcatgaatcgcgttagggtatgtgattgtgtttggatgatgtgatcgttttcctattgcgacttgtttttaccctatgatcaacatcgtatttcatactgttgaaaatctgtatccccattatctgttcccctttgtggtagagacttaccaaactatggtagttatcatatatcttgtgttctgtttgatctgttgagctactgtgctgtagagaaaaaatatggtagtgcattgctttgtttgctaatctggaaacagagaccaacatatggtggccatgttggtgaattgtttgttatgtgatatctgtatgctagttatttgtaattagaatagttgcctatgtcctggatttagatctatatagttgtattttctctgttctgtattcccatgatggcaaatagatgaatgcgttgaccatctttactaatccgggttttctacaatttataggagtggagggaggtttcactgatcaagaacccgaatacgatgaggcttttgaaattgttatcttgcctgaatttacttctctcccttttccatcaattgacttgccagagaaggtaactgtgcttgacataagagattgtacttacttactacatagtagttacttactactctacaactccacaggttaggattgcagttgacaaagttatacttgccgaaagtgctgatcgaaaacaacaattggcttcttgggttgctgacaagaaaaaagtcagtgcacatgctatggatctgaagcagctagacaatggtgtcattgtgccacctacaggatggaagtgcagcaagtgtgataaaactgagaatctctggttaaatttaactgatggcatgatcctatgtgggaggcggctttgggatggaagtggggggaataatcatgctattgaacactacgaacagactaaatatcctcttgcggtaaagcttggaacaattactgctgatttagaagcagcaggtaatgctactcgtggaccttttacatatttaggcttcctcttctattatcgaatacaacttacggtgacattgggttgtcgcctgtgaaaaattgaactaaaccccttttaacctctcacaaactgtatcctttgtaatatctaaattaaaagtgtcatatatatgatgctcaacttggaatgcacttttagaatactatactccctctagttttaaatatacaaaacggtggaccttttaaattcgtttgactatttgtcttctctagaaatatttgtgcaaataaacaaacatataaggcactcttaaagtacatttgatgaccactttacttaactaagtaattgaataaacattgttggtcaacgtttgagaaaagaagtggatggtgtcatatatttaaaaccagaggtaatacttaaatagcttttagagatatgtttgttataaatacttgtctttattcagaggcacaaaaagttggaaaatgttaatgattttgtgattggagggagtatattgcaattattattgaatattcactttaatcagtaagactcgttcttaaattccagagttgttccctggatacatactgctcgtacttcataatttataacacacagcccaattagctactataaaagtaatttacactgatattttaaccttccattgaaatattttgctttcgtcttattttagttttaacaaagaatattcttaaagtcctaaagcaaccttcctatcaagggcatgtgctgctgaagttactgttgttttatatttaaatatacctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48324 - DNA, 31398 bp, Oryza sativa
gacatggctgtggttgtatctagtcaagcggaggtatgcaataactctggagaagtcgtatgctgtttgagttgatgactgcaagcagtctgagggcaagttttatattggaggtgactatcgcatctaattttatacataacatagataattaaattaagaggtgatatgtataataggtcatctctaccacacaatccctaatatttctaacactctcacatgtttattaaagtttgtgtaggggctgccccttgcatgagaggtgactatttctctctcatccttcttctctcctccacctcacaatttagtcctatgtgacatcttggggcttgtgcttggatgctcatagtacttgctttgaggtgctacggagtagtgcctgatgcttcggatctcggagtcggaggaaagtggaatgttgccgattaatcaaataattgcagcttctttcaaaaaaagaattaaataattgcagagcagcttgtcctcctatcaaatcagccagtttgagctcatgctgaaaaggataacagcatcgctgaactttggcaactttggtgtgcatgttatagttatggactcatagccaaagtcctcgagtttattccattctttgagccgtccggacaacgcggttggtcaggttaaccacggttgctatacatactcatactccctgtcctctgcagtctcactattcagtattttttttctttcgaagtctacggcataacttgaccactattcctaatttttatcttcatatattcagaagtaactaggaaacttgggcaagagtgtcagaaacagaaagtgatataatttaataatccagactgtaaacaatcatgccacaaacgagcctcatacaataatactgatcatttgtaaaatactccctctttgcatctgcagggatcctggaaatcccctccactacaggagctggtggactgccaggctgcaaatgtaagccattttatgcttcacgattctttctcaatatcaagtcattttagaatacagaagtttttactattcttccagattttccatactaaataaatgttatccttctaataaataaatcatatttatgcacaagtctttacacggcttgtatttggaattgaagggagcacaattcttagggatgaaaatccgggcaagaccatagttaaagggccaaatatggactcctcccatccttacaagtatataggtacgatagtatcctccaattcattctttcagatctagaattttaataaaaaaagcttattcccatatatatgtatcaaccagatgcattttgctcgtttcccatttcttgaatcaataaccttatgttgttatatgaagaacctccctcttccaaagccctccttgcctttatgccaaaatcttttgctctcattctcatcccctgtgcagcctccccctcattcatcaatgtggacactgctgtctccacagaattccttgtcacctgagcctctttttgttcacttccccactgtgtcactcctttcactccaacctccatcccaattttcaggtgatccactaccagtttttcattcaagaattgctctgcaaagtgtggccatgtgatcataggcacacccgcgcagatgccctctattgtcgagttccacccacaatgtgtcatgaaccctccaatggcctggtgccacaggatcatcatctgtggtgcccaacctcttatgatcatccctctgtctatgacacgttcctcgaatccatctgcaagccatttctcgactactggaaacttatttcctgctttgatcacccatatgaacggtttgttggaagcttcaagccccagtcccagctcaacaagctgctgaggcgcggtgctgacaagggtgccaaaactgacaaagatcacggaacctggcttctttgaatcgagccattgcaaacattttacttcatccaatgacgccttgtttcctctagcagccattgtgtttctgtctctgtgacacaggcacattgggccgatcgtccagaccttatctgtcacctgcttataggactccatgtacaaagtctccagctcgtcgaagctgttcatgaccttgccgtcgcttcgcatctcctcatcatagatcttctcacggatttcctccagacctggaacgcacaagcttccaggcaatctagcttttggcaactctagcggcgtagggaaccctgagagcttaacgacctcctcctcatcagtgaggtcccgcaatagattgttacggtaaacaatgtcccttcaagatagcagtcttagctcttaaaacacatccaaccggcagttcttaagataccatgaaaagtttttctattttctgaaatgagttagtagtgctgccaaccaattgccaacctgacctgaagtattttttagataaaaggcttaatgtgtggttttgattaaaatcctttaaccaatatcattctcatgtcttgcctcgtctattgatcaattctaactatttgttgttcttgtagagataaatatgccagtggcctgtgatttttacctggcgagggaggcaaaggtacagaagccactaaaggtaagccaggggataccgagctccctggcgatgtcactggtccaccagtgcatcatgtcggatacgatgcagctcggcggcaggtcgtgctgccggagcctcgccatgagtggctcccggagcgcgccacaggcctcgaggaatttcctcatgtcgtctttgcactggagcatgtcaatgttctcgcacccgtctggcaggccgaaatcagcagccgggaaggggagctccagcagctgcactggcaggccagcctcctccacggcggcgacgaaccccgccatcctgccggcgttgaccggagtggtgacgaggctgatctgagcgccgtgctcggccagcaggcgggccatgtcggtcatggggatggtgtgcccctgcgccatcatcgggaccagcacgaagtgcaccgtcctggagcagcacctgtgctgctggtcgccggcgccggcgccggcgtggctggcaaaagacatggctgtgtggttgtatctagtcaagcggccaagacaagcgtggacagtgagagtgtgacaagaacagttggagccttggaggtatgcattaaccgagaagtcgtgtgctgcttgcctgctcgagttgatgagaagcttgacacttgacagcaaccgaggagtgcatatgtggtgcctgccacttcggatcagaggaaagtgacgggttgaaagtattgcagcgccaacagtttgtactactatcaactcggccagttcgagctcgtgctgaaaaagaacagtattgctagactttggcaacttcagtttcagtgacgcatgctagtcatggactcgtggctagatccctcgtacatgaagcttcttccattctttatgcaaccacagaggccacagttgctatcaatacagtacgtacttaaaatcgaaagatactccctggcctctgcattatctggtacaaggaaattccttttgtgatctttataagtctatgcctgactttgaccacaaaatttgcattcatatattcagaggaatcgaagcagcaattacgaaagtgatgtaagaccaggtctaatccactctatacactgatcatttgtagaatactcttctcatccgcaaggggtcctgggaacctcgtccactgcagaagctggtgggactgttgggctccaaatgtaagtcatttgagtctttctcaattcttacccaaatatatatcgtttcagagcttcttagcaatttttttttactattgttcaatgtttgtggttgctaaataaatgctatatccctcttaaaaataaataatttatctttcttgatatagtatactgtagatgaagggcaacaaattcattagagttgtttttattaattcttatacaaattgcacaagtataaaaagatttatatttggaatcagagggagagtacagttctttatagtttgagggatgaaaatcagggtaagcacaataggatcctccagttcttgcttacagatttacaattaagaaaaaataaagcttatttccatatgtatcaaccagatgcattttgcttgtttcccatttcttgaattaatagttttatgttgttataggaagaacctccctcttccaaagcccttcttgccttcatgccaaaatcttttgctctcatcctaatctcctgtgcaacttccccttcatccatcaacatggataccgctgtctccacagcagtccttgtcaccttaacctctttttgttcagttccccactgtgtcactcctttcactccaacctccaccccaattttcaggtgatccaccaccaatttctcattcacaaactgctctgaacagtgtggccatgtgatcatcggcacacccgcggagatgccctctagtgtcgagttccacccgcagtgcgtcatgaaccctccaatggcctggtgccacaggatcatcatctgtggcgcccagccccttatgatcatgcctctgtctttgacgcgctcctcgaacccatctgcaagccattcctcgacttctggaaacttttttcctgctttgatcacccagatgaatggtttcttggaagcttcaagtcccagccccagctcaacaagctgctgagggtcggtgctggagaggctgccaaagctgacaaagatcactgaaccaggcttctttgaatcaagccattgcaaacatttcgcatcatccattgacgccttgtttcctctagcagccatggcgttgctgtctctgtgacaaaggcacattgggccgatcgtccagatcttcttacctatggttcgctcaaacgactcgatgtacagagattccatctcctggaagctattcatgatcctgccatcgcttcgcgtctcagcctcgtaaatcttgtcacttatttgcttcagacctggaacgcacagtgttccagggcatctagcttttggcaactctagcggcgtagggaaccctgagactttgacgatctcatcatccgtgaggttctccaatagatttttgcgataaatgatgtccctgcgagatagttggaaacttggaccaagttcttaggatgtgtttagttcagcgcaaagtttgtattttggttgaaattgaaggtgatgtgactgaaaagttgtgtgtgtatgacaggttgatgtaatggaaaagaactaaagtttggatccaaactttggatctaaacacaaccttaggtcacatccaaactgtgagttcttagatcacatacctgataagtatctccttctactatctctatcccagaatataagcatttttagctataaatctggacacgacggagggagtaagtattctctgttcatatggaaagtagatttttgtccctcgaggagatatcccctcgttttttacatgtcgtttaaaaagttataaaaaaatttatcaagatagatcaatatataaatatatcttttcgcaaacatgcgagttaaaattcaacttatacaattcgaaacaaaaataacaaatttgaccgtgaattgcgcgtcctattcatagtcaaatttattatttttatttccacttgtataggttgaatttgaatttgcatgctcgtgaagttacatatcacatattgatctatcctaccaaactttttttaaaatattttgatgactttttaagtgacatgtaaaaatgacgggatacccttattcatatgcagagaaatatgccagtggcttttgctacgatttttacctggcaaaggaggagaaggtgcaggagccgttgaacgtgagccatgggacgccgagctccctggcgatgtcaccggcccacgagtgtatcatgtcggagatgatgcagctcgccggcggccgttgctgccggagcctcgccgcgaacggctcccggagcgcgccgcaggccaagaggaagttgctgaagaggtctttggacgggagcatgtcgacgttctcgcagccgtccggcaggccgaactcggcggccgggaaggggagctccaccagctgcaccggcaggccggcctcctccacgccggcggcgaacccggccatcctggcggcgttgaccggcgtgacgacgaggctgacccgcgccgcgccgtgctcggccagcaggcgcgccatgtcggtcatggggatggcgtggccctgcgccatcatcgggaccagcacgaagtgcgccgccgccgtcgtcgtgtagccgccggaggcgtggccggcggtgtcgtcgtccatggctgtggtttgttgctagtgaattgtggcgaagttgttttatggcgtttgagtcaatgagcttcggatcaaaggagagtgacgtgtggacgattaaacaatcggagggccggtttgcttgtatcaacttgccggatggagcgatcatgccggagaagaaaatagcaaaataaactttcaacttggagtgacgcatgttcactcgtcatctatggactcctgacctcgtgaatgggagtgtagtgtgtagtaatggaagttctagaagaactatggatactatccattcgaaattggtcagaggaaattccaaaagaaggtaggagtatgagatattcctctattgtctctctcaatgaacagcttgaaaatacttccaagcaggatttataaaactgacggtaactgtgcttattgctagggtaccaaaaataaaattaaatagattcaaaaaatagtctgaaattttgataaattttgtatggcttctatggtttgttgtggttaccgcaattgccgcatggcaactgtgcaataaacccatcgataagggtaaccttggtttcatgtgatttgaagtgctaacatttaaactcattatggctgtgtttaattcgtgtgctaaattttttttaattatatggatacacatttgaagtattaaacgtagactaataacaaaacaaattacagattctgcctgtaaactgcgagatgaatctattaaacctaattaatccgtcactagtagagtaaatgtttactgtagcaccacattgtcaaatcatggtgtaattaggctcaaaagattcgtcttgcgatttacatgcaaactgtgtaattggttttttttcgtccacatttaatgctccatgcatatgtctaaacatttgatgtgacggaaaagttggaggtttgaatctaaacacggcctatataagaaagccaagcagatggctattgccctctttgtttaggcttaggcttattggcctagacttttaagtcagcttattggcttatatgatttataagccagtggatttaatgtcctaagtttagtagtggagtcatacatctatctcatttaagccaaaaaagcttctccaacctagcttttggcttaatagtgttagaatagcttatggcttcaaaaaagccaaatgaaaaagctacttgtttgttttggcttagacttttcaacttataagttggcttataagcctaaacaaagagggcaatatatatgccttcaggccagtacgcagaatcttatctttggcctggtttagttcccaatttttttcttcaaacttccaacttttccaacacatcaaaactttcttacacacaaacttccaacttttccgtcacatcgttccaatttcaatcaaaatttcaattttagcgtgaactaaacacaccttgtttttgttaacacacttttcaaacaactaaacagtacgtttcgtgtgaaaactttctgtataaaaactgctctaaaatatcaaagaaatccttgtttaaatttgaaataattaaaactcaattaattaccttcttgtttgttgcatttaaaaaaaactttcttgttgaaattggacttgggagccacgagtccacgtgacagaggcagctgtgaagactacgaggcgggcgacgacgaagcttcgctaggcgcatacgtcatcacccctccctcccgacttttccaggaggcttctgccgccgcggcgcggcgcctcgacacaggcgtcgtcctcgtcgcgtcgacttgtatacgcacactgcaacttgcttgcttcctcacactcatcggcggcgggatggcggcggagctccatttcttggtggtgccgctgatagcgcagggccacatcatccccatggtggaggtggcgcgcctcctcgccgcccgcggcgcgcgcgccaccgtcgtcaccacgcccgtcaacgccgcgcgcaacggggccgccgtggaggccgcccgccgcgacggcctcgccgtcgacctcgccgaggtcgccttccccggcccggagttcggcgtgccggaggggctggagaacatggaccagctggcggacgccgaccccggcatgtacctgtccctgcagagggccatctgggccatggcggcgcggctcgagcggctcgtccgggcgctgcctcgccgcccggactgcctcgtcgccgactactgcaacccgtggacggcgcccgtctgcgaccgcctcggcatcgctcgcgtcgtcatgcactgcccgtcggcgtacttcctcctcgccacccacaacctgagcaagcacggcgtgtacggccgcctcgcgctcgccgccggtgacggcgagctggagccgttcgaggtgccggacttcccggtgcgtgccgtcgtctacacggccacgttccgccgcttcttccagtggcctggcctggaggaggaggagcgcgacgcggtcgaggccgagcgcaccgccgatggcttcgtcatcaacacgttccgcgacatcgagggcgccttcgtcgacggctacgcggcggcgctcggccggagggcgtgggccatcgggccgacgtgcgccgccgccgccgccagcacggacgccgacgcgagggccaaccggggcaaccgcgccgacgtcgacgccgggcgtatcctctcctggctcgacgcatgaccgccggcgtccgtgctgtacatcagcttcggcagcatctcgcacctggcggcgaagcaggtcatcgagctcgcccgcggcgtcgaggcgtcggggcggccgttcgtctggaccatcaaggaggccaaggccgccgccgccgccgtgagggagtggctcgacggcgagggatacgaggagcgcgtcaaggacaggggcgtcctggtgcgcgggtgggcgccgcaggtgagcatcctctcgcacccggccaccggcgggttcctgacccactgcgggtggaacgccgcgctggaggccatcgcccgcggcgtgccggcgctgacatggccgaccatcctcgaccagttcagcagcgagcggctgctcgtcgacgtgctcggcgtcggcgtccggtcgggcgtcacggcgccgcccatgtacctccccgccgaggccgagggcgtgcaggtcaccggcgccggcgtggagaaggcggtggccgagctgatggacggcggcgcggacggcgtggcgaggagggcgcgcgccagggagctcgccgcgacggcgagggcggcggtggaggaaggcgggtcgtcgcacgccgacctgacggacatgatccgccacgtggggggtggctactgcgcgcatacgcgccagctaaattgctggcgcgcacgccagctgccccaccctatagctcccttgtcttttttttttgcacttttttttttccgattttggtgcttacgggtgcctttttctttatctttttcggtgtttcttttccgatttttttaatctttggcatatctctttacaaatatagaattgaaagtttttaattttgatttgaaagttatcaaatttgaattgaaagtttttaaattttaagttgaaagttttctaatttgacttgaaatttcaaatttaagttgaaagttttaaatttgagttgaaagtcttcaaatctgagttgaaagtttttgaaatttcggtcaaaagatttgaatattcgagttaaaagtttttaaaatttaggtcgaaagtttttaaattcgggttaaatttttttaaatttgagataaaagtttttaaattttaacttaaaagttcaaaattcgacttaaaagttttcaaaattttcaattttttttgctgagaaaaaaagaatggttagcttaatataccataattatcgataactaattacgtatacgattttttctaaaagtcctgcgcacttcgttgcgaaaaaatagaaaaagaaggatgtagctagtgggccgtgcgcgaggatatgggccgaaaacgctcgcgacttagctagccggcgcgtctgcgcgcgataggaatctcgcgccaagtggcggaggtggcgaggacgaagcggcaggagagggaggcccggcccacttaaagtgattaggcccggcctatttacgcagggagggttttgggctgggacgtgtatgcgtggagcggcccagttagtgagattgggccgtaaaaagaggatgagatagcttttctgtcgatcggcccagttagtgagattggtgcacaagtcaaaattttgtcaagtgatatgtttttttcttatataaaactaaaatgataaaattttgcatgaaagttgtgtttgcttcatttggactcgctagctcgttattaaaatttggctttaaaaaaatgtaataaattgtaataaaattattttcaatcacagctcaataaaagacagtgccggcttgatttccagactactacaacttctataatcagaagctctccaaacagtttagattaaaaaaactataattatagaatccataaaataaactagaaatcaaaatctaagaaacacatttttttaaaaaaattctcagaaacttactactacacgaatcagctatttcttataatcttaaacttcttaaatatgttttgaagtacatgatgaatttatacatgcaagccggctggtgaagatgattaatttacgtttagtttgtttatatagtgtttatagtatataatgattctaaattcttagtttttaataacaatcttttcggcaatcataaaagcagagcgggacagtaatgaaagttgataaaaagaaaccataaaaccaatccataaaaattcaaaatgattccggattataatccgcagcactacgagcagggcctactcttgaggggcaaaaagaacaaaaaaacccatgatttgtgagatcatacagccgaccactcattcgtttggccattaattttgtattgcattacaaatatctactactcctgcatgctaaacggaaaaacgtaaaacattgtgatcttgactaatgagatctacatgtatctcttcgaaagattcttgactgacagcatagaaaatgtcatgtgccgcactcattgcacagagccacagactgatcaatctttttgcatcaataattcaagcatatggcctgtgataattctcaggacgatcaatctgtttatgccttgcctagcgagtactcgaatcatcatgtgcttataacttcaacagatggatgtaccgtacgtcaccgcttagctcatgcatatatacttcctgtttaattgttcacagaataattaattgcacgggacagtaaaatattatcgcagcaaagtaccacgcaaatatcgtgtaaaaggctcctacttttcttagtataccacgagcaattttaataatataatcaactactaactttataaaaaactaaagagtaaagtccatcaccggtccctaaacttgtaccgttgtatcatcccggtccctaaactcgcaaatcgatcgttcaggtcctcaaacttattcgactgtgtcatcccggtccttacagatcactcgtttaggtcctccaacttgttcagttgtatcaccccagtccctaaacaggacggtctaaaaactttatatcaaaaaataattcataactttttcatgtgaactctaatgaagacaaactttatatcaaaattgtagccctcgacgcgacctacaactttgtagttgaaaattttttgaattaaaactgtttagggtcccaaaatattgttgcatatttatagattttgaaattttaattttaaaattacattttggaacaaaaatgacttaaaataaaaaaaattcaactacaaagttgtagatcgtgtcgagggctacaagtttgatataaagtttgtctttattagagttcacataaaagttatgaattatttttaaatataaagtctttacaccgtcctatttgacacagatgatattcaaatccaagtttagggactgggtgatacagctgaacaagttggaggatttaaacgagtgatctgcaagtttagggagcgggatgatacagtcgaacaagtttgaggatctgaacggtcgatttgcgagtttagggaccgggatgacacaggggtacaagtttagggactggtgatggactttactcaaaattaaaatatcatctgcaacttatttaataatccattcatataattattagctatatatatatatatactgcatcattaatacctaattcattcgatctcagatagtttattacagaatgtgttgtagctggttacgaatctgtagcacgtttttcttctctctcatctcttctccatgtaatcacaaatgtgatgtgcgtgtgcgaatctaggggtgatcctagtgctcacttggaaaaaaaatcctaatccaatgcatatatatatacacatgtgaaaaaaaacttttaaaaagttttttttattgatatattattatgcatatttgaccaatttatatttctaacttggttacatttagggtgtttaaaaaagtttatataagttggatcacccatataaaatttctatatacgtcactggtgatgtgataacttgtatagcacgctcatgtaattttattttttaaataatacgcacaagatagtgtgacgttttgtattgatagagtagaaataaaatataagtctacagttctgaaaggttatacttagaaaaagaaaaaacaacatccatgtcacgtatctatgaccaaatatccgtattgaagatcaaagcagaacacacgacttttcttaagggaaaggatctttgattttattgtactcgctctactaaggctctgttcgatccccaggttcctagctcttcacccccgttttccacgcgcacgtttttcaaactactaaacggtgtgtttttttttcaaaaagtttctatacgaaagttgtttaaaaaaatcatattaatctattttttaaaaaaatagctattaattaattaattacgcgttaatacaaacatcgttttacgtgccgagaggggttcccaatccctcctgccgaacagagcctaatttaagtcacagacggtgtactttgtacgcttttgttatgtctgcgtaatactccgcactatgtaaagtactgctatatagccatataggagtatccacaacaaccagatattttacctatagcgcatcaacaactggtacacagttcctaaaaattaaaaagaaaaataaaagaaactgatgcacatttcatgttttcatacctccaccaaactgacgagatagtcgtataggagtatcgcggaagagtattttgtttctcatctgattttgtaagatttgtctggtccattattatcgtttgccaaaatattatcaaacttttaaaagaaactttttagaaacacggtataaatgcatacgcttgtaacacgcacgaactcaccctcatgaaacggcggacatattccaaaaattacggggttctatacatactgattatctaattattgactgatatattaattaacaggataaaaattagctgaaattgaataatctacccgcggtcttgtgactcaaaaaaaattacctccgaaagatttgttttattgtcaaggttatattatgccatacttttcatgtattgttataactagtcgccaacctatacgacccatcaaattaacgatcatatattcttttaaccgggagctctcaggaagtttgattagtataggtataggtaatagattttttttcgatctcagctaatcagctaaggtgtggccaacaaaacatttggctaaggtttcatccgatcgaagaggttaggttttgatttgtccacccgatgacattcttttcctgaaaggataaccgggcggggagagctttcgtacccactgaatattcatcgagggaccagaaagtccagagaaggtacacaattaatcagtcattagatatacaattaatcagagtatagtttgcaatttgagccgttactggcgaatggtgactgacaatagttactggcgaatggtaactgacaactccagctagctgtcgctgaaatatgcaaaattcgaactgaaaacctcacaaaaggccagcacgcagttgctctcttgtgccttattacaggcttgaattacaagtgattaccggccacagaaagaaaaaaaaacataaagtacaattcaggagcaagtcttgtcccttcaattttagaggtcacttcatttttcttggcttgaagtccttcgttcacttctaccagaaagtatcaaaatgtgatccttcaaaaacaaaaattttagaattttagataatagcagaggaaaaaaaaggttgtggtcttaagatgatgagctagttgctatagctaagatcctctatagggtgtggataccgtgggatatcaagtccctatagccgaagttagcatttcttgggtgtttttttggttgattgcaaccatacatttgagtagttattttcagtgacgtctcgatgggtagaaaaatactttccggttttgaaaaacgagaatgatatttttggacctctgcatcaatccacagccgttttacatcttccaaaaaatatattaaaacctagtaattgtttgttatcaacaaattgacaatgtgtcaacataagcttccggaattccactacagtaatttgtgccggccactccgatcgttcttgggttaagaatacaatactatcttctgggaagttttgacggtcccggtaataatatcccagtttttttctgggcatttgattggctgcaaggatttcggttggaacaaccaagcgaagatcaggtcatctggagatggggacaagtgaatcttattctgccgagacaagcacatagggccttcttctaattgaccttcacagctttccgtgttcaaatcagctaccgctcggggttattccaaatacaagtacttcctttgacttgactcataaaaaaaatcaagctagtatcatactacctccatcctaaaatatttgacgccgttgacttttttaaaaatatttgaccgttcgtcttattcaaaaaatttaagtaattgttaattctttttctatcattttatttattgttaaatatacttttatgtatacatatagttttacacattttacaaaagtttttgaataagacgaacggtcaaacatatttaaaaaaatcaacggcgtcaaatatttagggaaggagggagtatatttttatccagattcgtagtaatatgatatatcatatttgaaattagattgattatttatggacggagagaatacgttgtagaggtgatgctgaactaagaacacactctcactgtaggggtgtggtagtgtggcacaaagttttttttttcacttgtttgatttggagctaaattttcccctgttaatatttttttgatggtgctaaaatcttgataatttctgcgactacaaaatttggtaccataaatttatattagtgagggaaaaaaaagcaaactaaacatcaatgcaatactatttaggccgctaaaattttggttggaaaataattagcttcactccaaacaagttcttagtctttggctgggttgctaaaaattggcatcatgtggcaactttcgtggaagcagctaagtaagcgcattcggcatagattcaccgtttgtctatggtggtcaagcccaggaaaaaatttcacaatatatctttttcttcgttattttgtgtttatataccaatgcgatgaaattttgcacaaatatatctctaccgcataagggttgtggaaccagcggtcgcgcaaaacagcagtgcggaacctatcgatcccgcagcctggaaacgcggaaccgccgcgccgtcatcgctgcatgcaacgtgaatgcatgcatgtatgcaacatatgcacatccatgcatatgtgcttgtttgccgcaccggccgcgcgtcatgagcgcgctggaccgcgccggtcgcgcgggagcgaggaattgcgtgcgggaacgacggttccgcacggacgttccgcgggagcaacggtgccacgcggacgctgcgcgggaagcactgccttgatcccgcatctccattctagggtagagatatattttcacaactcttttctatgcatgtatataaaagcaaaacgttaaaaataaaagtatatattaaaattttattcgtcaagctcatagcaagaccgaaagtggatattggttggacttcacactggtggagaaaccctttgtagtcccggttttcaaaccgggactaccaatccgggactaaagatcgctatctttagtcccggatgaaataactgggactaaagatataccaaccgggactaaaaatcgagctgaccttttttttcatggctctgttgctgtagggtttatatatatatatgcatatatatatatatatatatacatatatatatatatatatatacatatatatatatatatatatatatatatatatatatatgtatacatatatgtatatatatatatgtatacatatatatatatatgtatacatatatatatatatatgtgtgtgtgtgaccaaaatatatttacattatagaaaatgtgtacacatgcatatagaaacatatgtagtcatgtattaattacaatccattatatgtcctagctagctacgatttcgacgtagtagtcgctagctcagaagctaaggacctatgaattgtgtttccgtcgtagtagaattcacccttgggatcaaggacttgttcgttgatgaatcccataagttgttcttgaaccgccacgataaattccttgtgtgtggtcaggttatccctcatacgaataaactatatgaatgtatgaaattgattagtaattaaacaagaaatcgatacgtaatgaaattttgaatttatttgtacgtacatcgagctctcttgtggtgatgatttggtctgcaaggcagtggcaatactcacacacgtaatagcagcacaagttagttccctgcttttgctttccgcactacaaataaatgacaaacgacgagagatctaattaatatacacttgtatatatttgaatcggagcaatataaatgtagagcatgtgtactcacaggaaatttaaacttccgcctaagtctttctctccatttgccgcggaccaaatgacggaaccgataccaagccctacatggagtttaaagctatgattcgtagtagcaattaacataacaagattttcttaattaacagaggaacttatgacaatacctgtccataagttcgaaaaccttgtcaaacgtagactctttttttatccattgagtcatatacgttgacggtgtaggccgacaggtcgaagagtaaaagcacccagtggaatctgcaatgtgcgtgggatgcattacatatgaaacacttagcaagttcgtacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgatgtttactttccgagggtcgatgaatccagtatcgaaaaccccccgccgtcgggccctttgaatctccattctacaacgataaaagagaatatattattttctatagtctacttatatacaaggacctaattaattaaaggagacgtagtaagaaatctaactgaacgatatacttacaaaatccagcaactcataatagagacgtcgagagcgtccagctggtatagttcgtagattcccttgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagactggtgtcagtaataaattcttctatcgtcatttcttcaccggtcaccaacggctcgatctcctggtttggttgctctccaagctgagggactggtttggactttccagaagatgctttcttcagcgttcgctcatagtccgatagcttaatggcctccttggcaggtgcagacatacccctaaagaacttcctgacactcgggtctataggaatcttcttttctggacttcgaggcttgaattgtctcttgacttctgatgccacgtaagcgtcaagctcctcttgcgtgcaatcgtaccctgggtccttgttcttggcggcgtcaactttcgccttcttcgttgcccttgtgtgggcaggcggtggagcttggggggcccttgactttgaaggtgccggaagaggagcttgcggaggagtcggtgtaggagcccgaggaggagtcggtgcaggagcctgaggaggagtcggtgcaggagtctgaggtggagacggtgttggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcatagatgcgtatcactgtctcctccagggtaatccagctcgaggtcctcgtacgcgccttcgaccaactcaacttcgaccttggagtatcctgctggaatcggcctgcagtggtaagtacctgaagggtccgttgggatggccatgcccgatgccaccatcatgtggtgagaggttatttattagtaatcaacatatataagcagcaactagcggaatggccaaatctaaaatatataaactacgagcttacctttattgataagttcttgaaaggaatatgcagctcacatggtgtccgctgagtgatgtcatcaacagggcaggtggattcgtcctgggtttgtatggcgtccatgctctgtgatcctacctgccccgttgaggcgcagctgctacggtttcctgacgggctcaccattgcaggaggaatggtcggctggggatcatgggaccgatgtgcgtggcgtacgtccaagaattcctaatagggtaactcccaaaatatagagttctttttccacatcgccgcgtgaccatcttcgctctctataggctggcttctaggcccctttccgaacactactttaagatctttaaccatagcaaacattgttttcccgctgcgatgtttaggcttcatacggtggttagccttatgttcgaagtgcttgcctttcttccgtaccgggtggtttgctgcgaggaatcgacgatgacccatgtatacaaccttcctacagtgcttaagatacgtactttctgtttcatccatacagtgtgtgcaagccttgtaccccttgttggactgtccggataggttgctaagtgcaggccaatcattgatggttacgaacagcagcgctcgtatgttaaactcctcctgtttgtcctcgtcccatacggggacaccttccttcttccacaacagcttaagatcttcgaccagtggtcttaggtacacatcgatgtcgttaccaggttgcttggggccttgaataataatcggcatcattatgtacttcctcttcatgcatagccaggggggagattggagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccattgcgaaccatcggcggggtgtctcagcatcccgtcctgttgacgctcttcagcgtgccatcgcatcattctagcattccccttgttcctgaacaaacgccttagccgtggtattatagggaaataccacatcaccttagcaggaattgtcttctttgttagctgcccgtcaacttctcctggatcgtctcgtctaatcttgtatcgtagtgctttgcaaacagggcatgcttctaggttctcatactcctcaccacgatataggatacaatcattcggacatgcgtgaatcttctgaacttccagtcctagcgggcagactatcttcttagcctcgtacgttgtctcgggcaatttgtttcccttcggaagaatgttcttgacgagtttcaataaatcgcaaaatgccttgtcactaaccccattttttgccttccattgcaagaactccagagtggtatccaactttttgtgcccctgctcgcaacctgggtacaacgaagttctgtggtcctctaacatcttgtccaatttatgggcccccttttcactttcgcagtcctccttggcgtcctgcaacatctgaccaaaatcatccgcaacgtcgttaccatcagcatccctttcctcctcgcccgtttgatttccttcaaatccaacgtactgagcaaagttcggaatattgtcgtcttccacttcatcttcttccatttcaacaccttgctctccgtgggatgtccaacagttatagcttggcatgaacccccgactcaaacaagtggaaatgaatagtcctggatgcagaatactccttctgattcttacacttattgcatggacaacaaataaaacccctttgcctgttagcttcggccactctcaaaaaatagtgcacgccatcaataaactctttggaccgccggtcagcgtacatccattgccgatccatctacatgagtcgaaaaaaaatcatacaaaaataattattcttacaataataacagtcatacaataattataagataattacaaactgtttcaacagtcatacaataatgacatatctttattcatacaaaaatcataaaatattacaccaaataattcttatttactatttctaaagttttaaactaattttaatgtgttttacttcttttaattttcattttagtttgttttctagtattcaagattaattttcactatagttttccttctcaactattttataaaactttctttagcaaatcaactaaatttctatatattctttcttccccacacaaattttctccctcatcaacttacaactaatttttggagacaaaaaagtatgcaaaacatagctgcaaatgtaatatgacaaaaaaatattggaggatgaagttgcaaaccttttaggcacctccgatttgtatgtaatcaccaaaataaattcactagaaattttagcatgacctcccctcttttttgaagaaattttgaagcttgctcaggcagctggaggaggaagaagacatatatataggggtgagactttagtcccggttggtattaccaaccgggactaaagttacgatctaccaaccgggactaaagatcccggggggcctgacaggccctgacagcatttgaaccgggactaaagatcatctttagtcccggttggtgttaagatcaaatatgcccgttacccttttgaaccgggactaaagatcatctttagccccgatttttattgcatccgggactattgtggaattcggccgaccgacgaaagatggtttctccaccagtgtcagaatttatcgtaccagttgtttgattaggatgtgttttaaacataatcttcgctaagctgctttgtcataagcacgcttcctaaattagtttaggataagttttttaataaaaaaaaaattatatagaaatattctttaaaaagttcaaataaattttattttccaatattttttctaaataaaaaaagagtaaactacactcccggtctctaaacttgtgacgtcgtcccatctgggtccccgaactcaaaaaatacagattcaagtcataaaacttgctaaagtatgtcatttcggtccaacatagccaccaccattccagcatcctacacggcgctgatgtggcatgccacacggacactgatgtggcctcatcaatacctctacattgactgacaaataggacccacttaaaaactcttttttcctcccttttctctttctcctttcacttttttgtcctttctcttctcttttttttttgttgtacaagcggcgggggcatgcgaagtagcggcgctccggtgagcttccgactgggcacggctgcctaggagcatcagggcgtcgacttggagccggaggtgttctcggcttgggcagggacgcccagcggcggtgcaccgtgctgacacaatggcggccaaacaggtaggcggcaccgcagcacacgggtaccttgctggtgagctccgatagcaggacggctcggggaggagaggggaaggggggagtttggcatagagaagatgaggaagacctcaattttggacaaggatcgacgatggcgacgaattccgaagtctaagtcagcggcaataaccctaagcttcggccagaacggctccgctgccgacgagcgcaacggcaaaccaacctcgccaccctcgcggcgatgacaacgccactgccgccgttcttgagcaggccgtgtaccatgcgcaacaccagtaccgacggcggcggcaggcggcgacgcggcctcttcggggtttggttgcttcgggatcattgtcttgtcgaacaggtgatgagagatggaggtgaaggcacacttgtttcaacaacgagctccttgaggtaggtgtgcttgcggagcatgtcgatgacctcggcctttgaccgggaggcgaagaaacagagctcgacggcagccttcgggtcagacttgacgaggggcggaagttggcgactgcgtcacggctgcggaactactgtgccgcaacatcgtaggcatgccccgcctcggcctcaccggtaaacgtgccgagccacacgcagtcgcgccgctcccggccagagtctcctcgatgcccaggacataaccgcgtccatcactgcgctggcgccgctacccacacgttgcagcgcctccgtcgacgcggctgctgcgccggtgccttcttgcccacggacgcacctctgttcatgccatcaaaaagacatgctcgaccagaggccatggctacggtcaatgcagtaggaagaaaagaggagaaacgaagaaaggacatgatgggaatgaacaaaaaaggatattaaaaaaagttttttattggggcccacttgtcagttggtgtagaatttgtgatgctgccacatcattgtccgggtggcatgccatgtaggatcctggaggtgtcatggtagtttgggatcggattgacacaatttaacaagttttgggatttgaatatacattttgagagtttggggactcaaataacacagtcgtataagtttagggaccggctatacactttactcaagaaaaaactttgcatgtttttgaaaacttccaatttagcttgtcatcagttaatttgacgagaaaccgagaaccacatgcgcggtggctggcggtggtgtgtcccttgggccgcggcgtacgtggcggcgccctgcaacagtggatgcctgggtggacgatgacgcgtcaccaccatccggccccacctgcagccacacatacacccccgggccacaagccgctgacccttcaaccttgtcacggctactgctaccatgcgcggcagagcctcccatccccgccacgtcatcgctagtgggccccacgcgtatctctttgtggtcctccacatgtcagacatgggcccacatgtcagagagtgacgacgtagtactagaaaataatggaggaatttatttatttatttattatttttattctaggtaaacgtgttcgttttcctggccgccgcggcttctcctcctctcttcttctccgcggcgtccattcgattcgccctcgattataaataccccctcccccgccgcggcggcgcagaaacccgcgtctccgccaccaccctccaactctagggtttcgctcccgcgccgtcgagcggccagcattgccgccgccgccgccacgcgcgccatcgatttgctcgacgactgatgtgagtgatggtgtttggagtttcgcactgtgtccgctctatttcgaactgaactgaactgcgaggtttgggtttgggtttgggttttggtcgcgttggtggtggtggtggactggtggtggtggctgtgcgttgcatgcctgccggtgtttgcgctgggtttgggggggatttgtttgggttttttccatggctgtttttttttttgatcgatttcggtggcaaatttcttcgaggaacgctacgtttgtttgttcgcaaggtgcggcggctgccgggatgtggtttgtggggttgcttgcaaatggatctactacaagttgttctgtcaaaactttgcgagtttgcagtttggatgtctgcttctcgagtttttttttctgttttctgaatttttttatcgcctattaattgatgagtaacttgtgtttcgaattttcttttcgaaaaaggctatattcactaactttttcttactaaactcttagtaacacggttgtgtcatgctatgtgtgcatttaattttttttaacttctatctacctaaatcaaatgatcaaaattttagtaagaaaaaattagtaggtgtagcgttgcgcttttttttttttttactgcgtgccattggttttccatgtatctggcttaaaccgagccccaccacgcatgagggatgagaggaggtgttggatcgtacggttgtactcggacatgtttgtaagctagctagccgcggttaccttacctgacgacaattttgaagtggtttgtggcactgacgctaaaaagttgtgctgcaagtgtcgaactagtttgcaccttggtaaaatcttcgtagaaagtgtatgttgaaaatctatattcgtctcctccgaatacaaaagttcggaaaattatgttgcggtgtacgtagtacacgcaaaataaatatttatacttcaaaccgtgcatgttatataagtaacacaccaagcaattaagcacacgtctgatattttgatggctataagtttgtttcgaggtttctctcgatttgactcgtcttgaggtagcttgacgccttgacccgagtttgcaaattttgtagacgacatggggcttctgatgtttttatatgccaatatgtgtgtcttgaattcagtcaaaaaaatatgtgtcttgaaaatccatgtaatatttatgtactgtttctgaattttaattactattgcagcttctgtttagtctcgagctaagtacagctgatggatctactaaggactccctttaagggagtcgtcgctgatatcgaaggccgagtagcttggtacaagcatgactgggttgctggattccgctctggcttcaggttgatttttgtttcaaacagttaattcattgagtgtgtattccctgcttttgttgcttgttaatttcatttctgaattgcttatgttgatgcattgttaggatattggcacctaccatgtatatcttctttgcctctgccctcccagtcatcgccttcggagcgcaactgagcagagaaacaagtaaatgcttaccttcttaccactatgagtctatgctacagtcgtgctatttcttgagttattgttcttagtatttaatcacatttctaataaaagaaaagtggttcatttcagatggtatactcaccacagtagaaacactggcatctactgcattatgtggcatcatacattcaattcttggagggcagcctctgttgatagttggagttgcagagccaactataatcatgtacacgtatctctacaactttgccaagaaccagcaagctctgggggaacgactgtatttagcatgggctggatggtaacaactgaatctgaatactatcacgttagcttttcagaaaaaaagttaatgctctcctgatttgcctactgttgacagggtctgcatctggactgcgctcatgttgtttcttctggcaatgttcaatgcttctaatgttattagcaggtttacaagggttgcaggagaactttttgggatgttgattactgttctgttcctgcaacaagccattaaagtatgctatatctaataagctcagttctttctatcttggaagaaaatatttagaccagggcctatctattgcagggaattatagaggaattcaaggtgcctagagatgcagaccatagttcacctatatatcaattccagtggctgtatgtcaacggcctgcttggtgttatcttttcaattgggctgttatacactgcattaaggtcaagaagggcaaggtcatgggtgtatggtcaaggttggtcactttttcatcttatttttatctcatgaatccaattttgagagcaaaccgaactctgggtaatcaaattagcaacaactgttccattaatcatccatccaaccgttagatttatgccaaacatttctttagctgtgttgaagtttggactgggcctgctttagatcaggcttaggttgtgctgggctacaagcttgtgttgtgagcctctcagctttggaccagaccatatgggctccttttttccttcttgagtagacggcttggcttgagatggtgttttgtagcctttatattgacagattcttttttttaatgaacttatattgacagattcttattcctttatattatgtggatagttgctgcacagttttttttctctttgaaagttttaacatttagaaacaaaaacaagaaattactactatcttctctactaatatatacatggcaaagcttttgctttatttcaaaaaaaaaaaaaaactactatgtatgctacatcagtatgtaaatggctccatgattataatttgtaaccattgagaagcacatgtatgtgcactgatcattgtgcgtttgagttgacacttgcagggtggctcagaggcttcattgctgattatggtgtcccacttatggtgattgtttggacagcattctcgtacacgttaccaaaggatgttccttcaggagttcctaggaggctgttcagtccacttccctgggagtcgagttcactgcaacattggacggtagcaaaagtaattagtcaaacttgcttgtgatactggagatgtgaatatttatggtcttcaattttagaagtttcgcacagcttattttgcatggcatcattaataatatcttctctttttttattttcaggatctgttttcagttcctccagcatacatatttgctgccattctgccggctttgatggttgcaggactttacttctttgatcatagcgtggcttcacaattggcgcaacaaaaagagtttaacttgaagaaaccctctgcctaccattatgacattttggtcctcggattcatggtgtgtggcatgtttttatgatacaatttatctgcttatggcgacccttcttaagtttctcttagtatagtcttttgaataagaaatgttcttatatattttaaagtagagtttgtatttgttacaccaattgaatgggtatgattgaaaatacacctgcatttcttagaaaattaaattccaacatccgtaatatctgaattttttttgcgtgattatggcactactgcaatctacaaggcaatggcagataggatacagattctgctttctggtctaatgtacaccctgcatctatcctgtgttctgacttcattatcagtccaaaattgtggcatgctccttttctcatagtagtacataaatgatacaggtcctgctttgtggtttgatcggcatccctccatctaatggagtacttcctcagtctccgatgcatacaagaagccttgcagtccttaaggggcaggttggtgaactttagaccgaagtgttttgtttgctacggtagccatatttgctcatcagctcatccgtcttgttcctttgtttgcttagctgctacgcaaaaagatggttcaaactgccaacgaaggcctgatgaatcgtgctagcagtttggaaatctatggcaagattcaaggggttttcatcgagatggactgcgaaaaaaatgtaggtatttactcttcattactgaagtatgttaccatataatttcctctttaatttatctgctgcattttacttctattgtgaatgctggttcctgtcaaaattactagttgtcaagaaacttagtcctgctccatgtaattgcctgaaccccttacttttcacctaacgattaagggttcatacttttgcttttctttcaccaactattcgaaatgttgatgccactgttagtcttgtatggaaaatgttcaagcaaatcaacttataggtcaaaaattgtcctgcagactgattctgttgacaaggagttaaagagcttgaaggatgctattctgcaagaagttgataaagaagggacattgggtgaagaatttgaccctataaaacatattgaagcacatttgcctgttcgagtgaatgagcagagactaagtaacttgctgcaatccttattagttggtgcttgtgttggagctatgccagtcatcaagatgataccgacatcggtcctctggggttactttgcttatatggctattgacagtctacctggcaaccagttttgggaaaggttaagacttatattcatcccatcaagccgacgctacaagtaatatctctatctgcatctgtttaccccaattgaacaatgaaattgcatgcttgactacttgcggtgcagcctatgtgcctcctttggattaatcaaaagataatccattttttttgttagaaaagtgattaacagcttacactatgcttcatcatttgcagggttcttgagggtccccatgcctctttcatggaatcagtgccttcaaaaacaattactgtcttcacgatcttccagttggtttacctcttgatatgcttcggcattacgtggataccaatagcagggatcctgttcccgctgccattcttccttatgattcttatcaggcagcatgtcctcccaaagttttttgagccaaatgaccttcgggaattggacgcagctgagtatgaagagcttgaaggtgtccaccacgatcacacgctggtatacatttacctcaccttcttggattatttgcttgtagtgacgattttgtgtttcattcttcaatgctccgatgccccacatctgttgttaatctgaagtttggttcctcacaggaggatggtgaatctgattcaggaagctgtggcagccgtgacgacgctgagatatttgatgagctgacaactaaccgtggagagctaaagcacagaacttccagccaccgtgaagaaaggcacctgcaggtaattaaattatttgcaaatgaacaatattgcagcgaatgtgcacaggattagagatgagatgatagagggtgtgggcttaattaacaatttgctctctaaccttctgctgtggtcaactactaggctactagccagtctgttgaaataccactcacgatctattgtactttggacctaaaatggcatagagtaaattctcttcagttaagcgcatttcatggcatccttttttttattttacctatttgagtttcacaaatgtttcgtctccatcgtgcaggtgcattcaaacgccattcaacccaggtgtggagatactgaaaacttgtccgagtgctaatgaatttctgcttattctgtcggatgagtatattataggcgtatatagcacttcctcaagcagcggtccgttgtattatatacataatacattcatactttcatatacatcgtactgtagctggagatcggccgtacgatatgacatgcttgtacgttgtcaacttgtcacattgtgcatgcagtaaacagaagcaactggattttactgaaggtctgtaaggctgtgtgacatgtagatttcaatgttctctagcctgtgaattgttgctcctagattgttctgtttgattgtaaaattgcatggcaatcaatatggaatatagatgtggagtttgggctttcaatgcagtagcacttgatgtttcgtttgatctggcataagcttttagcgttttatttatatagaaaacactcgtgcaaaaagtaagtggatggactcccaagatggtcatgtccaagtttggccatttgtctgatttaattttttttagattaatatttaagtaaattgcacccacaatgtatcaacttggcaggtgggtgtaaattggtgtaaaaacttgtgaaatgagcgttctagtgcaacaacttggtaggtaagtgtaatttagtacaagaactttataagtgatcgcataagaacttgcaagatacgtacaattttgatataataagttaagaagttatgcgacaacttaattatttggagcacttttttttatacatattcaatttttaagtacttattttggcaatatactagtgtggatttgtatataagcatatttatatttttatcctaataactaataactgaaagtcaattaagctggatgtagaaattattatatttcggttgagatttgggaaggtgaagaaaacaaaaattcttaaaggtaattggatgtgtagtataatttttaaagataatatccttaggatttctatgtaatggcatattgacatcgtgaaaaaaaaaactcacctagcatatgattagctaagttgatgcactttttcaactttttaataagttttttaaataagataaacggtcaaaggtacttatggctacacttattttggaacgaatataatataataattttgcaccacgaaacgataaactgacatatggacaaaaagttgttccactttgcagagcgttgatattaaatcgagtagtgcagttgtgcaatcttagg

SEQ ID NO: 48325 - DNA, 22219 bp, Oryza sativa
  unsure (1)..(22219): unsure at all n locations
caactactagctctaattcatctatagctaatctaatagccaatttatacaatagttgtttactatactaatagtatatggtcccactgtcatacatacattgcatcttggagtccgtgctgcagctagctacagatctgtatcccgctgctcttctctctcatcttttatctcattaaaatatatttgtagctggctaatattctgctattgtacctgctctaattgtcgcctcccccgcttctgcttgcctcgccgccaacctcgcccgtcgcacctcttttctcctcaccttcacatacaatcgtgtgaagatttgtcttttagttaacattttgagggttctatcggtttgatttatcaaatttgaattttcaaacttaattttgatgttaaatttaaaatatttttaacatagttttttttatattggcttaagttgccagaaatatatatacaaaagttttactgtaaattaatttttgtttcctaataaactgttttaacatattcgaaaatatggacaaccgatgaggctgagtgtgtgtgtgtgtgtatatatatatatatatgcgcgcgcgcgcgcaatatccatcgccatatgcaagatacgctggcacaaatatggcaaaaacacaacaccctcaaaacaaaggcaaatatgcaaggcatatatgtctttttcccactaaattaacaccgagccgtagcttgaggaagaggaagaagacggggaagacggggttgccgaagacgaggttgaactcggcggtgagagagaagggcgtgcggcgcaggcatgggagccgaggggcccgacattgacgcggacggagatggagaatgggaggctggggcagtgggctagaggaggagatggtggagacaacgaaccgaagagcgctcacgcgagtcaccgctggtagagagatcggactggaaaggcagcctgagcatcccgattggtacgttgccccgcatcaatggtcgtcatcgtggaatttgatcgatgccatgaaggtcgatgggtgcgtgccggggagagggccgtcacggccgtcaacctccactccagtgccgcctgggcctctccgcatgctgtcgcggcctggtcaactagctgagagagagataagggaagtggagagtttgactagtgggttccacaccgtttttcaccccgagttgtcacattggtatgtcacatggataaaaatggtaaatagttaaagaagtcatcaccttagaggggtaaaaatatttgcaaaaaaataagtgcaaatataagaatgacatctagataattgtttattctagaagtggcaaatagttaaattttcgtttacaaccaatgctatgtatatcatcggtcaagaaataatacttttccctatgtcggtactagctatactctcctaccgatcatctatatgacactgtgatattgatcccaacgtcatactcatacatatccctgtacatgtctcgagttcgtacttaactacggattagtacgttctattgccattgaaaatttcccttatcgatccagagaaaagaaacttcccaccgaccaattaactggagtacgtgctcctccctccattaaaaaaaacctacaagaagatgtaatctttttttataataaatttaaacagtctgtctagtacaatgaatctggatagagagtgagtcagattcattgtgctagaagaaattacatctttacttcgattaagggcatccacaatgtactccaaaaatggtccataagcaatataatatttgattcagccacctagcaacattgtgaaactagcccataggaaagaaataacaaaagctactcataaacatatggcctgcctatagagaataaaatatattatttgtctctatctcttctcttctactaatactatttgctatccatatacattgtgaaatttataatagttaaagtttatatatgtgggttctagttttatggactacttttgtcatatatattgttgttgtcctcagtgttgtttttaagaacggagggagtgcattcgacgatgcttactcgtgacaaagtacaaataattagtgctaactcctcacaagcaacggcagctgcctattctgctttgtacccctgaacagcgaacacatggccaacttatatactgtactatgttctaatcacaatcttgatcttgccgaccacctgatccgtacgactaactaaacgctacctgagctagtgaaagtgactgcgtaatacttcctctgtttttttaaacattacttcctctgtttttaaaatggtggttttcgattaatattgtatttgaccttcgtcatattaaaataatgatattttcgatgagtatgtactaattattatttattttcgtgtggtttgttttatcattaaaaacgctttttatgcatgagtagtatttctgcaaatttatagtattgatgttttaacacgatgaatggtcaaacatatcaagtcggagtataaaacaaaggaagtaattatcaaccctcctctgcatattaggcgaccagacaattggacatttatgctgcatgatccgatcgagattagtataataaaccagctgataatataatcagaaacgtgcgtgtacgtgtcagctggttaattcgcccagactttttaatcagcgagaacattctggaggttaaacctgagccatgtttcagatgattcgcattttatccttttgtttcatccgtcagctgcctgcctggtctgagaattgcatttggactttggagctacacctccgcttttgatttttttcaagttaaacttttcttttagttttgatcaaatttataagaaaatatagtaacatttttaatataaaataaactatcaaaatatatttaatgttatatttaataaaattaatttggtactataaatattaatattgttgtacatttctataaacttaaaatgttgactttagaatagttaaagcaacttataaacagaaggaggagctagtgtagattaatttaatgtaatggatttagtgtgtgtacatatcgtttaaaatcttcaggattaattatttatttgataagaataatcaatcgattcaattgactgatattgaaacttgttcttttttattttcttgctacaaacattgtgtatatgagaaatttaaagttaaaaattagttttaaagattgtgttaaatttcatcatgtcttatttagtggaacggaaagagaatgacggaggggtgtagggggcattatttgtattgctttgcatggccgcatgctaaatggtaaatgtaaaaaataaaagtgatcttgacccagtgactcatcaaatttaatttacaggcattccttttttctagttatgatcataaattgtaatttttttctactctatcaatagaacttcgtttaaaaaaatacagacatccctttgaaacattcctggcagcatcaaactttattgagactaatcaacatttttacgagatgtacttgatagtgcagtggtaagtagcgtgtgattttaaccataaaatctcatgttcgataaaaaaatatttggagggacgtctctccctccaaaactcatttttcttaatcaatatttttgcatcgataattcaacatggcctctcatattctcatacagtcagtctcgttgtcatcttcatatagccagtgccttcactgccttgatgagcgaatctggactctataggcgccgtcatcgcttagatcacgattatcatatctttttttgtgtgtattttacagcagaattaattcgaaaatgcttctcttcgaacgtccgatcagatgaaaaacatcgaacgcctacggtcagctcagtccttgcttgctaatttcttctttctctttattgacgtcaacaaaatgttgtagatcagcagcctggtactgtcgtactgtaacatacatgcatatacatagttgtttcttttcattcttttctcatctctttaaatattttttcttctaaattacttatctgatctataaaccgatcacaccgttgtattcgttgcaattaaatctttacaacaagatatcacatgattatattatgtcaaaagaaaaacgtatgtttcaaaccgttaaaacaaaatgtttcatacgtgatagtgatatgtttcaatatgtgttttaagtgtgtttcacaaaattcctgaaactacctactactactctctctccacctcatgcatgcatacatacatgtattttagcaagcttcaaaataatttttctcttaaattacctattcaatctaagaaccgatcacaccattatattcgttgtaattaaatctttacaacaagatatcgcttgattatattttcataaaagaaaaacatgtgtttcaatcagttaatacttgttgtttcatgtgtaacagcaacatgtttcaacatgtatcttcactatgtttcataaaatatttaaatgttccagttgctgacttttttgtttcaccatatatataacatgatgttttacttgttggtcaactgcaacatttgaccatccgtttttttaatttaaaaatgtttcacctaatgtactcataatgtttcactatgtatgaatcaactattgcagtgagttgaaacatcatttcgctattcgctaaaacattattttcatataaggcgaaacggcgtccaataaaacattttcgatctacctagtggaacaagtccgatatacttggtgcaactgcgtgcaacatttaaaaataattcaataataagctaaaattttttttcatcggattatattcatgtgtggtcttgttttaaagatttaattgcaacgaatttaatggtgcaatcggatcatgatttggataaatattttgagagaaaaaatagtttaaaattcgtttgatacatgcatgatggatggatggtgcatctgtgcatggatcggacggttgcggaggcgtctgatttttcgtctcgcgccgtacgtccgacacgtagcgctctccgaattaattgtacgagacagtaaagtattagcacgtcctgtttaagatttataccaagcaaagtaccaacaaatatcttgtgaaggctacgatttttcttgtacacaataactgtattttttttgaacattataactgtacttagtagtacgattttgttacgcataggtaaaagggagtacaatgtaagtactgctatacacaaaatgcagatattttagctactagggtctgctttttaaggctcaatgactgaatgattcttttttttttacaattatttgatagcacaaacgaatgtattaaatactataaagttaagaaatatattttaattgttttttttcatgaattcatatatacaatgttttttgtaaaaaaaaatatagtaaacatttgctaatgatggattaattaggtttaatagattcgtctcatagtttacatgcggaatctgtaatttgttttgtaaatagtttacgttcaatacttcaaatgtttcaaatgtttgtccgtatacataaaaaaaattaacaaggaaataaacacggcctaaggagcggcaaacaaattgttagccacacccacgcagccacgcttgttgcttcctgaccaagaggctaccattccgtttttctgttcagatcataacaattcgagacgtcgctgcagctgcaatctgcaggatccaaactgaaaacccccaaagaaggcagcatgcagttgctacgttgcgccttattattaacagcccaatcgttaggtatattatagtaaaaagtgaaacgattattttcaaaaaaaaatctataaataaaacttttatacatgtattcttaacgatctaagaaaaataaacaacgatgaaaaaaaaacttaaaatctactctatatttaaggttaaaaatttaaactttggctaataggtataaataagatctaagactccaagaactcaccggccacacaaaaaactttgaagtacactcaagagcatgaaaagtccttgtctcttttaagtttttatcagggaacatatgagaagtccttgtctcataaaatttaaattttagagattcgtttttttctctttcttggcttgagaggtcctacattctccttatttggtagagacaaaagaagaggttgtggtgatgaggttgccgtcaggttcacgttacgttcctagcagctgcgagcatttcttgggtgtttttttccattgaatgcaacaacacatccgtgagtagtttcagtgacgcctggccaggtgtagggaaaatactttccagttttgaaagaaaggggtatttctcacccttaatttacgctaactcatggttatttatgtgtattaggaattacacatgatttaaacacgatggaggagtcttacacgtacgactacacaaagaatacagtaatactccaatacataaaaatatatgatgtcaccatttcaccatagagctatacaacttacggaaacggaataaaactaaaatattttggccattagaagtagaacctcatctaaataaccataaataaattatatatttttttattacacacaacacgtatgtgcacacataccactcactcactcacctgccagtttgctccaaaacacacgttttgaagagataaaaaccgccgcatagcccaagccctactatacatatgataaaatttcttgctaatgttgcttctatgaaactagtgcatgcaacaaacatgagctccaatataatgttttaatggcccaatcgttaatcatgcaaggcaggatcataacaagattttatcaattttatcatacatatagttattttcagcatagccctgactctgaatacccgtaaatttttattaaaaacggactcacacatacataatatttatagatacagggaatctactgacccactattgtccccctttaataagtttcattttaaccgatcatctgttagagtacgacatcttttacattaatgtaaacgtctcaaaactaaattacacctttcgctataaaactaaatcacaacttactgtttctcatcaatacagcgtggcaaatgtgtcagcatctcaacaaaaagctcctgcaatttactcctccacaacttcttttcattttggcatcgtaggctcgttagtagcagctgttcgttgcgcttagcttgttggttggacgagaaacccacatcggccgtgcctgctgctgctgctggtggtggtgatggccgtgccttcggccgcgcggcgtacgtggcggtgccctgcagcagtggatgcctgggtggcagggggaagctgacgatgacgcaacgatcggtacacgtcaccatcaccccggccttaaaattaatttttaggtttggttatcacatcgaatatatacaagcacatatttaaagtattaaacgtaatataatataaaataaaatatatgttccgctaggaaactgctagacgaatttattaagtctaattaatccatcattagcaagtgtttactgtagcaccacattatcatatcatagcgtaattaggattaaaagattcgtctcgtaatttacacgcaaactgtgtaattgatttatttttcacatttaatacttcatacacaagatgataagtgaaaagtttttttttaactaaacaaggccatacagccataccgtactatctctatcatataatataataattaaatcttttatttttttttcttcatcaatatttcttttccaaccaatcataatccttcattatttaatttttttcataactttatttctcaatcaatcataaacttgtcccatttaattttatttattttaaccatatctaatttgaaacgaattttatcttagaatgtaggtactccctccatcccacagaaaattaacttctgtgaatgaatctagataagtattagtcagattcattcgtagaagttatttttttagaacggagggtatatgtaggagtagagtatctttggcgctgacccttcaacctcagggagtcgtcgtcacggctgccatgcggcagagcccctagtatcaccggtgagccccactggtgtcagctcctggggcccacttgtcagagagtgacgccgatgagagagtagacaaaaagaaaaaaaatcctttggaatttatttgggtgtagctatatttataacacaatatttttcataaaaaatagtcggcatgtatttacattgtaagttcctaaatatatatatatatatatatatgtaattttagtgtatttacagtgtaaatctcaaaattacatatgtaagtaataaaattacatatgtaaattcaaaaattacatactaattacatatgtaagtgaggtgtaactactatataaatggctgaaaaaatcgactgtagtatatggcgtcatatttctaacaactccgatttatttttcaaaaaaaatactcctaggtaaacgggttctcgtctcctttgttttccagccttccagaggcagccgcggcggcttttttttttttcttttctccccttcttctcggcagcgtccattcgattcgccctcgattataaatagccgcacatcacgggggccttgaggtttgaggagccaaccccgccccgcgccgccccgccgcggccgcgtcgtctcctccgccacctccacgtctagggttcccctccgccgtcagcattgcccgccggaggtacgggtcctctcgccgctgcctcgattgctcggccgatgttgagtgagcgatgggtttttggaggttttgcagtcacggtgtgcgtgcgttccctttcggactgtgaagtcttgtgttgcatgctggtgtttgcggctgatttctcttcctacttgtggggagatttgcttgggttttttcatagttttttttttgatcgatttcggtggtaaaagtttgtgggttttttgttcgaggtgatggagaaacgcggcgcttgttcgtttcgcaagtgcggtggttgcgtgcgcatgtagatgtcgggatgtggaatgcttgcatatggatctaacaagttatctgtaaatatttcgtgatttgggtctctactgcttgatttttttttctttttgctgttttctgattttttttaccactaagtaataatattggagtaacatgtatgtgttgtttgctgttatgactgaaccccacgcatgacggcatgagaggagaggaagtgttggacacttgccgcggttacctgacgacaattttttagtgcttttatttttgaaagaacccagcaagctggttttattttagtgcttttatgcatgatgtttagctcagcaagtgaccaagtaatttgtatagtataaacttcctagaaattgtatgcagaaatgcaaatttgtctcctcgtcatgcagaagttcgaattacaaattacaaatgctaattatggtacaccaaatatgttgcaatgcagtaagcgcaaattaattacgtatactgcaaactttgcatacgtattagcaccaagcgtgcattttgtgatgattgcaagtttggtccgtggtttctctccatttgactcatctgggtagcttgacaccttaacctgagtttgtaaattttgtaacatgggggcttctaggatgtgtgtatgccaatatgtgtgtcttcaaaatactacgtatgtaatatatatgtaccatttctgaattgtaagtactgttgcagcttctggttagtattgagtggaattcagctgatggaactactaaagattccctttaagggtgtcgtcgctgatatcgaaggccgagcagcttggtacaagcatgattggcttgagggattccactctggcttcaggttaattttgtttcgaacaattaattttgcagtagatcactgtgtgtgttttcactcctcttgttgctgtcagtttcattccttaattattcatgttgcctctggatgtatcgtcaggatattggcacctactatgtatatattttttgcctctgccctcccagtcatagccttcggaacgcaactgagcagagaaacaagtaaatacctaccctcttgccactatgagccatactacagttgtgctctttttggaattgctgtccttaggctttaattacatctctaacaaagggaaagtggttcatttcagatggtatactcaccacagtagaaacactggcatctactgcaatatgtggcatcatccattccattcttggagggcagcctctgttgatagttggagttgcagagccaactataatcatgtacacgtatctctacaactttgccaagaaccagcaagctctgggggaacgactgtatttagcatgggctggatggtaacaactgaaactgaatactatcacgttagcttttcagaaaaaaaagttaatgctctcctgatttgcttactgttgacagggtctgcatctggactgcgatcatgttgtttcttctggcaatgttcaatgcttctaatgttattagcaggtttacaagggttgcaggagaacttttcgggatgttgatcactgttctgttcctgcaacaagctattaaagtatgctatttctagcgagctcagtgctttgtatcttggaagaaaatatttagaacggtgcctacttattgcagggaattatagaagaattcaaggtacctggaggtgtcgaccatagttcacctatatatcgattccagtggttgtatgtcaacggcctacttggtgtaatcttttcaattgggctgttatacactgcattaaggtcaagaagggcaaggtcatgggtgtatggtcaaggttggtcacgttttcatcttacttttatctcattgtgtccaatttagggggcaagttgagctctgggtcatcaaattagcaatagctgttccattagtcatccatccaaccgttagatttatgccaaacatttcttttgctgttttgaagtttggactgggcctactttagatcaggcgttggttgggctgggctgcaagcttgtgttgtgtcagcctgtcagctttggggcaaaccatatggactccttttttttccttattgagtggatggcttggcttgagatggtgtttagtagcccatatcgacagattcttattctgcacagtgtttttccctctttgaaatttttaacatttagaaacaaaaacaagaaattactactatcttctctattaaatacgcaaagcttttgccatctttcaagtaaaaagagaagaaattactactatgtatgctacatcagcatgcaaatgactccatgatgacattttataaccattgagaagcacatgtacatgaactgatcattgtgcgtttgagttgacacttgcagggtggctcagaggcttcatttctgattatggtgtcccacttatggtgattgtttggacagcattatcgtacgcattaccaaaggatgttccttcaggagttcctaggaggctgttcagtccacttccctgggagtcaagttcactgcatcactggaccatagcaaaggtaataaatcaaacttgcttgggatactggagatgtgaatatttatggtcttcaggtttagaattttggtatagcttattttgcatggcatcattgataatatctttgggttttttttttatttccaggacctgttttctgttcccccagcatacatatttgctgccattctgccagctttgatgattgcaggactttacttctttgatcatagcgtggcttcacaattggcgcaacaaaaggagtttaacttgaagaagccctctgcttaccattatgacattttggtcctcggattcatggtgtgtgccatggttctatgataaatttatctgcttatacccgtctaaaaaaattatctgcttatggcggcccttcttaagtttttttttctcggctaactaggaacctaacatcttttggtcctcagtgaacatttcatttctctatcacttctagcctaaaactagccaaaatcttttagtatagtcttatgaatatgaaatatttccgttcaaaaaaaatgaataagaaatattctcatatattttaaagtagagttggtatttgttacaacaattgaatgggtatgattgaaaatccaacatccataatatcttatattcttttttgcgtgattataacctggcactactgcaatctacaaggtgatggttgataggagtattggacactgattctgctttgtggtgtaatagaccaaagctgtgacatgctcctcttctcatatagtagtataaaaatgatgcaggtcctgctttgtggtttgattggcatccctccatctaatggagtacttcctcagtccccgatgcatacaagaagccttgctgtccttaaggggcaggttggtgaacttcagaccgaagtgttttgtttgctacaatatccatatttgctcatcagctcacccatcttcttcctctgtttgcttagctgctacgcaaaaagatggttcaaactgccaacgaaggcctgatgaatcgtgctagcagtttggaaatctatggcaagatgcaaggggttttcattgagatggactgtgaaaaaaatgtgagtatgtactcttcattactgatgtatgttaccatataatttcctcttccatttatttgttgcattttacttctattgtcaatgccagttcctgtcaaaattactacatcagttgtcaagaaaattagtcctaagctcatgtaattgcctgaacaccttacttttcaccttacgaggagtccccatacttttggttttctttcagtaactattcaaaatgtagatgccactgttagtcttgtatggaaaatgttcaagtaaatcaacttataggtcaaaaattgtcctgcagactgattctgttgacaaggagttaaagagcttgaaggatgctatgctgcaagaaggtgataaagaagggacattggctgaagaatttgaccctataaaacatattgaagcacatttgcctgttcgagtgaatgagcagagactaagtaacttgctgcaatccttattagttggtgcttgtgttggagctatgccagtcatcaagatgataccgacatcggtcctctggggttactttgcttatatggccattgacagtctacctggcaaccagttttgggaaagaataagacttatattcatcccatcaagccgacgctacaagtaatatctctatctgcatctgtttaccccatttgaacaatgaaattgcatgcttgactacttgcggtgcagcctatgtgcctccttttggattaatcgtaagataatccattttttgtcaaaacagtgattaacagctcacactatgcttcaacatttgcagggttttggagggtccccatgcgtctttcatggagtcagtgccttcaaaaacaattactgtcttcacgatcttccagttggtttacctcttgatatgcttcggcataacatggataccaatagcagggatcctgttcccgttgccattcttccttatgattcttatcaggcagcatgtcctcccaaagttttttgagccaaatgaccttcgggaattggatgcagctgagtatgaagagcttgaaggtgtccaccacgatcacacgctggtataaatttatctcccattcttggattatttacttgtcagtgatgattgtgtttcactctttaattctccgatgccccacgtctgttgttaatctgaatcttttgttccacacaggaggatggtgcatctgattcagaaagctgtggcagccgtgacgatgccgagatattagatgagctgacaactaaccgtggagagctaaagcacagaactttcaaccaccgtgaagaaaggcacccgcaggtaaactattggcatgaacaatattgcgccgaatgtgcacgggattagagatgagatgatacaatgcgtggccttacaatttgctctctaactcttctatcagcgtcactactagccaggcttgttgaaatatcgagctctttcttttttacggaagatcaaataccacgcacgatttgttgtactttctgcctgaaaaatggcagagttcacgtgcaaattcaaaattctcttgcgttaagcgcatttcatggcatccctttatcttttttatatatttgagtttgacaaatgttgatctccatcatgcaggcgcatacaaaagccgttcagcccaggtgtggagatacagaaaactggtccgagtgctaaagaatttcggcttactgtcggatgggtatacgataggcatatatagcacttcctcatacattcctactttcctatacatcgcactgtagcaggagatcggcggccgtatgatatgatatgcttgtcagttgtcacattgtgcatggagtaaacagaagcaactggattttacgatgttctctagcctgtgaaatgttgctccttgattgttctgttcgattgtaaaattgcatggcaaatcagatgtggggagtagcacttcatgtttcgtttgctatggcataaacttttagcctttttattattgacaaaattggttatatagcatcgaaccaattttgcctataacttactgtagcacgcagacgcaggagctcacatcctagggaaggatgggaacatgcacagtgcgcacggaaaacggagtaatctattagcgtgtgattaattaagtattttagctatttttttccaaaaatagatcaatatgatttttttaaaaaacaactttcgtatagaaacttttttttaaaaaaacatattgtttagcagtttaaaaagcgtgcgcgtggaaaacgagaggggagtgttgggaacttgctcttgcaaacacagtgtttgatggatccaatcttcaaactggtaagacaattcctcgatctccagttatattcctagtttatcaacttcctgcttgaaattaagattcagaaatggttcagtgatatttttagaaaaagtgtcgagaagacgaaataaaaacatgcaaacaaacatcgattttgtataaactataggatgagttatagagggattcaggaccaagtaattaaagggagcaagaaacgttggtgctgctaaatagctaaatcctagccacaattatattcatctaaaatcatgctcttgactgatcaagctaccacaacgtcaatgctgtctaaacataaatgggcagaacaattcacttcaaactaggaaaattctgtacaacatgcaaccaaaagaacagtatggcatgcatttggcaaactagacatgaaattattaccttttcatggtttgtccagacaggtaatatggcatttcactggagataaaggagagtctctcagacatccttctggcagtcatgtaggtggtgttctgatgagacaagcttccatttttagaataactagtacaacctagtagaatcttcttcttcatgtggaccttgatcatccatgttgtggcttcagggacaatgtagttgccctcgttcaacaagaagcaaacggtgtaagggttttccatgtcaacaatagggaattctggttggacattgggaaggcggttttcacaatcgaggtcccaaagttgggcagcatccagtgtcgcatcttctctccatgttccgtcctcgcaccacgaccacagggttatgctaaaactgccaccacattggttgatgatattgacgaacttgatgccatggtgggtggcacacacattacgggaagcttcagggcatcctcgcccacgctcactgtcataagggttccccataaccggatcgaccggaagcggtacataccatagagcaggctcctgtgggtctcctcctcctggatgtgccaatttggcaacaatcatccctctcaagtagtccacccagatcaagtagcgacggcggtaggataacactgcatcagttgaccaccagccggcaccattgatatggtcaatccgcacatccctgaagactctccagccgtcggagccggagaaaaacatgtagatgttagctgcagaaggttggtatgaccttctctccatctcggccacaacgaacgaatccttgctgcaggacaggacacccatggccaccctactcatgatgcgtggccgaggattgtctctgcccgaagcccccttccagtagcaaacgggcagccgcgtcaaggagggttccccgttgggcttggccttgtagacgaagtagtcgatgtcgatggggcgagggcacttggcggtggagatgatctcgagcagcacgacgttgccgtgcgccgcgatgacgtaagggtaggatgtggtcccctccgacgggcggggcccttgcggccagtcgagggtgaggagggaggtctccggcggcggcgcgagctcgaacgagacggagatctccttgccgccggaggtgcgggaggccaccgacgtggtgcggtcgccgcggaaggaatccctccgggcaccgacccgattcaggatcacccaggttgggttggagtcgccggcgccgtccaacgacagggctgaggaggaccgcttcggccgcccgtggccgccgggaatctccgtctccttggtcggcgttggtttgcgccggtgtacggcccgcgaaccgtcggacgatcccttgcgccgcctgtggctgggaatccgtgcccccgtccccgtctccgtctccgtctccgtggggatccgcatggcggcgccggcggcggcgagggtttggtgtttggtgcgcgaaagggtaaatcaaaggcgagagaggccgcaccacccgatcagttttcggcccggggaaagttggctcgttcttcgttgcaaccctatacagatacggggtgatactgtccgattgattgtcttttttttgtttaccagccgaattcctgaccgttcatctaagtttaagattggtgctttatccggggtcgccattttgcatagattgaaccctgttttgtctctccgctccagctactctactctacggagtaaacgaaactgtatatttacaaacaaaaagtaatttctaaataaaacttttatatatgtgttcttatcaatctaaaagtaaaggctaaaaaataaagtttgataaaaaaaacccttaaaattagctctaaatttaaggttaaaattttaaaatttgactaataagtataagcgaaaagataatatcctagtgcattccttctgaatccaccaagacacccacgggaggttgacactgtcgatgagacgggaggttgacaccgtcgatgagatggccatatatatagtcgtcactgacaatgtgagtctcttttctacactttggaggcaactagttaagggtttgattcgtttctaaactcgaatggcttggcattttgtttgccccaaaacatgggtagtgttatttgggtattatggagttcttgatagctatttagattgaaggatctgatttctttctctctctgatatgctgcatttgggatcaaatgtatgcaagcaaagagatggggtaaaaggggacaagtttcagtgcgtgacaggggaggggctacagaactccaatccaccgtaggtttgtagacaagattagtcatagcgagggatgcacataaataagatctgtactggtatactccatcccttctaaacaaaaagagactaacctaagagagtccgacatagacaacccgcttctctctcttatgttactgtcaggggagtccgtctttcccgaaactaaggccctatttagttgggaaaagtttttgggtttggttatcacattggatatatggacacacatctgaagtattaaacgtagtataatgacaaaataaattacagattccgtcagaaaaactgcgggatgaatttattaagcctaattaatccgtcatcagcaaatgtttattgtagcaccacttatcaaatcatggcgcaattaggcttaaaagattcgtctcgcaatttacatgtaatatgtgtaattgattttttttttgcctacatttaatgttttatacatatgtccaaacattcaatgtaacagcgcgattttttttccagaaactaaacagggcctagacccctgcaatgggccacccatgtcatactcatagaccatctatctgcgagacagcgagaggtagtgtagcaaaacggctccgtgcaccttgtccacgagtcccacgagtgcaccgggtccagtgcaccaaaaccaaaccaaaaccccccacccccacccactccgctcctcgtcctcctcctcctgcaagcttcctccctcctcgcggccatggcggcgccgttcgtctactgccgccccaccgacgacggcaccagttcgtccagcctccccccacctctccgcatctcctcctagctcgatcggcttgctagctcctcggccatgtggtctaatggcgatttctcggtttgttcgcaggtgagagcgctctcctgagggcggccttcgacgggaacctcggacgcctcaaaggtaggtttgcttcctctcctcctcctcctcctcctcctctccttcttctccgccgcgtcgatcccccccgatcgatgcgtgtatgcattgccccccctttgcatgcgcctgtgttgcgtgcttttcctcccttaggtttgggtgatgcatgtgtgtccttgtgtggagcgcttggcgatggctgtactgttaattgatttggccatggaattttggaatgcaaattctgtatctagcactcgttgcctttgggaatttcccacaatttattttcggtaatgtttatatgttgcatggatttttgaccctgcgtgaaggaattaacagccaggtctatggattactggagatgcatgccatcttatctagaaattgcaagatctgaggcttttatcgtagcaagtccttgcgttggataaatgcgacaacgttgtgatcatctttctattacagttacctctccaagtgctaatgtgtgatgagtagcaggtagtactctacaaaaatgtttttcaagtcgcaagtatgaagtataggttcacatgactcagtgaggttcttgcacgttgcacgtattcgtcgctttttcgagttctacctagttaatctgttcattcgcagattatcttcctcactgtgatgacttctttttgttcttatttgcgagaaggtattttaaagagccttgggatcgagaaaggaaagacccagtatgcagtcttagctcttaacaagcatgggattgggatgctgcacgccgtggcatgccagggccatctgaatgtttgcaagttcttggtggaggaattggggggtgacgtgaatattgctggaaaagaaggttattatctaactctaccatcctttcatgaaattggcggctgccatgtctatgttttggcagtataatgtgccaagtgtactgatgtgctgtttattacagatataacaccgtttatggccgctgctgagtctggtgatgttcctacggtgcagtattttcttgatcatggtggtgatgtaacaaaagcagatgttagaggatgcacagttctccaccatgctgctggcacaggtctcccttgatatgaacactatccaattccttgttatattaccaattatattgttgtacaagattctacgatactgcattactattaatagattacatttaattcaaccatgtcgtcacagttatcttttattgtgttgctaatctagatacttttagtttatatatcaccactcaaagttgtataggtttgctctgtttatactcggtcacatctcacatgtaatctattgtgatttgtccattatactggtactaactgtttattcaaataactcaatttatatagtatttgtttccccatgatttatggcccatctcattcactgcaggatgctgtaaggtaacagagttcttgctttcaaaagggatacctgttgacatagactgtggccttggaacaccactctttcatgctgctaacaatggcaaggataagacactgaagattttgttggatcacaaggcagatgtatgtagttgccactatttcttatttcctcttcctttttctcactgctagtttggatagatagatatttgttttgctttccacttagatagttagcttattagctgatgtacactgatgcagtggcggagccaggataaaattatagtgggggctcctcagacttttgggccttctaacaatctcagataaagtctattttagccccctttaatagatatatggatttaaattttagggggggtcttaatgggggctctaatgatctattagggggtagggggtctatagaccccccagcccccacgctgtctccgccactgcactgatgcgtgtttgcatgggactgttctgtttgcttggattgacccattctcagatattgcagtgcataatctatccttttggtttttactttgacattttatagaggatcttagatcatatggatttccaggtcttaaaaaggattatttcttttcttttttttggttatgaaatgaattattgtgatgagagttaggataccacgcgtagcacacgctactgaggcccctgatcgacgcggccacaccgcgtacatagcatcttccacctgcattgtgattattattataccgctgacctttgagtaatactcctaagtcctaaaattgccatttggcatgctctaaataaggttggctgatgtttttttgggaaagagcatgggagtttaggtgttcaattcatggcacttatataagctattatcctgctcttttatctactcatctctttaatgattgaaatgctttaggatcatcactagaaaaaaacacgcggcaaagccgcgtgcaatactggatgggccatgctatttgaccctaatgagacagaataatcagtttaacaacaatgcaagtattatctaaaaaaaaaagcgcaagttatagcatgatactacagtgcacaatcatgattgctgtagtagactacaaaatttaaaagatttttgtgacatatagtgtgatatagactgtataatctgaacaaaacacagtggctatttgtgacagacatttgaagagtattgacatattatcttcaacaacgggagacgacgacaggattctcgagaacccggccgacgtcctcgtaatcgtttgccggaaccaagcaacccatcgtcatcgtcatcatcctctagatgttgatctagagcttaaataatgaaagattttaataaagctccatgtcaactttgtattagagtaactggctagtagatcagtctaggttcttagtcagagctagatacaccaaaagtaatttggctagtagatgagaggataacaaaagtgtccatcttggactatagatagcaaaagtaggctgtcttgattggagaagttatcaggtagaacgcttctttttgccctttgtctgaatgaagccatagtcagtgctttcttcttcatcattttcctaaaaaagaaaaacagaatccttatcaaagtatattactaaggaaccagcaattctttctcatgcaatacttagcacaatgcaggcagtaggtttggcaagtatgagacccctagtgtcagccatatatgtgaatagtacatgtaaatagagaatagttgttgaccacagggtatacacttgcttgaatatttcattccattatctaaaaaaatacacttgattgaaatggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48326 - DNA, 867 bp, Oryza sativa
tggctccccatctggtacgcctccagctgctgcctgtacgcctccatagctgcaaacacacaccaatcctcgctagggttagccatggcgatcgatttagcttaggttacatacaattactcaccatgattgagaagctgcatgcagagagggagctcacgcttgaaggcgtcgatcttgagcctctcttcctcgagacgtgacaagaactcctgaagcttctgcgtcgcctgccccgacgccgcagccaccgccgtcagatggtggtggtcgtctagggttaggtcagaagacgaagaagccatggctatcgatctcctccctccaagtatacaagctctacaaaccaagctagctcacgctagctagctacagcaaatagccgaccgatctagctagtatattactactactacttgagatgaagtagctgtgcaaactgcgagtgtaagtgtgagtgatcgagatcgaatgtgagaagggttttgatgagggatcagatggggaatcagcttctttttaagggagagttttgggagaaggaagaggagaataaagttggatttagaggaaaaggaaaagctagctttgtatgatcttgcacatatacacttagctaaacagctatagctagctagcaacagtagtgagagatcagagagagagagagagagagatagggggataaagcaaaggcatggtaacttcttgcaaagatcaaaggcaaacaaaaacaaaaagaaaaaggttaattctgctcctcctctgcatgcaggaggtttcatgtactacgtaccaacaggggaatcaacatatctcctaacattacgaccagatgggtccatattgcatatattgcaccatgca

SEQ ID NO: 48327 - DNA, 913 bp, Oryza sativa
gagcttggctagcttgagctagagcactcactctcactgatcacttgctcacacacacacacacacacacacactcactcacctctccaaccaacacggcaacacaccaacacaacacgagtatttatacatgaattgccattgccattgccatggccttcttcttgatccccattgtgaaaataaagccaagtgctcctaagctagctagctcatgagacttgtttctatgtgcatgtaagatgcatctctctatctctcttttcatgagaggaataaggtggttggaggcatgtaacatatgtgttgagtatagtacaaataagtggaggagagaagaagggcaacagagagaggggctatttttgccagaaaaggaggaatcgttttcatcccaagtacttccaatggtttcatgcccccatttggatctcctctctatatctacagcctttctggttaagctagccctcttgtctccatgcatccagatgctgcaggttcagtagtgacagagacacagagtgagtgagtgagtgagtggagcctagagaaaaccagcttacaattgcatgcatgcatgaagggaattgatgctgtgcatgcaacagtccaatgccagtatgccactgtgctagtgtgcatgcatatgtggctctcattgcatatgcatgcaaaaatcataaccaaattgtatctcaggtgttgatctttcagtttcctatagcaatgcgtgatatttgaagtattgttagtcttagaaatttcaggatggctagtgtcatgaggatggattctaatctctcgggtggacatccactcgtttcttgcatgtcacctaaatgattatgaaaaaatttcaaaacaaaacacaagatagtttaatatgtaatatatcacttcacaaacatgc

SEQ ID NO: 48328 - DNA, 964 bp, Oryza sativa
caaatgaccagtatgttgtgtggtatgattctatggtttaaaataaacctggtctaaattgcatcagttgctcagtttctcagcagagttgatacattttagagaaggagtaaaaattaaataaaatagcgtttgtgcaacaccctaggccaaaatgctctcaaagtctaatctccaagtaatttgggtgtacgactggtacatcttacgagcatagaggactggtgtaaatttatgaaaacaatactttgccaattatatacttctttaacttttctgaaaatattgtatattatctagcaactgtggctgcttcataagatcatgcatcccttacaaacctccatatgttaaagcagataaacagaaatagactgtttttaagttctttaaagctttaccaagcaagtcaaatgcatgttttgggtcattacaatttcaaatagcagcctagcaaatggaatcaaatatatgaaagctgcagactggagaaaataaagcatacctggtttttctatgaatgaaacagtaaggctccatcagacatcctcctttgcttaatagcataacggcgcaccagattagctccagaccacaagataaatttaacattactgcaagaaattcttacatgaaaatctctgcaaagctggaaaagctccaagtgtaagatatcttggcaagtcgcatagtgaatcatgtacagcatgttagtaaaaggatttgttttaaaaataaataaattccatacatatcatatttcgatttttagctcataagaatctgaatgagaaaacctccttaacagaatagtctaaattaaggaacaacttattgagaaatcaggaaaaacttaatactctctaaccagaaaaaggaaaacagatttcagcatgacataaaagagaacatgtaagggtaccttcctttcaataagaactttgccagtacaaccatcagcgac

SEQ ID NO: 48329 - DNA, 13001 bp, Oryza sativa
aaagtgactgccaacttctcactgtgccagtaaagaaccttctgcttttcctcttccgtgacttcaacaaggacctcagttacatcaggcacatatccagcattcctcaaatcagttagcacattttccaactttgagtagatttctttattcataggatgagacctatcagcggctacaaattcgtgaattatgccattcatttcaatcatactgcaaccaggttctttcttgattcctttctccattattatctgcctaatccgtcggacatctttccatctattagattttgcatacatgtttgacaacaagatgtacgctgtgctgttatctggatccaactcaaggagacgctccgctgccaattcacctatttctgaattaccataaaccctacaggatgccagcagggttccccaaatagtggagttgggcttcatgggcattttgtctattgtatccaatgcttcctttaatttcccagctcggcctaagacatcgattaagcatccgtaatgcaccacagtaggggaaatattatatgcctctgtcatgctgaggaagaactctcggcctttgtcaaccaagccagcatgagtgcaggcagtgagaacaccaacgaaggtcacctcatctggagtttgtaaagccctgagcattctatagaacatgtcaatagcctcctccccacggccattcactgcgagaccaagtataatggcagtccaggtaaacttatctctgttgtgcatatctttgaatacatccaatgcgcgctcaatgctcccacactttgagtacatgtctatgagtgcattcccgacaaaaacatccatcttgatcccaagtcttcccatgtaaatccttgcccattcccctgtctccagagcacctagctgggcacaggcagtgaccacactgaccatggtgaactcatctgctctcaccttgcaaatctgcatgtaacggaatgtctccaatgcgtccctgaacctgccaacctgtacatagccatcgatcatcgcggtccatgcgatggtgtctctttcaggcatatgatcaaacaggtccctggcacgatcaacctggcctgacctcacaaggccagaaattaccgacgtccaggacgccatgctcctcatctgcatgccctcgaacaacacccaggccgcgtccatgtcgccgcactcggcgtacatatcaaccagagcgttctccaccctctgatcaggcaacaccccgctctcgaggacgcgcttgtgcacctgcatccccagcagcaggtccttccctttcccgcaagccgagagcaccgagacgtaggtgaccgcggtggccatggcgctggctctgaccatgtccacgaaggagcagcaggacagctcgaaccgcccgctcctgttatggccagagatgagcgcgttccacatgaccggcgctccccctcccgtggcgaggcacgccgcctccagcaccgcgcgcgccgcggcgccgtctcccctggccgcgtacatgacgatcagggagctcgccgcgtgagcgttcgactccatcccgaacttaaccacgtgcgcgtggatggcaccgccaactgatgccgccgccacggccgcgccccgcgccgccgccgccgccttgagcaaggacgggaacgtgtacgcgtcgggcctggccccgccagccagcatgcggacgtatcccgcaacagcctcctccgcgccatggccggacacggacgaactcgcagcacgcccccgccggtggggaattccgtcgagcaggctgcgggcacgtgacagggcgcggaccatccgcctcacctcctctcctcaggcctcccccacgcggtccccgccattctattgacggaataaccgccggcggttaccgcgccgcctccccgcggaatcccggggaagacgaaatttccgcggcgagacagcgggccggcggcgagtgcttcgccttctcttagtcgctcggtgtttttttttctttttttttctgaagccaaaggcacggtaaagcatcaggtaaaataatgaaaaatatttttattattatacggttattattcaatttgtactagtatacgacgggtatacgtacatgtacagatgtacaggtataatgaaggatttttgttgtatctagcaacgtcgatgtcaccgtacatatgtacgcacatgtattattgtacgtatacgcacgaataggacccggaggtgcagagagatttttcttttcagataatagagagaattttgtttgtcacctttacgccatgtttgtttggagtcctcgttaattgctctggaatgtaaacaatatatggtacacggatattaattgcattctgttttgagttctcataaaagaacaaaggtcttctgtttttttttctctttgttaatctctttgccgttttgcaggcaaagttggttgttttcatccctttttccatcttcgtctaattcaggtagagcccttgcttattttcttagaaaacatggtaatatggtgcttcggattgtatcttcacatctttagaataaaagccagcgtttgtttcttgcgataattgaatccatgtcattacaactttacctaattaaaaaatatcaccactgttcatgatatcgattgggtgccatcaatattttttgaaatttgaatcatgtcatcatcgtcacgttttccgtccttttttatacatataaatgaattaaatatactaataaaattgaaaatatatgcttctagaaaaagtatgtttaggagcttgaaaaacgtgcctattcattctattgatcgagatcgagtgcaaaggaagaggatatgatgttgtactcatatttatatccatgaaaaatggtaagagtctcgggcagtgtttagtttccttcaaactttcgaaaattccgtcacatcaaatatttagacacatatatggagcattaaatgtggataaaaagaaaaaccaattgcatagtttgcatgtaaattgtaagacgaatcttttgggtctaattacgctattatttaacaatgtagtgctacagtaaatatttgttaatgatagattaattaggcttaacaaatttgtctcgcggtttacaggcagtctttgtaatttgttttattattagtctacgtttaatactttaaatgtgtgtctgtatattttaaaaaaattggcacacgaactaaacctgggctcaatttaaggaaaaaatgtgcacttgaaataatgatgaggctaactttgggttcgttgaagacatgacatgacagcaatttttgtaacctcttcacgtgagctataaactgaattacaatgactaacctagatgctactactagtacatctcagcaaaaaggactaataataacctattgatggctagagaaacttttaacaacgttcgtgctacataggcaagcttaacttgcgttgcacttgtacggatataatgcgcacacatgtatataggtatagttctaaaaagaaaaaagtaaagttggtatgcaatgcactgtatatggccaacgatgctcgtggtccattcgaccatatgggctttggtcccataaaaacgtagtactacattttattgaattcattatcaaatacattttgatagtatatttgtttagtgtcggaaataatgcttagattttttgtaaatttaatcatactttaaaaagctgacttaggaaaaacttatttaaaaaccttattatatgaaactgatgtagtaatggtcaaagtcacctattcttagtcgaaaggatatttccgctcacttggtttatcaattaagcttttgcaaagtcaaggtaaatacacatacaacatatatgcatgacaccatgtacaaccatatatagatgaacaggagtatacatacctacgttgcttaggtagcaccttgatttaatcaaatgctagctagttgatgccaggtggcacactgcggacggatttgtttgtcagtttccctgcattacacattgtacaggagtgtactacatccacatacaatgaacagtagtagtagcagcagctatatactccagttgcctagtcgtacacaaagtataattaatcacaaaattttcattttatcatggaaaataagtaggcattcataatgcacgtacactccgcacccatacaatgaacagtagtagtagctactagatagttgcctagttgtacacgcagcataattaatcacaagattttcatttttcctaaaaaaaaacaagcagacgtataatgcgcgcacactcatcctacctttaatgagtatcttcagaagattgagcctgttgtcgtcgagaggtacagggtatgtcatctatcactcaaagaataactagtcgtaaatacgagtaccgggttgctgtcaaggggtataggttacgttggctatctcttaaagaataatttgccgtaaatgcgaataccatcaagcctaagacttgcatccatataggctagttacaccacaaaacctaacgtgttaagctacgctccctccacacaaaattttcatttttacccagcaaaaataaatgaatactgaagcatgcagcgctgtacacgagcttcttgtttatcattgcgtatttgtcatcatctaaaaaaaattgcgtatttgtacgcgtacatgcacgtttccatccacaatttcacatccatacgcgggtgacatatattatgcagctctcgtgggcatagctcgccagccaagaacgagctgaagctctcgtgcgcggcgcggccatgaaggcgtcgtcgtcgtcgcaggggcagagcccgaggacgccgtcgccgcgcgccacctccgccaccgccgagcacacgcggtcctcctcggagccgtggctcgtggcggcggcggtggcgagcacctgcgacgactcgtgcgtcaacgacgtcgagaacttcgcgcgcaccgtcgccgccgccaagtctaggcagctggtgggctcgtcggcggcgtcgcgccccgacatgctcgcgtccgtgctgtcccactacgccgccaagtggctccccgacgtggtggccgcgtcgtcgtcgtcctcgtcgccggcgacgtcggcgtcggggcggttcctgcccccggagagccccaccgccacgtggctcaagaagcggctcctcctggagtccctcgtcgccgcgctcccgcctgacccgccggctcccgccggcggcggaggagcggccgacgacggcatcacgtgcgacttcctgctcaagctgctccgggcggggagcatggtgggcgccgacgcggcgctgctgcaggagctggagtccagggcggcgcggcggctggaccaggcgacgctgggcgccgtgatgataccggcgttcgggcacgggtacgcgtgcgggacgctgctcgacgtgccgctggtgctgcgcctggtgcgcggcttcctcaaggacgccggcgccggcgggggcggcgccgccaaggcaggcggtggcggaggcgccgccgccgcgagggtggcgaggctggtcgacgcctacctcgccgaggcggcgctcgaggccgggctgcggccggccgagttcgaggagctcgcgcgcgccgtgcccgcgcacgcgcgccccgccgacgacgcgctctaccgcgccgtcgatacctacctcaaggtcacccacacgtactcctccttccatctccactaattttacgtttccgtttactactaaaaaaaaaagctaccaatgtagctttgcatattgtgtctcgatataccgataaggtcttttttacaccttatggacaaatttgatgtcgcaatcttttcggtttcaaaaaattgatatcaccatcttctacatatcgtcaaaacaattgtgaattattttgggaccagctagctacattttaatattcatggcgttacaatttaagaaaaaattgtcaaaattttattacactgtaaattacatatacttacattataacatttttaaaacctacactgtaatttaaatttgcagtacacgtacaatataataataataataataataataataataataataataataataataataataataataataataataataataataataataataataataataataacaacaacaacaacaacaacaacaacaataacaataacctacctagaactaaaatgggataggagagagaaacatattgaaagtagccgtaaaaaatatggtgtcataattttagcaaacacgaattatttcattcagaatattttataactatgtaactaatatgcacaacatttagtaaaaagaaggttttgaatttttttactcgcaaaatagaatattttgatttgactgttatggtgaaattcttgtttttctttcacaagaaattaaattccagctgacatggtagctagtggtgtgttgggtttgcactagtagcagctagcatatgcaaagtatgcaaccatgcaaatgtgttggccgatgtgccaacgttggatgcatcatgcatgttcaatataaatgtactgaaccaaatggggagttttgttctttggtcaatcgccacgagacagcctgaaaatttgtgaggcgtctactgcatctgtttttgtgtttgaccactgaaattgcatcggacaatgcactaacagcatagcatattctacatactccgtttggtagtacgggtgctcacttttctctgtcgaagagaatcttgtgtgtcatctactcactaaacatccttttggttttttgcaagtataagtataaagtttagtgtagggtgcacaatcaaaataaaccaattagatataggcttggaactttggaagaaacaaaatttgtgtaatattgtatatcaacaggaggagaatcaggacaactgataagacctgttattttctcccttgggtttgttttgtcttgttagcttgtgaactgaatgattgatatcagtagttgcttctcccacttcactaatatataaaactaaaatagctcattaaggccattaagatccttctttgtgtttgttctgttggtgtttactgtagtgtccaaactataaagttactaatatctgaagattgttcagccaaatcacttgtagtttttttttctgaaaaaaaaataaatcgtaactcggagtacttctatgaagtagggtaagaacaaagcgtagggaagagatcacgtgagctccaaactgctaaagaacaaaggtttacctgtatttacacatgggaataggtgctttgtggatatcaaatccttcttgtcccttagcttgctgcctgctgttctcatcaacacttgtgctttgtcctggtgcgagtgactaacaagcagttttactgtagctgcgcgtttcaacaaacaaaaaaaaccacatttgtacttaattatttttagttgtttcattcaattttatcaaccgagcaaacgagtgtccaaagagtactaagagagaagatcatactcctaggcctggtttagattcaaagtttgaacccaaatatgtcacatcgaacttttctacacacacaaactttcaactttttttcgtcacatcgtttcaatttcaatgaaacttccgattttgacgtgtaactaaacacaccttagtactctaaaaacgtgtggatgattgaaattgccagataaacatgcaagtatcagagatcttgcaggcatgaacagtcatgcaggtggtacttattaacagtctttaacaaccatcgtaccagactactgtataacagagccaggagattcatctttcaatttcatggctctacatgtcaggacttgacagtgctgagagtttcagatccaaatgacaccaaacaaaaatcatgtggaattctgtttctgctgttctctgcgcttttacagatcccctgttcatcagaaatgccagcaactcagcattgttgctgctgtctgcaaatgaaagattctcaatgtcaaaaccaatcatatgttaggcagttaggccatgcaagttcatgccaatggcactatgccaaatatcaagatgccatcttttgttcagttctgttcttcaaaattttttgtctagaataaatttacactttgttgagcaaaaagtgctgtgaaatcatgggagaaatgatttttcaagtgcaaaaaatattttttaaaaagaaaaaaaggccgtttgtggttcgctgttggcgccacttgttttgggggccttttgggagtataggattttaaacccctcaacctccctagcgataggagtttttccctcttagtagctagtactccctccgtattttaatgtataacgctgttgactttttgaccaacgtttgaccactcgtcttattcaaaatttttatgcaaatataaaaatacttatgtcttgcttaaagaatatttgatgataaatcaagtcacaataaaataaattataattacataaattttttgaataaaacgaaaggtcaaacgtttataaaaaagacaacgacgtcatacattaaaatacggaaggagtaacatttttgtttgttacttgttttcggttcttctatccttgtccactgacaacagccttctgctgcttgtgttgtgtaattaaactttacttttcttcttcttctattttacttttcttcttcttctattatattgatatgtaatcattttgcgcattagtgaaaaaagaaaaataatctatctattatattattaaaacagtcttgaaaggaggcaccacgttcgctgtggaagctagaaattctcacattaatcggagaaaaagaaaaggagagtccaagtagaaatacaattcaaaaatagctgaaattcggaattaaaaataagcgatattgaaagatgtgtccatataagaacccaatacaaaattaatcaaaattcgaaataaaaataaaataaaatccgaaattagaaaataaaataaaagttcaagtaggaatacaatttaaaattaactgaaattcggaattaaaaataaggaacattgagagaagagtacatataagaacccaatacgagattagttaatattcggaataaaaataaaaataaaatccgaaattagcaaaaagaaaataagagttcaagtaggaatacaatttaaaattaactgaaattcggaattaaaaataagcaatattaaaagaaggatccatataataacccaatacgagattaattaaaattcagaataaagaaataaaataatatccaaaattagaaaaactaaaagagagttcaagtaagaatacaattttgaaacaactaaaattcaaaaataaaaaataaaaatattaaaagaatgctatatggtattaaataatttttttaaaaaataaattctaaaataagaaaaataaaaaatatttcaattaggaatacaatttataaataactaaaattggtgataaaaataaagactattgaaaaaaaagaccatataaaacatacgatgagataaattaagtaacaagcctataaaagagtagagtggtggcggttgatacgacatataaaaactattagtaaaacaccaaatagaatcttaataatgattaaaaggagggatgataggcaggccatgaagcaaacgtgtaagatggttgccggacttctagaaagtgaaaaaaaaaccccattgataatcatattcgattttcaaaatctcaatgacaataaaaaagagaagcagcgggcatgatgtataggattatagttccagagccaccgatggttggcgggacttctagaaaataaaaaatgaattgaaacgatagttatgttcgaatttcagaatcccaataacaataaagagtaggcggcgaatgggtcgtagaggagtatagtggcatcatttgacgtcacttctaaaaattataattaaaaaatgaaacccaacaagacaataaattgtaaaaactacaaggtccaatttttaaaggttcggaacttctaaaaagtaaaaaaaaaaacccaatgataatcatgtataattttaaaatctcaatgagaataaagaagggagacaccgggtgagccataaaggagtacaatggcaaagccactgacggtttggcgggacttatagaaagtaaaaaaataaacttgaacgataattatgttcgatttgtaaaattctaatgacaataaagagaaaagacagtggatgggccgtaaaggagtataatggcagcgtttgatgggacttccagaaattataaaaacgaaacccaacgagataataaactcaaaaaactataagatctaatttttaaaggtttcaagaagaataaatagaaatagtggtagaccgagcaagcaaataaaaaaggatatgacagaagtaacgggtagcagctggtataacttttaaaagctacgtaattagaaatatggggatgatacgtggatagctatttaataaattttaagtgaaatcatactgaaaaatatatgattttgtttgggtgctagccgcgcaattatgcgggccacccaactagttttaagaaagagctaattttttttggctgtttcatggtgagcaggcacacgcgagcacgagcaaggaggagaggaagtcgctgtgccggctgatcgacgcgcggaagctgacggcggaggcggcggcgcacgccgtccagaacgaccgcctccccgtgcgctccgtgctgcaggtgctcttctccgagcacggcaagctcaaccgcctcgccgagctcagcggcggtgcctcctccttcggcgcgcccagcccggcgtttgacctccccggcgcccgctgcccctccaagcgcgaggtgctcgcccagcaccacgagctccgccgcctccgcgaggacttcgcccgcctccaggtacggccatctccgccgccgctcgccgccgttcatcgattcgattcaaagctttttgaggtgttcgtcctcgtcttcgtcgcgacgtgcaggtccagtgcagcgcgctgcaggctcaggtggacaggctgagcacggagaggaggcggcgcggcggaggcggcagcggtggcggcggcgggttcttcaagtggagcacgttctggttcggcggcatgagcgccgacgtcgcgcgggtggaggactccgagagcggcatcgagcggcggacgccggcgagcgggaagaagggcaggggcggcgccgccggcgccgccgccgcgacgccgacgccgaaatggcgcaagtcgatgtcatgagaggatctgaaattctgaagccaaagctgatggctaagtgggtcgttaatctgttttactacctttaattacagtcagttacctttctgtctgaactattgtttgtggtgaaaccattcagataaatctgctcacttgagtgcataaataaatctgtgatgttctaaaaagagagggaagcatataagatttctggtttggtcgaggacgaaatggacttaagaatttagtttctcttcataaataaatcaacaaatagttgtacaacgccagtatgatcacataatagtgaccatgaacagtaaatgtctgtctcactagttgcagaaggaactctgcaaagctatgtatgcctcacttgagtactaacttattcagctacagaaaacaaaactagcaatttgacacgaatttaaacacacagatttgaagaataaacaggttgaaatgtgctgcatcatggtgcaaagaattgtttatttgttcactgctttcttgatggcttgcttgcacctggtgaggaacttgctgctgcttgtggacactgaatcttcatagccgtatctgccattgtcgtcgccgaccaccttgggcttcctgctcatgcactccacaccccttctcattccaaggatcttggaaggtgaggaaggcagagacctgaaacccctggagctgtcagaccttgggaaccagatcttcttctcctctcccctctccttgatctcaaagctgttcctgcacctgtcctgctgctcagtagcaccatcgccaccgacctcgacgatctcatcggagcattcggtgatctcattcctgcagctctcatcatcaattctgctttgcatttggtgctcgtctgaagcgatttcatcagcagtgttgtgatcttcagaagaatgatatgctgctgcaggatcttcttgctgctgctgatcctccatgagcatttgaagccacttatccacagttcctttgccggtgtggttcatgtttgcgtcgccttcggatcgaccgacgccttgccgatgaatcacattattctttttcaatagcaccgatttctctgcaggatatctaggtgttccatacatgccagttactctgtaaggaggacttggaggaactgaggatgtccttggcactgaaactgtctgagatctttcagtctcagactcacattgcaccatggctgctttgcccttgccattgccatctcttgacctcacaggagtgctagttgcccttgatccccttgatgacatggtcctttctctccttctgccgcgctgccgttctttgatcgccagatgctccagcttctccctcactgatgctcttcctctctcagtgtcaactgtgttgtcttccatggacctccttgggaagtttatcaccttgaaaggtgaattcctgaaatttcccattgttgaagtttcacctgcaatttcctcttcctctagggagatgtatgcatctgaagccctctggtcctcctccaggaaaaccctcagctcctgcttgagagggtttctgctcctcagtcttattcctggaaaatacttcaccctttcactgtgcctttcttctaagctgtgcctttcctctagcaatccatcatcgtcaacacgataccgcttccttgcttgatcggtgaaaggcttgatctgcttctccagttcatccttctgctggtacttcctccggagctcggtttcggat

SEQ ID NO: 48330 - DNA, 2706 bp, Oryza sativa
ctgcatcaacaaattactaaattagatgcaaaatcatctctaattaaagggacttactatgtttcagttgattggttatatatgagttggtttagagactagagatgtctataacaagggtaattttaatatctctgagaaggtactaagaggtaccatatttctatggtaaatttaatacttctaggtattaagtaaggtactaaaattttgatatctcaactgtaaaattccccctatataacaattaaaaaagaaaaaaaaatatccaaatactcctctaaactttagatagaaatacttctacaccctaaactttaaaatcagatctttgcaaaaccattcatattactccctaaggtggttttgtatagttatttttatctaatttttatataaattggatgagtttgatcacatggcatacatattggacacacatgtgtgtgtatgtgtatgtatgtaggtacaatggtacatacgtatgtagacagctctattaaatggagaggcaagtaacattagaatttagaaattaccagtcaagcgaaagtgatttaccgttttgtagttaagcccagcgggaatggtacaccttgagaggtcagccggagtgaggccgtcgttgttggcaagatccaagcaaaccctgcgattccgcagcaggtagcagaacacgttgaggacaccgctcgcgaccgccaggtgcagcgcggtgttgccgtcgtcgtcctgcgcgttgaggatgggcgtcgccagctgagagccgtcccgcctccgcctgtcgtcggtggcgaatcccacgatctcctccctcccccggtcgacggcgacgtggaggaaggtcctcccgcgggcgtcgcggaggccggcgcactccgggcacctgtggaggaggagggccacgagcttgaggtttcccatggacgcggcgacgtgtatggggtactcgccgttgctgtccggccggcaggctaaggacgggtcggctttcaggagaacttgagtcgatgtccggcggcggcggcggccattgcgcgagcacggccatcgcaaggcgagccgccggaggagtgagctcttctcgagctcgatctctggtccctccgctgaggctgcgaaatggagcgctgtgctgccggatgcgtcggcttcgccggagagaccatcgttccattgcagcatcttttctgtcatttctttataatttacaaagcaaagcttaagataaaccaatatacaacacggtagctatcaaactattgctcagcactgttttttttttaaaaaaaggcataattttaaactgtgatgttttaagaataatttttaagtgtgatcttagcaatcgtaaaggagtgtttattcatcagttgattgaattttcataaactgccattaggaatgaaaacgtacggctcggatactgtgaaagctacctctactatatttgctttcatctttttatttaaaaaccgaaacgaatactctaaaatccagatatgaaaacgaaaccaatcggaatgcatatggtcaccaatatttatcggatcaccataaaagcttcatatgatgggcctccgaaatcaacggagaaatattacttcttgcatatcaaagaatggatcaatttttttaaaaagtactcgattttgctatagatttgtcatgtgattttttttctctcagatttgtcgtttttaggccgttccatatgtgccaagatccgtgcgtatatgttgggctgggaacccgcatagggttcagttgggtcgcgtgtaacagcgtcggatggttagagtcactattttatttttattttttgctctgaaaaatcgacatgcatgatgctctctctcctctctcatttgaaattaaaataaaaataaaatacaaaattacagtactatataactaaaattacatttgtaaattcagttgatatgacatgtaagtgcactacaattttgataacaatgttgtgtaagtgaatatctatttgttattttctttaaaatataagattacagttctatataattaaaattacatttgtaaattcagttgatatatatgtaagtgcattgtaattttgataacaatgttgtgtaagtaaatatctatttgttattttctttaaaatataaaattacaatactatataactacaattacatttgtaaattcagttaatatgacatgttagtgcattgtaattttgataaaattgttgtgtaagtaaatactccctccgtcccaaaatataaggaattttcagtttttgcttgaaacgtttgaccactcgtcttattcaaatttcttttgcaaatataaaaaacgaaaagctgtgcttaaagtattatagataataaagtaagtcacaaataaaataattaataaattcaaaattttttgaataagacgggtggtcaaacgttgccatcaaaaactcaaaatcccttatattatgggatggagggagtatgtattttttttttatttttctttgtagtccgttggatgtaaatctaagggtagaaaaatctggatgatttttttagaaatcacccgacaaatggataggcaatcccaatagtactatctccattccaaattgatttacattagagatggcaatttccccgacggggacccgcccctacaaggacggggtcggggctatatttggccccacaggtgcatcgg

SEQ ID NO: 48331 - DNA, 4453 bp, Oryza sativa
cttggtcggtacgttgcagatcagatccatttcaagttgggagtgaagtgcttcaacgttgctgacctaggtgtatttcagtcaaaaagagatgcaaagatgataaaatgaatttaaaatgaaagaaataatgaaaatggcaaagtggtgaagtgtactcaattgagaatagtattctagcgaaacccatttgaatgatgatatttttgcgaaaccagttttataccatggtacatatgcaattttctccttttccttatctcgtcttatctaccccagccatacatagtcacggagccacccatccagatcgagtcaatgacctttcaaaagaaaataaaaagaaagatagagtcaattagtagcgactgcatcggcgctaccgcagtcgttgcaagcgatagtgactccgcacggctgctgcgcctcgtcagctccctgcaaggctgcgcctcgtcagcccaggccggctgctgcaccttcgtctcggccgcgggtcaccggccgctgcactttcgctgcatctccggctgctgcaactccgccgcgtgtcgccggctgttgtgccttcgtcgcatgtcgtcggctgcttcgcctttgtcttcgtcgcgcgtagccggcttctgcacctccgccaaatctccgcgacactggcctcctcgataagccaccgcatcttggctgctacagttctggtttgtcctctttctctacagcttgcggggccccggtcggggtcggtggcggggaagcttttcacacgaagatggtaccggggccagggacgggggataaagtcgggggttaggggcaggaccgttcctgtccaacccagtcccaccccgccccattgccatccctaatctacatatagttttttttttgttattcctaaatgatctatatatttgtgtttattcattaagtctatttgttatttgtgcattggaataaatagacattgatgtatgcatctatgcacgcaagtatttataatccacatgcaatatcttgatttgctattggctagaaaatagcgagaatggtgcatgcatcgagtttgttgctagagtaaatatagtatgagagagatattagctttttttggtcttggtatacctatgaaatatgtagatcaatttgatagagggagtagcaacttgctatagttttttcgcaattcacttccttaattattcacatgtatattctttattggaaaaaagaggttaaaaataaataaactatattttcccttctttcttatgcacagcctccccattttatcttcctagtgttggtgtaccactctctagacatggctcagggaaaagctggtcaatagtttagaaactcctcaattttgtattagtattcttactacgagtaaacaaagctgatgcatctttttggtgttaatcactaatgtcggtatcctaaagttacttactccctccgtcttataattataatatagcaatctagtactggatgtgacacttcataatataacgaatttaaagtacagtaaacatgtctggattcgttatactatgaagtgtctcgtccggtattatgttacaatattatgggacagggggagtacttccatggcgatattaaataagcacgcagcttgttaagttaagcatacctatttttgtgattaaattaagcatataatcagtttgctagctgagagattgctttgtttttttttttctaaattgaatgcttacatccagttagatacattaattagattataactaattaaattattgttcttagtgacattttaaaagattatgaactatttctttctataatctataaattaactataaaaataggagagaaacaaactttgcatccaattattggttgtttgttgaatcagtaatgattattaaagttatagtcatagtttcaactacaactcaccctgatttgtgctttacatagaaagaaagggaatccagagtaattttgtcatttttcaaaaaaaaagctaacactactcttgagtgacgtggatggcatagatgaacgaaaattctgtttgatggcatatacatgaactgctaatttacgatggcatataagaaaacctgtgaactttaggtggcatatgaggaattttctaaaaaaaaaagtgtaggagtacgtacctgcaccgcgtaggacagcagcgtgcagggcagtttggccggccggtcctgcatacgagagctcgtccccttgctgatgcagagcctctgcgatgtggtcgtggcccagtgagaccgccaggtacaacggcgacatcccgtcgccgccgggaagacgggcaagccggggatgcaccgaaatcagatggtcgacgagctgcttgtcgccgagcctgaccgcgtcgtgcagggccgtctcccgccggccgttctgcctctccatcacttcggccaccctgcccgcgctgccggcgagctcctcctccctggccatgtcgaggaggcacctgaccatcgccgcgttgcccgccctggcggcgcagtgcagcgtcgtgtcgcccctcgcgttggggcggtccaggaggcgcgcggcgtggctgtagatggtgcgcgcgcagcgcagggacccttcgccgtcgccggaggccgcccccacgtgtagcgcggagtctccctgtggtgtcgtcgccgcgtccaggaggagcggcgattgttgcccggaaccgacgtcgatggcaacttgcttgtttggcgttccggcggcggcggcggcggcgcccaaaagtaaagccttaagccccgggcagttgccgcggcctggggctttgaacagcttgggatccatcatatcatcactaccgggcctgatgaatcaaacttgggatttaaacccgtttgggattttgcaactacttacaattaacatttcagatggttagtcagatgctgccatcgacgtgctgaagcggttagcactagttgactaattaaacatggttatgcacagcactatgcactcatgcgtgtgcaaaaaaccatggacgtacgaacccgcgcgcgatcaccacctgtcttgcattgcatcccgtgtgccgagtgcgaccggaaactctttatgcggcactacctctaattttaaatgtacaatgttgctaccgctttaacgtacctagtatggtttactattcattattcaaaaaagattatataaatataagtgctacaatgataagcagtctctaaatatcttgtacaattaaaatatgtcacgtcaacatcaacatagatggtactttcatgatcgtttaatatgatagataatataatgtacgtctaggagtcaaagtggcatatacaaatagattaaaggataaacacgaattacccattagacaatagcagtcaaccggattatcccctaaccggaaggccagacatcattcgcccctaactatataaatcggacaaataacccctcaccccctcctcccgacggttaatccgcgatgattttggttctaaatactattagaacaatcgttggggtccactgttagatctctcccctccacctctctgcaccaccagcgcaaccaccaccaccacacgccgcggctgtcgatgatgccgccccgtctcccaccatcccctcctcctcatcctcacccaccaccggagattaccccactggagaagccgacaccgcggatgacgagggccgcccctacatctcttcacgagacgaccttccatgccgagctgagctcctcctcagcctccggcgccagcgcatacatgaggagagtcgtagtctccgcggtgccaacgagggaggcgaaggtcgctcgggcggccagcgacggaggcggaggtgcgtggcacattgcttgggcagctggcggcagaagaggtcgctcgggcggccagcggtggaagcggaggtcgcgcgggtgccgatggggggaggcggaggttgcttgggcattgacgacggagataggggcgcgtcgccatccctggcttcggcacccccagttggctccgcccttgcctgccgccatcctcggctcccccttcgttgcctagacccaactgcattcgctcaccgtcattctctgatggaggtgaggggagggagaagagagagaggggaccggggaaagggatagagtagagagatagagacgaatgagaaactgataggtggggccctccaatttttttaaagaaattctgattggactatcacacatatgccacgtaggactaaaaccaccgcggattgagctagggttatttgtcaggtttgcatagttggggggtgaaggatgtctggttttcgagttaaatagagtaattcatactgtcgcgatgttcaggcgggtaattcgtactttttccaaaatgaaaagggtaagttttactccctccatcctaaaatagccgcttagcgctagtgattt

SEQ ID NO: 48332 - DNA, 2539 bp, Oryza sativa
cttgaagctccggcgagaaacgtgagcacacgctcccccatcgacggtggcaatggtggccccaggctcttggaaacctaggtcatcatcgccgtcatcgatgtcctcgtcgggggccttctgcttggcctcacttcgccgattaccggaaggaaccgccggggatttgccctctcggcgctcctgcctcctctcctcctcccacttcctcgtccgctcagccaaacttttgactgcacggcagtccgcaaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtttggggctccttggaggcgatcttttcaagcatgcggttgtgccgcacaccccccctgaacgcgtaaatcaccgcgtgcgcagggatgcatggtatggtgttgcggacttgacagaccgctgaatgtacagcgaagtgactcatcatcccttcgctgtactgcgtgcaagtccgcttcctcacctgggcgcggatatgtgccttgaaagttcatggtgaactgttggcacaaatcctcccaagagtggacaaacgcgggtggcaagttcattagccaaccccgcgcttgtcctttcagggccatgggaaagaaattcgccatgaccctgtcgtcaccccgggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaactgggggcacggagggctgatccccgcgtccgtggtgaggtgacactccggacgaggaggcgccctccgttgcgtggggagcacgtcggccattacgccggcgctcgatactgatgcgagcatccggttccccacgcagatctttccgggtcggaggcgttgacgaaagagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggtgtcgaagtcacggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccgggggccctgggtgaggttctaagctcttggtctgtggaaagttcgcgagagtgaaatcacacaagacacgggcgatgtatacaggttcgggccgctgagaagcgtaataccctactcctgtgttttgggagatctgtgtatgaaggagctacaaagtatcagccagcctctcccttgttttgggtttctaatctggaaaagtccaatcccccctctcagtgggcaaggtcctccttttatatcttaaggggataccacatgcaccatttctctctttttttgtggggacttacccccccttttcataaatggacggagatttgtatagttgccgtccgagtcaccttctgatgagacggcccacaactacctccactttcgccgggagcaggtgcgacgtggaatcgtggctgtctgctgacgacatgaccagtatcagactagtcacgtcggtcattcttgtccaccacgtgtcagcttagcaatctacatgctcgcccttcttcacacaacatcttgcctataatggtttaggatgaagcctggcatatatctgaccaggactaacgtgccatctctgggaggtaacacgctagctccagctggggacgagcgcctagaagccctcgtcctgacgggatggggcgaggcgtgcatcagatcgcctgtcgccacctaacccacgatct

SEQ ID NO: 48333 - DNA, 1429 bp, Oryza sativa
ggcaagagtacaaaggcactgaggaaggatctgtttccttcctttcgccattattccccttgtcttcgccgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccacactacccggggcggtccgtcttctttctcccctttgcaatggcagggctggttccaccattttcttctttcttcatggatgttctggagttctacgatctccagatggcgcacctcacccccaacgcggtgatgaccttggccatcttcgcgcatctgtgcgagatgttcattggggtgcgcccatctcttcggctgttccggtggttcttcactgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggtgccggtagatctgggggatggctatgacgccgtcctcgaccgcctggcgggcctgcgatcccaggggctcacaggggccatggtgtacggcgactacctccgtcgtcggattgcaccgctccagcgacgcgctcggggcgcctgggagtacaccgggtccgaagacttcacgaggacccaccagggagtgagatgggactgggctcctgaggacttcaagatattggttcaatgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgagagggggtcgtgcttcttggtcccgcgacaggggcccggggagcagccgccctgccgacgcccgggggaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccat

SEQ ID NO: 48334 - DNA, 1994 bp, Oryza sativa
ttattctagagatatttttagtatattttgttaaattttctcttgtagaggtattctttcaccactttaaaatatgcctgatatgtaaagacattttcttgagatattttaaactctgcagagacacttctaaaaaagaataatactgtatactaagagaataaatataagtaacacacgccataaccttacaagtattgacatgaggttaagttggtcaacgcattgaagataataatgagttgcctaaaagatcttgagttcaaggattgacagtagcaagaattaatagtttatgctcttttttcaacattggtttgatatgattatggtgaaatttaatatctttagaaaatgcatctaccctcttatagacataaaaaatgtctctattaaaataccacgagacatagagggatttatcttatagacatgaaaaaatcgcctctattgaaatgccacaagacggatatttttcgtttgtagatattaattcacaataaggcacgcattacatattttttaaatgatatagtgttgtaaatgtattttaaaattgttttctatggcattagaaaatgcctctacgaagcatttttcttggaggcgacgtgtccgtcgagagcaagacacccataaacacttcatcaatctcaatatataccagtctagtctctcggagatgttcataggggtagagtgtttgtgtgtgtgagttcagaaggatgagtgtgcgcctgtactgtgttaaaaaaaaagtgttccactcataaattgcatgcaagatcgatgcgcatgcatgttccctacaaatgaaatacgagtactatctgttatccaaaacaagtccatggtgcacacttcaattaaaatctaggatacaaggagtagatcaacctttatggccttgtcctttacctagaaagaataagccgttgttaaaactttgatcagaactcctatgggcttttgttatctaactaaaaaagctcgtgcgttgcaacggataaaaacgttttgtcagtgatacaatagctattagaaactgagcaataaattaaaacattaggatggctatacattataattgaaaaagctaataaaaattctttcttggttttgggatgaaagtccattctttccttcctagccccagcctattccgttacttccctccgcatgacctacctctcttcggtccagcccacaagtggagccataggcccaactcacacagccgactgccatctccgacctttagatagtctcttgcatatatgccggagccgttcatccccatcaaatccagccaatttcttcttaatctatcaaaattggttgagggctttttatccattcgatcttctctttccgtttttctcaaaattggaacaaatccacaaaattcaatagggggataaaacacacggggagatgatgtggcgacaatgctaggttttggtccggcggcggcgtgcaatagatcagatgagatcgaagaataccaaaccgaagcgtgatggaaaaaaacagttggaaaaaaagacggacacggacaaaaaatatttcagaagctttacctattttttaataaggtatagatatagatataaagttgcataattagctaggtgaccatccattattaaatcatacctcatgaaatttcacttggcgcagggatattattggctctaaattagtggcatggaatcatctattcccacgcatcgctaatatagttttgtcacatgagcaagatgagtttaaatggaatctaacaccagctggaagattcttggttaaatctcattatcttgctttggctcatacgggagctcccaatattaacaaaactatttggaagttaaaaatgcctcttaaagtaaagatctttttgtggtatctacgtcgaggagtggtgttaacaaaagttaacctggctaagcggaaatggaaagagagtaagatctgttgttttgccacaaagaaga

SEQ ID NO: 48335 - DNA, 5898 bp, Oryza sativa
cctgcagccctgctcccttcatcctccttttagctttgcttaattgtgccgctatagatctagtcgctatttgtgctttactcttgtttgtgtgatagatctacttgttgtgcttcattggtggatcagacagtctgatcaacatcagactatctgatattttcggatagtctgactgtggatcagactttcgaccttatatcagttttagcttccgcataaagttttaaattagcctctaggccgaattgaccctttcaggtagatgcatatgcgcacgagtgaatttaacatgttgtgcggcaagcaaataatatggctccgatgtggctgggtgaaataatatcatgatatctataaggacccaaggcttggcactagatggtacctaagtgaggacaaaaggatatatatacacaatatgttttttaaaaaataaatctaagtagaatcatagtcacgtaagatgagttatatacacgagtgtaaaatagtaatgtgcatatatttgatatctattagtactacatgtttgatgtttctgtcacaggacagagtaacccaaggaggtaaatttcctctcttttgctgaagtgtgtgttcttcttattatctatatatatatatagtttcctatataattatctgtttctgttcttcactctgattcttcttatgttatatcagttatcacaatgtatattggcatctcaatcatcaaaaattttatttctgaatcaagttcaacaagccctggctatttctcagtatagtactgattgagatcaatcattggttccatctgaattttgcttcatcatataaagatatctgaattttgtttgtaaaattttactgtacacctgttcctacagctgcatttggtttgttgtcaccaaccttgtagatgcagatgccttgccatcaaaacctaccgaaatgagggagctattaaatgtcaaggagcaggccaagttttctggtgaattcaccagaaatctctatgtgaggcagtgccagatgattccaagtcttcagcttcataaatgttgcaactaaacatcacagccaaaacagaccaggatcagggtacaatcatttgtgctgcatcttcaggaattctaacattagtaatctcaatgccctatctgatcccacagtttgcatttataatctttctcttctagtaataagatcataattttaaaaatgtccagacataaatacttctgtaatctgtactgtactgtactgtacttctgtaatctgtactgcatttcagttgatcagtgactgaaaaattttcaaactctcacctaacacatcatatagatatctactatttgatttagcagttgtgcttactttgttataatgaccagtactacaagtaagtcaatcatcgtagtcatagtacatatcaaacctagaaaggtcatctgaataggacttcctgattgggatttctccattgttcactggagtagaaaggaagaagaaggcctcaggctgggcgaggcgccgacacgtgtcgtctcgtggcaatctgcggtatctcagatctgtatataggcctgtaacaaattgaagcaacagtgaggtcaggtgagctaggcaaaggaagagctgtgagatggattcagctacctctaccggttggtctcaaacagcaggaattggttgtgtactctttcttgtacactgtcagaaaatcttggcaacaatctgcacttgcctgtcgggcatattcatgcaagaaggggaaacaaattattctcacatcataagctaatcatgctataacatgactagcagcagagatctagaacaaatgaacaattgctgtagcatgaaactgaacctgaaactgaatcaggattgttctactagcataaacaaatctgaaaccgaatcataattgctgcaagcataaagtttcagggtttagagaacaggatcacataagcaccagttcagtaacagtttcccagaaagaggcaacaatcagaaactcttttttctaagctataagatcagaacatttcttagctaacgactaattttcatcaaagcttcagttgcacactagagccacatgtgtgtgcaaccaccatcccaagtaaaagctgatcagatatggtgaagcatatcacaccatctggttttcagatctcaggccagtatactttgatgataatctgaatgaaatcaactacctatgacatatatcatgaaacataacagtaaaaatattatacagccacaaaaaaaaatgcaagttacattttagcattacaatggctgcacgtccgcaacaatagtacactccttaaccaatacaaccaggtctaaactagtcattcaacaacccaaccggaacaatagttcacttatgaactaggcacttattttgtttttttttatagaaaccaacatataaatagttttttaactgccaactacagcctcagatcaatggaattgaagcctccaacatgccgacatagcaatgttacttcgggtcagaacggagtttgtgcggagtaatttctgggacaactctgtagatgtgcacttttatgttatccttctggacaagctcgaagacacacacatcaaacttctccagattgttgccaacagcaaatttgccccagccaccactgaaagaaccaacagaacgatcactgtagtagacatagttaacttcccaagccttcccttgtggatcccagagtgtgatccttttgttggtatggggaagacactcacggacaaattcacatgggatattctgcaatataagaaaatgagttttggtttagatataagaaaacaagtagggaggttgagtaaacatatacagatagtgagcctttttgtaaaaaaaatgtattgccccgagggtaaggcataattggggaaatcggaagtttatctaagaaagatagttgaaaaatactaaacttggctcatttatgatggtattaaccgaatgcttgaaaattactactacagactgttgcttatttatagatcgctctctgctgtatgcagaaactttgtaataaggctatgtcaagatgggatgttcaaattagaacatccaaaactctcaaactatagcagcagcgccattgtgcaaattataatcatgcatgaaagaatcctctcatgcacatattttttttaagataaaatgtctcatgcacataaaaaagggaaagtgctggatgaggattaacacacggaagtaacattaccatgaaaaatccaacatagacatatgactccatcattatttgcacggcaaaaggattcttagatttaaactctcttgccctttgaagagcatggtccttctctgcttcagttaccggacgcctctgtgatattactgttagttgtctttgaccctttgaaacacctgaaaagtgcaacacagtcaaattgtctacagaagtaatttattagcactacatttaggggacaataacttacatctaccacgccgagacacctcaccagacagaaagcgcatcaggaatggtggatttggtgacttgctagaagaattatcttcatctgagctgcatgatgaacctataatgtgcaaaagtaattttttgggaaatcatatgaatccttaggattctgaacaagtatgatggaaataaataaataagcaacctctaaccaagagattagaaatatgtctttttgcaattactttgcatggtttggcaccgcgtagcttatggctatgcatggaacaaatcaggaatacaactaaacaagttctataaacgaaatggatgtggcaagtcatttgtgccgttatgcagacctccctggtcccccaacagttcaaaataattgactattaatagtcatcatctaagctgactatgccaaatatgtgtataacactttcagaaatatagaaatgttttacctctggtactgttatggcttgtcgatgttaccttggacttgccagcagaagctcctgcacgttttctcctagaactttcgcaaacattagcctcagatgacttcttaaatacaaccaccctatcttccataaggtaatctacatctctagttctctttcctgtgattccattattttccttcagggcgggagccattttctctgttgtgatagctgcggtgaccatgcccccttcatcactttctgttttaatgatcacatttttggaagggtgagcagagaaagttgatatcttgtcaatgcctgaaggttcaaagactgtcactgagaattgtgaccgtttatcataagtgaatactaaaaattgaccacactgaattgagttatctctgacaaattctttccatccatgcacaaagaagaatccctcagagtctgaagtcagctctgcactccatttatttccacttcgatcaaccagagaaaccatcccagtaggttgattctgaaggcattggttgaatgatgatgggattttctgcattgtaccaaagtataaaatatgttaatttatttttctacactacttgttaacattgtgaactactcatacgatgcaatgtcagttcaaaaacaaatatatcagacaaatacaatatgccacgtcatgtaatttttctataaggcatcaaattgtaaagaccagcaaagcagtcctgacatcatagcctcaaaaatgcaaaattacagaacatacgtgatgtatgactggaaaaactaaatgcttagaccaactaagatcaaaccttatcctgattaattgaattccttcttttcccacaccaaaaaataaaaatgaaaagtaagactcaaaccctctgaaagataatccaacccattagcagaggcccatgttgtgtaagttttaagccgctgagttgaaaaatgaaagacatcataggcaattttattgtaacacagtgctttctactattctttggccacataaatgtgaaaatgaactaagcaagtttggcagctagccagctactttgggaaaaccacgaaaatagtaaatgtagtcgtcatgaacttctaacaataactgattgtgtgaccaatacacctgagtgttagacaaacctggatttggtagtgggagtgattactctatgtttttctaaagaacgctatgagaacacataccaccaccaaacaaggttaatcaagatgttgtttgctgactatgaaaaaccaactgtgcagtgcaaatgaagagctacatatcaaaatcaatactttaatacgctcgtgtgaacaatgaaagtgtataaggttactaacgaatcaaagcaagctagtcacactagggaatatacataaccaccacaaaaactcggacatttatttgaaagtgtttatagttaccctgcaatcatacagccacctttcgactaaaacacatacttccaaataattaatctagcgaacacaatccacatccgtgggattcgcaaaaaggggggacaagcatatagctaccctgcaaccaaacaaccgccttggggaaaacacatactcctaaatcattaatctagcgaacacaatccatatccgtgggattcacacaaaggggggggggggggaagtatttagctacccacagccaccttggggataaaacacattcctaaataattaatctacacggacacaatccacatctgtgcgattcaaaaaaggggaaaaaagtgcagatatctaccttgcaacctaacaaccaccttggagtaaaacacatactcctaaatcattagtctagcgaacacaatccgcatccgtgggatttacaaaaagggaaaaaatacatatagctacggctacccacaaccaccttggggctaaaacacacactcctaaatcattaatctagcgaacgcaat

SEQ ID NO: 48336 - DNA, 2593 bp, Oryza sativa
  unsure (1)..(2593): unsure at all n locations
acattcctaaataattaatctacacagacacaatccacatatgtgggattcaaaaaaaaaagggaaacaggtgcatatagctaccctaaaatcaaataaccagatttgggctaaaacacattctcttaaatcattaatctagcgaacacaatccgcatccgtgggattcacaaaaaaggaaaaaaaatgtatatagctacccacaaccaccttggggctaaaacacatactcctaaatcattaatctagcgaacacaatctgcatccgtgggattcacaaaaagggaaaaagtgcatccggtctacgggtatcacctgaggacgcgagaccttggggttaaaacacatactacttaattattaatctacgaaaacacaatccacatctatcggagttgcaaaaaaggaaaaaaaatgcatgtagctaccctgcaatcaaaagtcaccatggggctaaaacacatactactaaatcattaatcttcacgaacacaatccacatacagctacctacagccaccttgaggctgaaacacacactgcaggttatgtttggttcatggccatttctagccttgccaattttgggcaatggcaatgccatttttttttggcaaaaattggctagtgtttgtttggtttgctaccaaagttgcatcttgacatattcaactcagccaaataatttggcaaggcaaatttttggccataaaccaaacaaataataaaaattttgtcagtcccaattttttttttcggtttggctgagattggctacaaaccaaacatgcatatcccaatcaactagcacaatcagcatctaatgaacagattaaaagtagcacaagtgaacacaacattattactaccctctaatcaatcaaccattcataacaaactgaacaacaacaacaacaacaacaacacaaacggagaaagagagacaaaaaagggattaaagagacatcaccatccgctccagagattgcagggtgagaagcacacggaagaagctcctcccgaagcagttaatgtcgcactccttctccttccccttccccttacccttccccatccggccaccttgcttttccctaaccaccatgacctcctactccgattcttgggccccccccccccccccgaccgaacaaccaaagccgaaatagaatccaagaaaaaggaaggaagaaaagagagcgcaagctcgccccgcccggccgggtgaacaaaaagaaaaaaaaaatcaaaccggcgaggaagcgggtggcgggtcgggagagggaanacgagcagcaacggcggcggcggcggaggagnaggaaaagcaatggaagcgaaatgcctaccgctgtgctgcgatgcgaggggaagaggaaaataggaaacaagcgagcaaggagagagagagagagggttttggaagagagaggggggaggggagtgtcagcactggaaaagtggaaatttccagaagggcctgagatatcacctgcgcggcggggtgggacccacctgcagtcacacacacttccatctcttttttttccctcatttttttactttctattgctcgcgtccaatcaataactctctctccttcagtccaattctcgcactctgcttctctgttggccctgttcgtttccttctaaactgacaggataaacttttggattaaaatggcatgttttttaaactactaaacggtatattttgtgcggaaactttctatataaaaattgttctaaaatatcagattaaaccattttttaagtttgtaataattaaaactcaattaatcacacgttattgccacctcattttacgtgaaaaacttaatttttatcttcaggagattcaaacacaacttaatttttatctttaggagattcaaacactaccttgatagtacccacagccactttggagataaaaacacatactcctcattcgttgatctacacgaacacaatccacatctatgggattagaaaaaaaaggaaaaaattgcatatagcttccctgcaatcaaacaatcaccttggcgccaaaacacaatctcctaaatcattaatctaacaaacacaatccgcatccgtgggatacacaaaatgggaaaaagtgtagatagatacccataggcaccttagggctaaaacacatactcctaaatcattaatctttgcgaacacaatccgcatatgtgagttttacaaaaagggaaaaaaatatatagctacccaccgccaccttagggctaaaacacatactcctaaatcattaatcttcgcgaacacaatccgcatatgtgagtttcacaaaaaggggaaaaaaaacatatagctacccaccgccaccttagggctaaaacacatagggtatgtttggttcgtggccatttctagccttgccaattttgggcaatggcagtgctttttttttagcaaaaattgtctagtctttgtttggtttgctaccaaagttgcatcttgacatattgaactgagccaaataatttggcaaggcaacttttttttgccacaaaccaaacaaataacaaatattttggcagtcccaattttgtttgctt

SEQ ID NO: 48337 - DNA, 1143 bp, Oryza sativa
ccttatattatgggacggagggagtaggcccacagtaaatggtgccattgggggaacattctctaccgtccaggacatgagatgatcaacggcttagattgaactggtacagtagaatgagcaaagtacagctttgtctcacagcaacatgccagcatcaacaccctgttgctacagtaagaacgtactgtttgaattggtcagtgatttggatccttcgctgcgatgctagcagcaattgcaagcataaggaccccatatcgctagtttggtatttatcactacctttgtctttgtatcgttgtcagcaacttgtataggataaacagtattactctctccgtctcataaaaaatcaacctagcataagatgtgatgttttctagtacaattaatttgaacaaaagcatgtttcctcttttttaaaaaaatatacaaggctatttgacttttaaatatgagcatatatttgattactcatcttatcatgtctaaaagttaatagtgttatatattaaaagaatcatgctatacgtacgacccatccatccaaccggcgtacgaccaaaacaacgtagcaacacattgcgagacggcgtgaggattcgtactgcacgctgctgacggcgcgtacatcaacgttgtagtcatctgatagagtcggatgtgtgggtcgtgtgtgtagcattttccatattgaaaaaaggagggagtatctatcttccctctagtttatactacccctccatcttttatatgacatagagggtattatacaaatgtctatatgaatttaatttgtctaaaagataaagaattttaataaggtaaaacaccttcaatcataatttagatccaaactcttaattaactcttatgctgatcacctttcaaatttagtgcataactgttgtgaaaaaagagtttcattttttagaaccaaaaaaggaaggactgtacatgtatataagattcctcaaacagccagcatccaccaggactaattttccccgttcctgtcgatggctcaggacttctcttgacacgccttcccgtattttttgtccatatgtgtcggtgacatgggaccgggagtatcatgactagagccttgggcaggagcaatcacccacgtggcctgac

SEQ ID NO: 48338 - DNA, 741 bp, Oryza sativa
tcgggcgactcgggcggcggaaccctagccgccgccgccgcccttccccgccccttcctctgccttgccgtcgcctgagcgagcggccggcaaagccggcggctcgcgaggacggcggcggcggggctcgcggtggccatctcccgagctcctggcgcgggtggacgcaaaggcggtggccgaccggagcggcgccggcgtcgaggcgcatggcggcggatccggcgtcaccaccaccggatctggcgcgctcgcagctggatccggtcgcggaggcgcgggcacggcgtcggcgaggcgtgggcgctggcggccgcgacaggcggtggcaaacgcgacggtggcgcaggcacgggcggccgggcggcggcgtcaggcgtgacggcggagcaggcgcgggcggccgcggtaggctcggaggcgcagctactgtggccggcggctcgatgcctggcggcgacggcagcgatgcccccagatccacgcctctcggctggatctggaggatgggagcagtcggcgacggcggcgacggtgtggcgacggcggcggcggcaattggccgacggcagttggcgacggcggtggcagctgtggtggctgctgtgtcatctggcaaaggcggcgtgtgtgtcggcgatgtcgtcgtgtgggtggggctattttttttcttttcctgggtacgactctccaggggtataacctggaccttttttttcctgctctatcattagaatttcc

SEQ ID NO: 48339 - DNA, 940 bp, Oryza sativa
agccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccggggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagtccccagacagcaaatggccacgaaagtggtatggtctgcagggcctgggccggctaatggatttgcttggcgtggaattgacacgctctacatcgccggaccaggttgaccgcatcattaagagctgtcggctaatagaaaccctggcgaaaagctttaccaaccaagg

SEQ ID NO: 48340 - DNA, 1644 bp, Oryza sativa
tgtggaggaggaggcgaggaggcggagggggagaagaagaggagagaagaggagaggagggaaagcgatggcgggtgggtgcaagcaagcaaggtcgttggtgagagatttaaaagcgggatttaaatttggagggagtacattacatacaaagctttaaataataataattaaattataaacaaactacactgtactttgtgtatatacggcgtggcgccgaactgtacatcacagcaaagctgctgtacatctccgtcaggtccataccgtggattcgtggagccattgggttcggaatcatctatcataatatcattatcgttacgtgatcttaactttatattatcccgcacgacagtgtttataaaagtagtgtcattatggtagataatgtgaacccgatggactaatggtagtatcttcacctcccgcacgtaaaacgaagggatctattatggtattactaattaagtattagttaaaataaactttaaaaatagattaatatgttttgttaaaacaactttcctatgtaattcttttttaaaagactattgtttagtatgtttggaaaacgtgcgcgtgaaaaacgaaggagtataggttgggagttgtgagtgacaaactcagcctaaaatcttcataaacccgagacaatggctactgttcacacctctcgtattaatatgtaagatgtgtgcagtggtgaaatggtgatgtgttcgctaccatgtgtgatcacgtctgagtcggatgacgcataattcgtgatatattaaaattttgttattatgttaatagatggcggtgtaagtgattggtaattaatgcgagtgattaaaataaaccaagggtacatgacatgagtgttgaaatgtttgctagcttgattgttgcaatggcgtttaatcggtgttgtaggatccaggggggtgaatggttggtatacccaaaaaccgaaaacttttagtggaaataaaagttaccctcgaaatcgacggaagtcggtctgaccgagattgatctgccggtctgaccgaagcgtagccgccggtctgactggtgttgatcttccggttggaccgccctggaatccctgctgcgcctgttgtcgtccccggtctgaccgaaggtcacccgccggtttgaccgccgccttgccgccggtctgaccgccgatgtgtcgccggttagaccgccgaaacccggtgaaacataaattgaagaattctaaaagtagatgacgactttattgattctctctgtatttacgaagtgcacaaacagcactccttacagaaatttcgactaaactcaaaaccctaactcaaaactcaactcaattgctttcaaaagcgataccgggaagcctcatgctccccctctatttatacccgaggcaggcaggaaccaaactcatactaggagtcctaaacaccttagaaaaccctctagtacaagaaagaaactttacataaccaatcgtaccaaatttggactccttccaaattcgactccgcatcccatacacacacaatacctccatcgtatgccatatggaatctccatcaaccacgtgcatcaactctagcctaagtatcccgcataatctctgaccaccacggacgtcgtcttatcccc

SEQ ID NO: 48341 - DNA, 1523 bp, Oryza sativa
gacagaaatatgaacattagatccaccagttatctgtcaaaaaaaagtatgatttgatacttacagtcccagtcaacatattgacaactatgttgggcagcagttttatcaggtaggtacaggtaaaaaataaaaaatggaggcctgatgtccctattttacatcttcctaaaaaaatcaggtaagctcaaattgcagcacaactgcatgactgcctaaaaatatgtttttttttaaaaaaaaagaaagtttaaaggatgccaccatgtgcaactgcacttcatgttcttttccagaactggtattctggaacaactttctctcaagtttcaactggctttaaggttggaacaatccctgttttcctccatattagagcaatcatcatccagaaaagagttatcaacagataatttcgtcatatgcatagactttgtaaaagctccccctccagtttttcatcatcaagttatgtcatgtttgagcattgtgtaaggcgccaattttcggaaaggttcttagcatgtatgttgaaagaattatctttatcaggcaatattcaagtctttatatctactggaaagtcttccattaggtagcgattatcagctttgggaagtgacaatggcaaggtctcttcgtccacagaatctcggtatttcaatggaacgacttcaatcgaaaacctattttggctggccgactttgaacgacttgtgggtaaagatggtccagtacctatttggaaaaatctcattagacatgatgacatagtagtatctatgaaaatgtgtaaaatgacagattgtggcatactgtcagtcatgtcctttgtcttgtggaggagaaatgtcccagaaaggatggtcacaaaaccacacagctccgtgacaatttgtgttggattttgtcgatcccaatcctgcacgtaataaactatgctatcacaaattgaggaaataaactttccataaggcatcaattgtttcttgaagacagcaacattgtgaaagaaaattaaggtgcgtagtgcacggtaacaacattgtgcaaaattataatcacagcagcatagttagcggagcaggacacatgtagaactacacattaagccaaaaaaaaaaattgttcatagctttctgcaacaagaaagttgagtgtataagggctgaatgcctaatggaagtgatagaaaaagcttaccttaaacattatcacactggctaaaattgttagtgaagtaaacatcacgtaatatattggtgagacaactgctgtattaaaggtgtccaatgcctgcaagtcacagagataaaagaattactattgcgttaatgtaataagcccttatgtgatatgttacaataatggtagctcaataagctacatgttctgtactattgcccagagtgacatttcaatgccccagtgacgagccaggaaagttttacagcctgaagccctggaaaaatctaactacgctgagtatatgctgcaattctattttcaatccctacaatgat

SEQ ID NO: 48342 - DNA, 2021 bp, Oryza sativa
acttacagtaaggctgctgagggctatgttatgaacatattttaatacagtaaatacctggttcagttgcaagatcccaaacttcccttacagaatcgatgttgcgctcctgtggagcatggagtacaattgtgatagatccaactacacaaagaacacaaccaagtatgccaaaggtgtgtagtttctcctgcagaatggcgtgtgcaagtgcagcactgcacaaattgacaaaagattatggttttgatttagcaactagatagcaaaaacaaattttagcaagtttcttatttgattcatctgaaattacctgatgattatactgagtgccccaagaggagtaacaagaatagcaggagcaaatgcataagcagcaaaatttgcaatttctcccacaatcactgttcacaaaggtcatgtaagatgccattagtcaagtttctttccttagtgacattttttgtctaaaaacaaatgaaacagtaacttcagtatattagaaaatacacatttctgttcacttccaaccaataaattccaccaaatatcttactgaaagaataacaaggaaaaacaacagccctaggagcagacagtagtaagagatattcatgctaaggagccatattcaggtgacaggaaacactttgctccgtacaatcacttttcatgccccagttaagctcaaaggttctactaatatctagtcacatacttgtatcaatgtaattatctagaatatcgttttggcttcattgaattcagccccaattaaaaatgtttagtttctcctaatacaaagtaactgtatttatcctgattctcaagacacagaaacatcttattacaggtcttagggagttgacaacttgacatcaacacgagtttacatgaccaactaaccaggtaacagacaataaagatctcatcataatcaaagtgacatcaataaggaaaaaataattgcaggataatgtttgagcagagcaagctatatgttaagatcaaaggggaaaaaactgataaatccaatgatagaaaaaaaatattgtgcacataatgtgacagaaaagaaaggaacattttcaagaagtacaaaatattgtataatttaaaaaggaatcaaatgtggcttactagaaatcatgcctatccaccatagaggctccattaagtaagaaaatcctccatatcctgtttaatgcaaataaagaaaacatgtgacctcctgcattgaaacttgtagagcttgcaacacaatagcttatgaaatatcacacgaataatgaaagtgcattgatctgacatcaatcatttcaggtaagtgcataaggacatagatcaggttgagatgtaagtgcatgttttgttcatacgttaccactaggctgtcctaaagtaagctattatagagtaaagtatcatagtagttggttggtttgataaaatattgcacatgtgacatcgctatcatggaagtgaaccactagccagccaaaaagatgtaatttcgtcctggcatactgaagaaccatatcggttagccactaatcgcagaagcaccacaaccacctagcaatagaaacaacaacccgaaatttgacttgactttactctttccgcaaaccgaatcaaacaaaatccacagtaatcatccatgactcgatcagatacagcttacgatccagaaattcaaaataagcaaagcattggtaccacaagcattgaacatcatcttgtataaatatttaataatggaggacaattgcaaaaggccaaggataccaccacaaaagacaacttttttccggactcactcatcttagttccaataaaaaaaaatctcacaagtaacaaatgccgtatcaaatgaagcaagaaaaaaaaattcttcagagagtcaactgatcctccttgcaagtaaagtaaagatccttagactcgattagaactacttttgcaggtagaactttccagcttccacgcccaaatcattgcaatccttttcacccgcgaga

SEQ ID NO: 48343 - DNA, 1649 bp, Oryza sativa
tcagatctactatatgtgttgttcttgttgtaaaaaatactatccttttataaattattaaattattgctcgtgttcgcaaataaatacttgctatagtttattttatataagtactcgtacaaacgaagacaccaaaaccacattgggaattgtttatgtaagtgttcgtaaaagactcttgtatgtatgtttaaaattacttatatttgaaatcaaaagtgtaaatttctatgaggcagcttcaagcttatcaaatttcatttattcacctatatgtctgcagcgcggtatataattctatctttaattattgtcataataaaatctgtctaattcttattccttgtttatttttcaaaaagaaaatatacatatcttatttaactcatataactgtttcctacacattattcgtcatctcaattaatcaatcacaacattctcttctttaattcatccgtctattttcgcatcttaacatatcatcaccatttctcattcaaaccttaatttatacttaaaactccttaaaaatactcatgtctcgaaaacggagtgaggctgtgtttgcaactcctttttcccaacccatctccctcgttttccgcgcgcacgttttttaaacagttaaacggtgtgttttttacaaaaagtttttatacgaaagttgcttaaaaaatcaaattaatctattttttaaaaaaaatagccaatacttaattaataacgcgctaatggaccgctccattttccgtgcggagagaataagttctcaaccaccccatgcgaacacagcctgagtacatgacatagaagcactattcgtatcatacacgctacatatgcatccggaattctaggaggaactgtggtaaacctaattattgggattggtcaccatctagtagtacttaatatgactagcacatgttcacttcaccggtgggactttactactacgtgaaattcctcctcctttcacgttaaataaaccctttacaattatcgccacgttctcctatcttatattagcaaaagttattatacattgcattagagagaaaaaaaagtaccacgaataacaaagtgagtttgttaagtttcttgtgatgcaatcagtctatccggattcaagttatgagttgatacggatgttcgcatttacagattattgtttttcagtggtaaacgacgtaaccatcgacaacgagacacccataatgacgtcattaatcttaaaatatgctgaccaatttttcgagcgcattcgtaaattttaggatataatatttcgttctttccaagattagagtgtgtgtgtgtgtgttttaacatatatgagtgagtgtgcgaacgtgagtgcgtgcgtatatgtacgtgttttttattaatactgtgaataagtagtataacgagtcctaatttcacaataccgagactcccaagggaccaaaacgcaaagagccccccgaaattccaggtgaatcgaaataaatgtgtttcggatggcagggcgtgtcaaaacccacccaaccacgcggctgtcgcgtcgtccgatccgtctgtccatcaccgcatcggacggtggaggcttctcccaggagaggccggggtggcgttggtacgtggggacggttggtctggatt

SEQ ID NO: 48344 - DNA, 2852 bp, Oryza sativa
ccactctggcgccccataaaggaccatttttgggataagtttttctaggggtctacttgccaaataagccttttaaaaggaccaaaatgtgaaaaatcctaccgttggttgggttgggacgggttcgggagcacgtggaatatgcccttgccctcctgtagttctgtactaccggatgaaacggagcaaggaatccgccacgctggcgcctcctctccattttcatggtggctctcactctccaagcgaaaatggatcggaattacgaacgctgatggcatgatcgtagctaggcccggtttattccctaagataaacttttcaccctgtcatgtcatattaaatgttcgaatacataagagtattgtaaaaaaactaattacacaaattacgtataaattatgagacggatattttaagcttaattgcgtcataatttgacaatgtggtgctacattaaacatttgctaatgatgaattaattaagcttaataaatccgtctcacattttacaggcgctctgtaatttgttttttattagactacgtttaatacttcaaatgtgtgtgtctgtatatccgatgtgatatgccaaaacttttcatctcgcaaactaaacaaggccctactaccttcatgtcaaaatataaaaacttattatcggattgaatattttgtagtataaaatatctagatagaaagtctatccaaatacgttgtattaagaaacgtctcattcggtactagattcttatatgttgagacagagggagtacgtaaaaaaaacagtagcgaaagagaaactcttactattcccactatcctagttcatacgtaaaaagacactttttagaaaacaaaggtattactagtattgaagaaataaaatgtctcaatttacaaccgaggatagttaagagagtagaaataaatttattttgtgataaattttaaattgtaggaaacttattttgcaggatggagggagtccttatcagatgcaaccaaaactaaaatttaaaatgaagttgatttgggggtccttttctttgtagtttattttttagcattggcttttaaactgatagtaacacaacttctaccgataatttacttcacttgctagtcgtaactcaaatgatcagaacatctgtctattttcttgtgtcttattggtgatgtagtttgtgtaagtaacaagttgtctctgtttcatgagaagccattattatcatgctgtgtaacttcagccccgttcttttctccaataaaaattgtataaatttggatattcatggcacgcttttcaaaattactaaacgctgccgtttcgtgcaaaatttttatatatggaagttgctctaaaatatcaaataaatatatttttcaagtttataataattaaaactcaattaaccatacgttaataccatctcattttgtataaaacatttcatctttattacgagtttcaaacaccatcttcatttcctaatggataatcatccatttataagtcatgggtttggtcttatacctacagaccttccatgattttgatattagaattatgtttgatgtacaattcacatactctctgttcaagaaaaaaaatccaacccttatatcctgaggtaattttagttgtgagaaaaaaaatactacataacccctcgttaatagaaaatgaatatgttggatgcgtaggtgagcggtacagaaggaataaaagttcttgatcaatgaatcaatagtaggtaaaaatgtagaagtttaaattttaattttaggattgagtctatctgagacacaaggagtactataacagctggtttaatttggtactacaataaagagagtccacgggattttagaggattgtttctattacaaatctgaacggcttgatggtttttactaagtccacattgtgcatttttcagatagtactccgctgacttaaaaaaaggacaaaatgcagtgcaagccagccaaacaccgaaacacgtatagtactgtagaagtatttatatttctgaccaaatacgtccatgtcgtgttctgaatttaggacgtgggagcctctatattgcctgtctgcctgacatagattttcagccaaagccaaaaataagaagattaaaaaaaaaaactctttgttcagttgtgccaacttacacacctagaaaacggagagaaattaattaattaattaatgctatgtcctactcctacagttgactgttgtcaatgtcactccgttgtcctgaaccaatttttttaagaacaatttgtcctcaactttggcccgtgagtgacacagaagcagagggacagttattatagttgcatttgctccaaagcaagtactacaccaagcaaagtcagagtgtttacagttcataatatctgtttttgtttcctcctcgtttaagccagggctgataaaccgtgaaataattataaaaacttctaaaacagtatgtgttattagtggtttaaaaatcaatttttaaaaacacaaggataaaaatactctaaagtcaacttgttttaaacttcattttcaaggtgacaaccaacagactaacaagctattaaggtaatattgttatcgttttgcatacaactaactataagtcataacgcttactaacgataaaaaaaaatgatgataaaacttttataatgtgttctgaacgacttaaaaattcaatgctaaaaaataaattaggataaaaaaaatcaaaatcaactatagaaatattttttaatattaaattctttgttgcagttgataagttaaatagcaaacggtacaattcacagctagaaatgcgaaagctgccgct

SEQ ID NO: 48345 - DNA, 4786 bp, Oryza sativa
catcctagcgacgaacctgcttagtgctaccatgcatccggttagcttttgtacttccttgagtcttgtgggcgacttcttgttctcgattgccttgatcttctcgggatttgcttctattcctctgccagagacgaggaaaccgagtagcttgcccgacggtactccgaacgtgcacttctctggattgagcatgaggcgatatcgtcggaggttgtcgaacgtttcccgcagatcgtcaatcaatgagtcgcttgtcttggtcttgacaacaatgtcgtcgacgtatgcctcgacattgttgccgagttggtcgctaagtgcgccctggaccgtgcgctagaaagtattccctgcggttatcagtctgaatggcatcttaacatagcaaaacaccccgaacggcgtgatgaatgctgtcttctctccgtcctctttcgccatgctgattcggtggtagccagagtaagcgtcgaggaagctcaacagctcacagccggctgttgagtccaccagttgatctattcgaggaagagggaagtgatctttgggacacgccttgttgaggtcggtgaaatcgacgcacattctccatttctcgttggccttccgcaccatgactggattggctagccactctggatgaagtacctctctgatgaagccagctttgagaagtttgtcgagctcttctcgtatggcttgtttttggtctggtgcaaatcttcgcagtttttgctttactggcttggcatcgggtcgcaccatgagtttgtgctcaatcacctccctggggaccctcggcatgtcggacggttgccaagcgaacacgtcagcattgtcgcggaggaaggtgatgagcacgaattcctatttctcgcttagtgttgccccgatcttgacggtcttgtcagggttggcactagagagtggaacggtcttgatcgcgccgtccggtgtcggggtcttgtttgtcttgctcactttcttgggtggctcatttgtggcgggtgggctgggcatttgctcgaccatgtcgaggctccacttgtcgcattgtaccgccagctttgtgttcccttgaatagtgattgttcccttcggtcccggcatcttgagcacttgatacgcgtagtgggatgtggccatgaacttcgcaagtgcagttctcccgatgatggcattatacgctgtatcgaattcagcgacatcaaaggtgatctgctccattcggaagttgtttgcttggccgaaagtcacaggcaacgtaattttgcccaatggtttggacgaggattggggagtaattccatggaaggattgatcggtgggtgtcaactcgcttcgcgaaattcccatcgcgtccaaagcactggcgaagagaaggttgattgagctaccaccgtcgatgagaacccacgcaaccttgatgttccgaatagtgggttcgaccacgatcggatagcgtcctgggatgacggcagtcttgggatggtcttcttctgaaaattctatcttctgttcagaccacttcatcttgtgtgcagccccctgccatgtcgaacagacttcacgttccactttcttgtattctcgctttgaggagtacgctgtggaacctccgaaaatgtgtgaaacgtggaggttagagtctggatatgctgtgtccgattcctgaggagccacctccgcatccttctcgaccacgcgtactcgcttgcctttttcaaatgccatgtgcttctcgagcgactttttgaaaacaaggcaatcttccaaagaatgtctgtctatcttgtgtatggggcaccatgctttcttcgtgtcgctaccttgtgggtctgggcgcttgggagggttcgcgtattctgctgcgagaacttccgcttgagctttcattttcccacttttgcgatttttcttcttgcttgactcaggtgcgtccgtggctggtttcttctctcccccggtcttcggcttatcgttcttgcgtctcagtgcatcatctgcgtgggcgcatcgctcaacaatctcgaacaatctccgagtagttgtgatgcgtcttgtcaccaactcctgggtagtatagcgatctctgacaccagacttgaaggcgcaaattacagaagcatcggtgatttcggggattgtatttctgcactcgttgaagcgccgaacatattccctcaaggattcacccgagttctgtgtcaacgcatgtaggtcgtcttcgatcgcgtggcgcttgtaagttccttggaagttggcaatgaactgctggcacaggtctgcacacgaagagatcgagtagggcgggagatgcatcagccatgaacgtgcagagccttttaacgcagttggtaaataattcgccaatgcattgtcgtctgctctggcggcgtagagtactgtggagtagacttgaaggaactcttctgggtcggtgctcccatcgtacttctctattgctccgggtcggaatctctcaggccattggacatcacgcagggaacgactgaaagctctacacccagcgctgggggcggtgggttgtcggcgatcgtgtgtccttcatggatgtctgtctgatgatgaggatgaagaagaagacgacgatgacgatggatcgcttggttccggtgtaggattacgaggacgtcggctaggttctcgagaatcctttcgccgccctcggttgttgtcccggcgtcgatctccgtcgtcctcgtcattatggcggtgtccttgaccagtgtcaccctgcgtccgcctctcgcaatcatcgtgatcgtggcgatcgtggcgattaacacggtctcggtcttcgctcgagcggccctcccgtctttcattatcgcgatgtcgtgaagagacgcgatgccgggagcgatccccgttgtctcgtgtgcgtcgtgcctctcagcggccattgaggtggtcacggagatcgccggtgccgcgaggtggaggggtagctcgatggggtgactcccactattcgggattttcgccattggcaccgccagttggtggctattccgggtgtgctgcatcagcggcttcttcgaacgcgttgctgaggttggttactgattcccgtagctgttctgtccactgtgcgagatcatcgtttagaacgggatcgtaaggggtctccctcagtattgcgttgatggtcctgatgtgctaggccggtgtagccacttgattttgtgcttccgcattagcgtgtgctgacgtgctggtcccgtcgatagctaatacctcgcgcggcgtactcgctttgatgagccatagtcctcgagtagatgcaggactgatggttcgggtgaactgatgtcgattatgccaacgaatcgatctgaaaccagcgtcgttccttgttccttgtcttcatctctaagggatatgcctaactgctggaccttaggggatgacgtcatcgtggcgctgagaaagaccttgcagcttgagaggtcgtgattctttgtcttgtgaataggacaatagacatcacaggttggagaaatacgctgaattccacgctctttgcaggcgcgaatttcggcgcggacgttgagaaaaacccaacaggcgtgcaaagtgtgtttcctggttttgtggataggacaccaggaccttgtcgcttcggaagttattctcgtcggctcgtggctcttgtctgaacgacaaggtttggccgcattagaatccttctcgagctcggatgtcgtcaatgttctgttctccgcttcggcgggaggatccttcgacagggagtcgtcctgggttgtatccactgcgttctcatttccggtcattgatggaccagctgagatcggcatcgtggtataaaccgggaagacgatttcgccgacttgagtccacaccagcattgttgaagtaggaaatccctggtggaggttggtgttgacgccgttgtcaacgaaactggatgacatagtagtagaaccttgagcaccaagtccccctacctggcgcgccactgtcgacgagtgatacccgtagaccggatatagagggtattggggtacgttggtacaaggatctatgtaatacgacatcaagcaaacagagaacgaggattatactggttcaggccccttgataggtaatagccctaatccagttgatatgagattatatgatggaaaacacaggttacaaagggtacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggtggtttccaagtagaactcggagacatcgaaacctacacgatacattgacgacccagtcttgtccgagtaggattcttttcatctgtaaactccgtgaaggatttccttagttatgcggagaatgtccatatacgcgcagacatgccatatcgatatgtgacgtatatcgaaaggtaaagggtatacctaacccgtaaccctgacaacatacatgaaatattaaatatatgctaaaataataactaattgcacagattgcgactatttgcgagatgaatctttttatcctaattactacattatttgacaatgtggtgctacagtaaacatttgctaataacggatttattaggcttaataaattcgtctcacaccctatataatactcaatgtgacacgccaaaactttacacccctggatct

SEQ ID NO: 48346 - DNA, 1157 bp, Oryza sativa
agataaggctggactgcagtaggacgacggccattgggacaccaatcctcgccagcaccatgatccccatcctcttgtgcagcacgtacgcgcacatcagcatccgcagcacctccccaacgacttcacatgaatcatatgcctttgtaccagctatatatgacttgctttttatattgagaataagcattattctcatatctccttttccttttctttttcaggtttgtcctcgtacaattgtaatgtccaaaggactggaaaagtgcagtaacagaaaggtgcttcacaaactgaaaagttgaaagccatgtcactgcactacgtctgacaaaagaacaacagctataggtatttggcatttttattggctactctataaaaaaagcacattaatatttgtgtcaaagaatttaatttctacacaagatttataggcagagggcatgtagctccacataatggagctcagatgatcaaatacataattacatagtccttactacatggagtctaaagaaatatatatatatccaagtagtgcagcatcatgcacggccactacttattagaaataaaatgaagtgaataaagatatgcttctgatgatgccaccggcgtgaaccgagcaatctttcatgcagattttcgcctccacctactcccacgcacgcacgcaatgagcaatagttggttgctgacttgatccgagctttgacaaattcagtttggaactttggatgaatctgcaattctgacgacaaaagggaagggaaggacaaaaaggttttactttaatcttctttcactcaatgtctaaagtgattttcagagacatacaatgggctttatatctttcttttactcaacatctaaaatgatattcagagacaacacaatgggcgaagacctgtatttatctctgctctgaaagactgaaacagtctctgctccagctacgaagactgtatacttgctggtcatacagatccaggatgtgtattatttgcaaattcatcagaaagcatgactcaaccatcacacacactcacacgtaccatctgtcatctctttcgatgatatcattcaacagggtgacaaactgaaaacaaagaattgcaagaaagattggaatgaacacaacaggatgacccagg

SEQ ID NO: 48347 - DNA, 2839 bp, Oryza sativa
ttgtcatcagaatcactgtcagatgcagatgcagattcggagtcagattcagacgatgctgatgatgaggtttcccttctgtgcctcctcttctgctgcttccttttgggtcgccgcttcttgtcctccgagtctgaggagctgtagcttgagctacttccagaagaatattcagagccggtaactgatgattcactgtcagagtcaaatacagaagcctcactactatctgaatcactccgtgaacggtattttctcttgcttttccgtttgcttttctcagacttctccttcttcaactttgctttcatcagcttcctttcctcttccttttccttctcaagatcaggattctggaactgataggaaacaggagcagccgtcttcttcagcttggggttcttgagctgctgtgtcctcgagggccgcgaaatgtagacccgttcgttcttgcactcgtatgtccagtgcccaggctgaaaacacttctggcactgggtatatgcgccaccagaagaagaagaagtttgcgcagcttttggtttcactcccagtatcacagccttctctgtactcatcagatacatctgtctcttggcctccttcctctcctgccagcgcgaaggtccctcttctttctgcccataagcattgacattgcgggcagcggctgcagcagctcgctcggcttgagttctgctcaatcccttggcagcagataaggcctgtgcttttattctctcagctgcagcctgagacttatcgtcatttccagacatcttgggctcacccaacaagaatcaaatcatacaaaatcagcaatattatgatcctgtaaggaaaccaaaatacatcaatagagtaatttgggtaatgaaaaataacgcaaacaataaataagctttctgctataccaaaatcaacacattgatgcaggaaaaaaaatctggcacataatatttttcgttgctataagaagaacatctacttatgaatttgtcatacgctcggtgtgtgcgtcggtggtcaatcattgctacgcccaaaaataaaaaaatggacaaacccttagagctaagagattctacagtaaaccgtggtaagaaagaaattgcgagctacaacccaaaagcaagcaaataaatccaacgaatacacctccccaggccgggcggatcttaacgtgggggcatggggattcactcgaacccccccccccccccaaaactttattccgtaacaaactgctgctattagtgctagggttagggcaaattaagagaaaagcttccagatctaggagaagagaagctagggtttaggcgaagacagatggtgcgggggtaggaaggtgcgtgtgggttggtgctcaccggcggcgaggatgcttgcggcggaaggaggcagcaggtccgcctcggctgctcgccgagttcgatggagatcggcgcaggcgaggcggcgggcgaactcacgaggaaaagagagagagagagagagagagaggagcgggtcagaatcgggagaggtgaacgggtcgggatgtgggggcgagcgatgatacgtgggccgttaatgggccgatcactatgtcggtcagtgatgggctgatctttatgtgggccggtgatgggcccatgaagtaaataatgatttgtactgatcctaacagggtaaatttacggtgatattagacaaccatgcaaagttttattgtgagatataaaacgaagaaaattagaaaaaagaaaaaacagaaacaatgtttttattttaagattctttaattttattatgcataaacggagttgaggttgtttatttacatcctacctacatgctctgtgtgattctttcagaacttctatataaaaaaatttccacaagttcctgatttttgaacatgcgtgcaaattagagtataataaaattattatttcttgatatcatatgatatagaagtaccccgcaaaaaaaaatgatatagaagtatatttatttgagatccattgccataaatggtcccaatacggaacccatttctgtttctcagaagcatgagcccctgacacaacctagcagaaaacacatacaaccatctcagttttgtcaagattttggaggtctattacctgcagcgagactgaattctacccgggaaactactttttttttattttatgaaacacgcgaaactactataaccataaaactgacagcttttcaaaggccatgttacagtttctccacactgaaaaaaacagtaaagttacaccaacttcaaattgcaacctgaactatgaatattgctgccaaatggagtaatatatacagcaaaggaaagtaggagcatgaatggaaaaggaaaaaaaatgtggcaaaggttccaaaaaaaaaaacatcctgactacacaacacacaacccattatgatcatgactgaatgtatctgatatctgtgaattctaactgtcgaatgcacaataacaccttgcacagccaaagtaattcccaaggtaatgaaatccagactgaaactcttatttgatggtatatatcatctctaaagccgctaaacctgtaaagccaaatagcttggcaactcctcaaagtgcttccctagcacccattggtcagcgagtcctgcggctgttggctggtttagatggagaagacggtttgttcttagcgaaatcgacaagatccttgaaaagagaatcttcaggtttggtctgccgtgatgcggtcggaactgatgaacctctctcattctcggtattcctctgattaagcgaaaggccttctgtttggctcaccagtccattgtacccggcaccgtt

SEQ ID NO: 48348 - DNA, 3513 bp, Oryza sativa
ccccactaagatagtcaacactgcttgcctccgtgaaaactggcctctttgatgatggtggcggaggaagaagtgggcttgggtaaggcctttcactttttggagcaaaaggtagattgccctgtgctgctgtgccatcccttgcagacctacagaacatatatttgtacatcagatgacaaaactaaacagaccgtgaatcttggtatcataacatgatccgcatcaccaaaacattttcttaagagcagtcagctgatgttgccacaaccatccaaagcttagaatagcaatagcatgtatgagaaataattagtaaagggtactaatagggaaaactaatatagcttgcctgcgggaaagaacagagaactcgtcttctggctcatcgtcttcatggtgcacattaagaagtggggaaaatgaaaccccagtaggcctaggaggggctgttcctcggtttacattagcagcagcaggagctgggcctgaaccgggaggcactccctttgcgatgtcatcatgacgctgaagaacacgctgcagttcatcatttaaaccgagagcttgaaatagaaggctctcatcactgcagaggatacaagacaatatgtcacatgacaatgtgaaaaggacatggaaccaaaatttcagagtaaaagaatagaacatacccagtattgctaacaaggtccatgactcgaccttgataagatcggcactgcccaacaaggtcaacaatgacctcctccctcacaccctacaacatgaagcgcaattagacagaaatttagagaaaaagagcataggtgggtggaatggtggattcaatagttaaatacagagacgcatagagacatcacactagtgcaagtttggtcataataaattaaaatattagggcacattatttttagccagataccagagcaagttctagaaaatacaaaagcttagaaatccctctttaattattcttatgccctcagtctcctatgctgctaaacatgattccctctgaacaaatggaccaagtaaaatagttcgcacattcctgtaagctgatgaggtaacatggatgaacaaagatataaatggatattggataatatactagacttcaaagcctagcaagaaactactttgtcatccattacacatagatctgatcaatgatgggacatgtaatagttacatcctcttctgtgcacaattcacagatacagctcagctcactacatgtgaaatatgctgtagtatgatcatatgaaataaaacacatgatttatgcataatttttttcatgggaaaaacaaaggtctagaagacatgacaatcatattaaagctcttaaaagtaaaagaaactacagaagagatacaaggattatacaacactgcactaaattttgatgcttaaaaaagtcacctcagggtgcctgtggtccaaagcatttaacatctcatccaacacatccacaattcctcgagcactctgaatctcacttagactgtaatgcacaaggagcaagaattaaaggtggattataactaaagaatttcttctgcaaagatggtgaaataaattgataaacacaattgaagtattcaggtattgtttagcatgattatgaaactaaactgtcacaaggcaataagtagaatctattttggcacactgacaccgccatattttgttgttagaaataccactataagtatgaaattcttggaaagttgcatggccctagttctatgaatgtcttgcctgtaaggctgtaacagggagacaaacaaaattactattaatgtaatgcatcataattactttctagtatgctttagagttcaggaatgaggacaaccaaggatagcggcaactgcaaccatcagtagcggaggttccaactttagatcagagatggcgtacttcaagaaagcaattaatcactgaccacttttttcccccaaaatacttgacactccatagttgctaacaggtatttttccaatatcacacctggtgggcccaaccggaggttcagcttttttttttttttttttgcccctcaaaactactaatgtgttctcagtgactaggaaaaaacaagaaagatctggagcctgatagcctatatgcaccgtgaaccttctttccgtactctccagttgtgctgagcggcaagtcctcagggttggagccttggaggcacacaaatcgtccagaagcaacttggacactgctttctgctgtctgatgcacaatttcagcagaatagagatactttaatccaggagcattttcgaaatttaactaggaaacattttatagccttgggaagtttgcttggctaatgggtgtcatctatagaggaacagagggagcagaacatattgtgagtacgattccactcctaaaacatgcctagccatttaatgtggttgtaggctgatcagtatttctgataggaacatgtgtttgaaacttttcccccccaagtgtgaatttacaaaccaggccatgcttgttccaaccaaagtaggttattctaaagagaatgggaaaaatagaacaaagcaaggcataaagaaacagcaaaagtaaatggcattaagaaactatggatgaatatgacagtactgcttgaagtgaacaagtaaataaggaacaaattttgcattagaacaaaagaacacctcaaggcaggtgcagaaggggcgctagattgaagagaagcttgtatcgctgcatcttcatagctttgacctggaggtggatatagatgtggttgcctcaatggttgagtttgaggaggtgtaaacagtggaaccgtgttctcctcacgaggtggaaaatcaacaccagcattctgcacacaagggcaggatatcttgttcatggtttggacagaaacagaagcaattgaatattaactcaaaagtaaaaacgttgaagatctaagtttacattgaaacaaagtgcagaacagattgaagttgagtggaacagtagtcaagtatgagctgtgatagcacaggataaataacagatgagaaaactggaatgaacacaagtagacagtaccctgagttcttggtaagcagcgtgatactggggatatctgccagatgcacctccaaaagccacttgccatgtgtcaatcaaactcaatattttctcccgaacatttaaatctggctgaaatcataaattggcaatcaaatacagaagcataagaatgtaggaactataggaataagtcttggctggttggtcttggtcttgtggtgccttttcctgcttttcagctttctaggacagcatctctactttcagtttggatgctctaggacagttaggacagcagtttgttgagatgctctaggacaatatgttgagatgctctaggacagtttgttgggatgctctaggacagtatgttgagatgctctaggacagtttgttgggatgctctaggacagcaccctcttagactagcatggctgcatggct

SEQ ID NO: 48349 - DNA, 1026 bp, Oryza sativa
  unsure (1)..(1026): unsure at all n locations
cacgtcaccactgccgcaaagccaaagagctcgatccagcgccgggtcagcaatcacgcgcgacacgaggccaatattagaattattttactacacagcttttatcgtatccgagagcagtaaaaacgccgcctaatttacccggatccggattttgnaagcgtgtgcgttgcgtggcgctggtgggggcgcggagcaaatcagggctccgggacatgtcatagagctgacgtggcgccctcccattggccgagggctgtacaggtacgtgtacgtagtcggggcgcgcggtgacgtggcgttggccgtcgttaattcccctgccttttttgaagtcacaggattggatttatccctcgggaccaccccactttcgcccccctaattccacttaattacacatcactcctcatcaggggcatattagtaatttattacctctagttttagcacatctcagcctcgtggagggatgatttgacgatgataagtacagggggttcatcgcaaatgttacctgtaaatatctcgtgactccggtgcgccgcgtccacgagggagtccgcggggtggggcccggtgggcagtttcagggtcgatgtggacttggtccacgtgatccggtaaacccccccctcgcgtactccgccctattaaaacccgtgtgagaagcgtgtcgtctcagggaaaaattccgaaagccacccacactctccgtctcctcctcatggcgatctcgaaggcttggatctcgctgctgctcgcgctcgccgtggtgctgtcggcgccggcggcgagggcggaggaggcggcggctgcggaggaggggggcgatgcggcggcggaggccgtgctgacgcttgacgcggacggcttcgatgaggccgtcgccaagcacccgttcatggtcgtcgagttctacgccccgtggtgagtgtgctctgctctgctctgctacggcccccctgttgatgagctgtgcgtgttgggttagatctcgcgaggtgggtttttgggggggggggg

SEQ ID NO: 48350 - DNA, 8512 bp, Oryza sativa
agggccacgagcctcaggttgccgcggcggcggcgacgtggatggggtactcgccgtcgccgtccgggcggaagggtaaggaggggtcggcctcgaggagaagctgggtgggtgtccggcggccgtggctcgacggcgagcggagacagcggcggaggagtgaactactgtcggtctctgggttgttctccggtgaggctgctgcgaagtggagcgctgtgctgctggacgcgtcggcttcgccggcgagccccttgttccattccagtatcttttctgtcatttcttgaatttatattatgagtaaatttcactgaactaataattatatgatgagaaaacattatattcatatatacttcctccgtccaaaataagtacaaccataagttctcatgtccaactttgatcgttcatcttatttaaaatttatttatgattagtatttttgttattattagatcataaaacataaatagtaatttatgcgtgacttatttttttagttcttttaaaaaaatttaaataagacagacgattaaagttggatacgaaaactcataactacgtttattttaagaagcaattttacggtttttgagaaggtaccaagagataccattttttctattataaatttggtattttttggtacttagctattataaggtactatgaggtacagattttagactaaattttttttacctaatgctacctcttcaagagcagtagaattgtgacggaggagtatctttgattgatcggttatatctttgatttgttgaacttaattacctgcgctgcgtaggacagcagcgtgtagggcagtttggccggccggtcagaatacgagacctcgtcgccgccttgctggtgcagggcctccgcgatgcggtcatgccgcaaggacaccgcaaggtacaacggcgacatcccgccgcccggcgccggaacacgggcgagccgcgggtgcaccgacatcaggtggcggacgagctgctcgtcgcccagcctgacggcgtcgtggagtgctgtctcctgacgagcgttcctcttctccagcacctcggctacccttgagccgcccgtgccgccggcgagctcctcctcctcctgcctggccatgtcgaggaggcaccctaccatcgccgcgttgcccgccctggcggcgcggtgcagcggcgtgtcgccgccgccgccgctcgcgctggggcggtccaggaggcgcgcggcgtgacggtagatcgcgcgcgcgcagcgcaggaacccttcgccgtcgccggaggccgccaccacgtgcagcgcggagtccccctgcggcgtcgtcgccgccgcgtccaggaggtggggcaccggcgccgcctcaggcgcttgttgcccgggggccgcggcggcgccatgatgatgcacgacgacgacgtcgatggcgacttggtttggcgcggcggcggcggcggcgcccagaagtagagcctcgagccccgcgaagtcgccgcggcgtgcggctctgagcagcctgggatccatcgatcgacgtcacgcgctgaagtatgtaccactccggaaattgaagacaggtttacttaggagtagctgactatactctggatcagatcgtcgatgagaaaagatttgcaggtcaatcccaatggtcgagagcatccatcttacccagatacgaaaaaactgtgtttaaccgtaattaattataggttttcacctcagtttacttcttttttctattctatggcacgtaccacacacttagaccccacgaatacgtgtcctagcacatactttaagagaccgaaaccagctgtatatcatgtatcgatcacactaaattgccattaaaaacccacccatagtgtgtaatattatggatattaagatttgaaattatgcacccatgatttcactactatattacttgtgtttctttataagtgtatttatttttatgggtaagaagatgacgatggtggcgggcaacttcataatgggtaagatgaagaagaggactacaggacattgcattcagccggtactgtctaaacccgttggtacatgcaattatcttgagttacatatgtatattgtcagatatattttcttatggggaatgtcaaaccgagacactacgcattaattagccgagcctctccgcccccgtctacgacgcactcaatgttaggaatttttttccgagtaaaatgttcagaggtatccatgcatggagtgtttaaactactccgtttagagatttttttaaaaaaaaactttttgaattttttattttaaaataaacccttcccaaacttatttttagaatctaaactttttatcacgccagccggactgacatggcaaaacaacactgacacgccactctggctagcgtggcagcgttatttggtcacgccggtctagctggcgtagcaggataaagatgtcacatttgcaatgtgtggtgtgtcaatattgttttgtcacgtcagacgggttggtatgcaaaaggttcatattctgaaaataagttttggttgggatttttttaaaaagataaaaaaaacacaagtacaaaaaataaaagaaaattccaatttaggacatgcctacaatttagaccccactttaataccctttatgaaccaagtgagagggtcctttgcagtattgcttactgacatgtggccctcacatatcctcaggcccacatgtcaacgagcagtaatgtgtagtactagaagatttgaattgttatgaacccttgcagacgctattcctgtccgttttgtagtttgtcactagctgaatgcctgaattgatctattttgttgacttcttttaaaaaaaatcacaactatttagatgatatgtaaataacaagggaatgttcctcaagactttataatcagttgggccaaagggcagcgaaaaggaagtgagcagtaaccttccaccatttatcaggaatttcagaattgcaaattcgaggggtattgatttaaatcttgatgactctgatttttcagctgaggttttgaacggatgggacagtaggttgatatctttaatggcacgaagatccataagccaaacgtttggaaattcaaatcttactacttaaaaaaaattgataacttttcattagtcttacataattttcgtctatttcgaggaaagggtagaggagattgaggggaacccatttttccatccaatttggaaaaagagagcaaagggtaggtgtagggatgaaaacggatcggaaacggacggaaactagttttatcatatttgttttcatattttttttcagaatcggaatcggaatcgaaaactcgaatacggaaatgaaatcgaatattatcgaatacagatacggagcgaatacgagacagaacgaatacggtggcgaatatttactggtatataaaaagcccctcaaattgagtttctgatcaaggaagagatatcattcaacatctccaacatttatatcatcaattttgtagacggtctcacaaccgtatgcgaaaatcgattttcatggttgttcctctaagagatccatatgcaaatatgattatcattttcaattctcaagaacttttacttgatgtataacttacttgccattgtataaattggagatgttatttattttactttacatcttcgaaacttgcaatatttgttttatgctttaaatgctttcaaatacaaatgttataaactacaaagtggtagatcccgttgagctctacaactttgatatagaacacatctccatcagatgttgtttgaattgtagatctgagattttgtaaaaattaatatgatatattataatgaatatttagacccttaaatgatctcaaataataaaatagtcaataagaaagttgtagatctcatcgagatctacaatgttgatataaagtttgtcttcatctgattccgtatgaaaaagttatgtatatatacgtgttttttctaaaattttatcaatgtctgaggatatccgaaaaaaattccggatagtttctgaccgttttccgattccgacggatagtacccttactgtattcgttttcgtttccgagaaaataatccaaattcgtttccgaatccgaaaatttctggatagttccgaccgaaattattcgaatccaaaaaatggtccagacggacggaatctatccgaacagtttcatccctcggtaggtgggattggaaggagaggcagcgcgggcttcgcatgggcacgggggttcggtctggaggtgtaggaagaagactgtggcacatgggccctgggcgacagagagaggagagaccgaggaacgctatctagactttttttttcaccaaacgctatctagacttgctctgctgctgctgggccgaaggggaaaggaagaaagcaaacaggccgataaaaggaggagacagattagacttcaccggagaggaggtaaagcctgctagagagagagagagacggaaagcagactttactcgaattggtccaagacgagacgattttaactactttttcatttaaattaatcactgaaatgaactttgaattttcaaaaacactttcaatgttctaataatttcaagaaaaatcatgaaaatagttggatactcaacgtatttaaaaaaatatttatctagatcatttaatgattaataattgcttaaataattattgaaaatgttctttgtattgttaaaattaataattgaaaaatttcaaagagtataattaatcatggagaatttattaatgattaaacacaaccatgttttaattaggaaattatatttctcatattaaacttcacttgtaaattaatgaaacttaatataaattttgaaataatttattaaataatttacaaaatcccttaaactcaaatcaggatgtgacaaacacaaatctttaaaaagagcaccacaataagcggaatatgagttgcatccaagacataacacatgtgaaatcatgaaaaaacatatatcatcttcagtgtcaccaatcagttgcgctctgcttactctaccttcgaaatggaagacggctcacgtttctctgctccagacgaccgaatctgccagcgagattttcctttttttcttcccgttacaacgtacggacactttttctagttaaaattaaagggttgtacagaaagaattactcatcgaaggacctcgcttcctgcatgagacacttgtcctcacgaatcccatagcaacgacttctctcgtgtctctttatcaaatctcccatcttcctactgttatgggctcatggcgacggcaagggcatgaacacccgcgttcaggtctgaattcgtagcatctccggccataaggcgagggtgcggaggcgtgcctagaagctgcttcgagctccttccatattttgattagctattggtagatacttcctttttcctaaaatttaagggattctatatttttttctaagttaaactaaggatccaattctttaattttgttgagaagagtatgaacatctaacataatcaaggaagtaaatcatgaaaatatatatttcaaatggatgtaatgatgctcatttgatactgtaaatattattattattattttccttttattagaaacacggtataaaagtagatgctaacaatacacgtacgctcgtatctatgaacacgcacacgcgcatcctacttctataagcacctccaaaaaactggactgacatatattttgaggttgacaaaatcaccatgggcacctcgttggtgatgagtacgtcgcctaccactaaaaaaataattagtcgtaaatatgagcatccgtgttaactctagaacttaaattcggacgaactggttccgctataagaaacttggctagttgcttagttgtctgaccaaacttgagacaacaacttaggacataaatagaattagaatttttatactttactactccctccgttccattataagtgcagccataagttttcgtgcccaacatttgactatccgtcttatttgataattttatgaaaaaaatttaaaagttaagtcatgcataaagtcctatttatattttatcatctaataacaataaaaatactaattataaaaatatttcaaataagatgaatggtcaaagttggaattaaaacttacaactgtgcttattatgggacggagggagtagaaccaagtgtgtattcactataacaaccacatcccgtgaatcccgtggcaaggtcaacatcgctacatggccgcatagtttgttttcttgccgcacggtttggatgcacggctgcataagaaaggtcagagctgagcaaattaagcttaggacgccagtgacttgtgattaccggtaagcgtgctctgaccgtttccatttcttttcctttcactttgtttttcttttcttatcttacggagcttatttaatggttgtggcgtgaaagaaagtttttactgttagtaattaatgagaattatagaagcagtccaaagaggagacttttatttttgtctcaccccagagcatattaagtcatgccgatctgaactatcatatttttttagacttttattattaactaactgtgacttgctttttaaaccctgaatacttctacctagctaccacattttcagccgaggtatatacgatgatgtgtcctatacatcttaaattattaacaaaactgacatgactgaccaactctattgtgataaaattgaccaactctattgtgataaaattcagatttccaaatgtattagtcatttgattatagagcagattattaccacaaattgtgtatttgatcatagggataaattaaacattatgagaaacaaacttaataaatagttaaaaataagttatctaagcagttaatactgcagaagaatgcttttagagagcaaataatctgtttttaataatccgacgaataatctgaaaaaaaaatagggatgcctttagagatgtgattatggtgaatgtgcttttggaaagaatgatgaactaactgtcctcaaataatcatgtcagctggattaattggagtacttttagtgtactccattgtacaatcaaaatataaatcatcacacatgacatcccacctcagttttgtccagtaccgaaacctaaaatgcgttgcaacaaattaaagtataaagtacatgcaatgccaatgcatatgtcgtataggagtgcatgaaacagatccaattgtgaatgcaactgctgcactttctttcttccctctgatctatagatcaaatttcgttcacatacacatatagatcaaatttaattttgcaagtgaaagtacacatggcataataaagtatgttgagaaacgctcaggggtcttccggctagctccacaagacgtgttgggctagacgatttgggttcgaagtctcaccccttgtaattatttgatattagatcattccctaatattcgtatcataataatgtactacctctgtttcaggttataagactttctagtattgcccacattcatatatatgttaatgaatctagacatatgtacaatcctagaaagttttataatatgaaacggagaaagtacgttgtctaaatcttattttaagtttttgttaattacttgaaccacgtaagaaaacaaggacacatgccctcaagagcttaaaacacttcccctaagagagtaaaaattataccatttcttccctgcaaggcaccaaagggccggccccatgcatccatccatccttacaagtcaatctataagttattagtagttgccagtttgccactacatccaaatcaaagacctggcatagctaaaagccccaaaggatggttggttggttggttggttggtgagttgtctccaatctccaaactccaagaacaagaatgccaaatcaaaagagcacaagtgctaattaagcaaggtaaggtaaagctaggtgtatgcatggaatagtatgcatacctagttatcctcttgcttcactcctccccttctttcctttgaaaaaattaatcttgcctactcctccaagaaacccaactttgcttccatgcaaatgaacaaattgcactagatcattattatattgttgtatttgcacaacataaaagtgatgcccaattcaccatttcttgtttgatccttggttcttgagatttgatttaattcttgtgttgcatgcgtgacgacgatgagatgcctaaggcctggtggtgctcgccggcgatgccagctgctccaccgcgccccgccgccttttgcgcctcgctggtggacggcctcgcgcagctggagagcacgctgttcgtgaggaggacgacggcgatggcggcggcggcggcggtggggcggtgtcgatgaggtggtgcgccgacgccacactttcctgtaggctaaacatctcttgttccaccccttcccaagctcg

SEQ ID NO: 48351 - DNA, 2397 bp, Oryza sativa
  unsure (1)..(2397): unsure at all n locations
gcatgcgtgacgacgatgagatgcctaaggcctggtggtgctcgccggcgatgccagctgctcgacggcgacaccgccgccttttgcgcctcgctggtggacggcctcgcgcagctggagagcacgctgcttcgtgaggaggacgacggcgatggcggcggcggcggcggtggggcggtgtcgatgaggtggtgcgccgacgccatgaggctggtgaagcggatgcagcgggagcttctggtcatgttcaagaaggccgacgtgccggtgggcagcgccgtctcctacggcggcggcggcggaggcggcgacggcggcgggtgctggttcgagcactacatgcaggagacggcggcgctgctcgacttctgcaacgcgttcaagtccgccgtgtcgcggctgcaccgctactgcatggtcgtcgacttcgccgcgcaggtcggctgcgccggcgccggcgccgccgcggagaacggcggcggcgccggcggctggtggctggaggaggagccgggcggcgacgacgcgggcgccatccgccacaggctgtccgacgtgagggcggcggtgagcgaggcggagcggctagggaggaagatcatgtctagctccagcggcggcggcggcgccggggacgacgacgccggcggcatggtggtcgtcatgctcgtcgccaagatcaccatggccgtcgtgtcgatgttcgtgctccaggccctcacctcacccatcgtccccctcgccgccgacgtcgacgacggccactgcacccttggccgcgccgccgccgtcccggtccccgagctccagccatggcgagaatccctctccgtgatcaccgaccggttcccgaggcggccgggcgtcgccgagcacgagagggtggccatggtggtgaagtccatgatgatcaacaccaagatggaaggagaagaagagaccaaaaatggcaaacaagaacaagaagatgaccatgttgagcttctaagaacaagatcaggtgagctcagggaaggtgtggagatgtttgattgtgttttggatgaagtgtttgatgaggtgatcaagggcaggaatgagatgcttggcatcttcagagataaggccctcacactgggctgaatttttagatgttagctaatctctgaaaagttaattgaccttgagcaatctggaaaccagcagggtatgtatgtaacctggggtggatgctaatttgactgatcaatttgagttgttttgttgagggtttagagcttcttgcaatgtgtgagtatgtgtttatgaaggtgtttaattatatttggtttccttttatactttaatttctcctttggtttgtaacttgtttcagtgtgacatactgatcaataaagcatctgaagtttagatttgttttatatctgctaaaagagatgaaacaccagatgcaatttcacatctacattgcagttgatgcaggagtaaactatgttcagttaagaggtgaattgaagttcagagcacaaaacacaatcagatggtcacttcttcattgttgaaggaatgctcaattgcagcaagctgtantacatggaacaaaaaacaaacagatgatcacttattcattctcagttctgatctaaccaaagccccagggaaaccctgaaaattccacaaattcaaacaaaaaaaaattgcttagtttgctatcacagagaaattacagaaggttttgtttcctgttgtagtattacatttcaacaagaccattgaggattacatcggaatcatgtcttcacttggtagttcttttaacaaccatatgataatacacagtgctaaactagttctgggagttcatgccccacttgtcccagatcaccccaaaagaatgaacaaaactttaccgagagcagaagaatttacgaaaatcaaacggccatagttccctaatccgcctttgtcaagtgcaaaatagaaaggcggcaggaactggtctgcaggatcatagagtaaaggagtagaatcgcttgcgacctttaggcttaaattcctcagcaggggcataaatcttgacactgaatagtcctgtgccatcctgtgctatatcaaaggtaaaatcctaaaatatccttgcaccacccattccgaaagaatctctgtcatcttgttagttgtggactgctgcgtctctcttctgatcgatgatggaataactttgctattgaccgcctctcacaatcctgaacgagaatagcatgtaaattagatttagtatggttgcggtcaaactagctagctagatggtcaactgtacccaccttaaacatattaaggcgaaatggcttctccgggttcattcttctaagcttcaaatatgtatatgcaaagctgagctggtcacgaggtgtgaat

SEQ ID NO: 48352 - DNA, 2493 bp, Oryza sativa
gttggaaagaacgaatcagaaaaaaacataaacagtactactgaatcatatgcctccacgtgagctcaacctatctgagaccagcaaagcatcaacacagatacagctgaattgaaggaatcaggattgattgctactagtagcgaggcagtcaggaatgtgcatactgatagggacagggcagaatgtgaaaacagatttccacctggtggcaccggtttatgactggaaactactggtattttctggcagttagtgttggccaatatttttgataaaaaaaatagtaaccagctggtaaactgcttggatttcccaaggtgatttatcttgggggaggggagttactagctcagttcagctgaggattaagaatgatattggcccataaacatgacagtgtggattcaatgtggaaaaaaaaaagtacaaccaccatatataagaacattcatttttaccttgatgatgggaaaagacgatgtgccagaaatttcggtattttgccgactctccgcatgtcattataaggcatattcttaatcaatatgatcttccatataccgatgaaacctgaactatccattttttggccttcagattccaaagttcgtaatgtgatttcatccaaaaacatagcaaagcatactgtcttctttgatagacttgtaatctgcgtagacagatatcatatgaagttatttcttaaatattaccagatttccatcaacttctgaagcatttaaaaagattcagggagcattggaacaacagaatggaaaggtcagcaattgtttaacctaagtatggagattgaggttatatattcatgtatatccaaactaacattgcagaaggttcagttgcatttcacaggcctattatataaggtttatgtttcattgcctactaacagagccaataagtacctatggtaaaaatgaagctactgagattataaggttctaagacaaatcatgcaaagaacgctaattttgcgattgccaaaatatacaagagaaccaaaataaatacattgacaagagttacattggttgtaactcatgcaggattaggggtatcataattttttcaggagtttgttggtacagaaaaagaacatactgttttcccaaaaggagtcttcagacgatcagaatttccaaagatgcaggaagatactgcaatgtggcatttgctcatgtactttctgttttcctctgagatatcaaaaccagtgcttgtaccattgggacccttaacaaaagcacaatttaattgttggtcatgagctaagtatgattcctctctttcttgtaaactctggtggccagcaaatcttggctcccaatactctgatccaagaggtttgtcttcaacttccacatattccaaattaaaactagcaaatttctcatttttagcaggctctacgagttgagcagtggagttcagaaacctcatttcacaagttgaacctgatttatgtttatccaacagattagaaaaccatccataataacaaaggctagataccaagagtattttatgtgataccaaattatcaaacgtagaaatcaatagatcatattgataaacattgtaaatcaagcactacataaatacacatgatgctgctgtgctactaacatctcaatcttcattttaaaggatactaatgtgtggaactaacagattagttggcactctaaaatgtccaagactaactgatttatgtctatcgaacatgaatagcacatagttagtaccttcttacaaccagattccataattggtgtttctgatatcatagaagcaagctagaattacctctaaacactacagaaggctattgaaacagaaataaaatgcagaaagcttagttattctcagtagggatcaatatgtccactaagctaaacaagaaatcaggtttctgaattcaaatcgcctgactctagcacttaaatttggggaagaacaaactcaccagtcttcttgcgctttgatttcttttttgacgcgtgtttcttatcaccagtcgccgaaaccttcttttggttcacattagcagcatcaataacatcgacaccatcactaatacccgcacctgtttccgtgcgtctctctaaggcgatgctttccttattgccggtgctatcatgagctatattttccttactctcggtgctctcatgactactgtcgcaagcttcctcccgccatcagatgaatgcgactgagcatcatcaagatcgtcctgtgcatcaatgccatcgtcatactcatcatccggatcaacctccctgatcccagtacccgcagctcccatcgcagccgcctcatactgctcgagctctttcctgcccccttcattgtacaaggtccctcctttcccaccttcagctacctcagcagcctccttatcggcggcaccgccggtatccatggtcaaccctttctcctcaacagcaggatcagaggtcacaacct

SEQ ID NO: 48353 - DNA, 1072 bp, Oryza sativa
ctcgcaaaggagaacggggacattgctcgccatcgttgggccactgatcatcatctggccgacacgacgtcccacggcttcgctgctcagacctgtgaatcgagaaccaaagttcgataagtcaggaggaacgcgcacacaagcaagtcagggtaaatgcaagaaagataccccgaggagaaacctgggtcgtgtcctccggtccagaatagtcaaaggctagatgggctcgagcctggagcgactggatccgtctaccaacgaagtcagcagcgacttcataccccgacaaacctcgtactcggagatcgtcgataacatcgatgaaggactgaagggaaggggtcaaggtgggctttgcggtccaagacgaaatcttgtctggttgttcctcaggaacaacaaagacaggatccgaattttctatctgaagatagaaccacctcgtccgccatttgctatgagaggaagggcactggaaggggatataacgcgacttcaggccatcccggagtcggaatccgacgcatccagataccctgttggactacatccaacgcaactcgtagtagaagcgaaagagatcaagaaaaggctctaccccaatgtaggcctcacaaagatgcaaaaaaatactaaggaaggcaatagaattggggttcaaatggagcaaagaaagaccgtagaagttcaaaaccaagagaagaaattcagaaggcggagggagaaaaccgcagagaatgtagtcctcgatcgcaaccatgcgacctaggacaagctggggttcagtacctccttcttctctctccatggtcccacgaccgggaggggcgccatcctcctgtagcttattcagcgacgcgctggtggaggaggacttgccgagatccatcgctgactggagatcgccggagaaaggactgagattgatgagctagggttttgcgggagcggaaaagacgagaagcgcttggaggttggagggtttcttcacaacaggcagacttcaaaatggatccccaaaactctcttaaataaacgcacttccgacggtgcaaatttcaaggaaagg

SEQ ID NO: 48354 - DNA, 1760 bp, Oryza sativa
ccgcgtcggggctgtcgacagtctttggcccaatggccaatcttgccacagttgcggcaggcgtattcttgtgccggcttgtggttgccaacggcgtaaccctgtgcacctcctccagcgccaccctcagcgcgtcttcagcccacccactgacgcctccgcgcgccttgcgcggcttgcaggcgcctgtcgagggaagggactcccccttgctgccgttactctggctggactcccactgctgccgagtgagatagagcttcccgccaatggtgataggccccgagagaggctgtggctcagcgccgtcgacgacctttaggcgacctaacgcctcctcgatcgacatcgtggagaggtccagcaaagactcaatcgagcgagcgatctgcttgtacttctctgggacgcagcgaaagagcttctcgacagctctctcctcgtcgtaggtgtcgtcgccgtactgcaccatcttctgcaaaagagtgtggagacggagggcaaagtcatcaacatcctcacctggcttgaaggccaggttctcccactccttgcggagtgcctgcagtgttgacttgtgggcgcgatcgctgccgatgcgtgccgcagcgatggcgtcccaggcctccttggcagtccgcttctgggaaagcgagaactgcatctcgggcgggactgcagcgatgagggcatccagtgcccgccgatcctcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtctggacgccgtggtggccatggtgccggtcaggggagggagagccacgctgcctgcgagggccgcgcgcgggctccgggctgccgccggcacgcccgcgcccgtctgggttcccgtcggcgggcgcgcggtcccttgggccgccgccgccgccgtggaggtgggctgctgcccaccgctctgcccgctcccgtgccctacctcttgcaagctcctcaagctccctgtcggcggtgatgtcgccggcgatggagccgttgatgctgctgcgcaaggtctcaacctctacctccgccgcacgtgccgcatcttccgccgcctctgcttctgcctccgccctggctgctgccaactctgctgccgccagtctggccgccctcgctgctgctgcagcggtctgagccgttgctcgcctgcgctcttctgctgcggcgagctcggcgtcctgctgacgccgagtgctcgagacgaccgaacgccgagaccgaacgtcggacatggcgcacctccggggggctgctgcgtggagagggggaagggaaaggggaaggaggagcagccggtgttgctgctgctggtggtggctgagagctcaaccgagcttgggaaggggtggaacaagagatgtttagcctacaggaaagtgtggctctgataccagatgttagaacttcaatggctactctcattgagaaaaggatggcactcggagtggggcaattttctggttttcttcattcacaaactcaaaagccatatcctcccaaagaggattggatacatatttatagctgcttgtagcagccatgcagccatgctagtctaagagggtgctgtcctagagcatcccaacaaactgtcctagagcatctcaacatactgtcctagagcatcccaacaaactg

SEQ ID NO: 48355 - DNA, 988 bp, Oryza sativa
ttaacttttactcctacataagaaaaaatgtatatgttagcaatgacatatatataagaaccaatttactatgcttgaaattacaatggtgttgtttcacttttcctggctgcagcagcagtgactgtcggctgtaaccattgaaaatggctgctaacggcaacaactctaagctactaaaacaaccatcactattgatcactaccaatatccatacctctcgccataacataatccgacttcattaaatttttcttatttcacctatataagataaacacaaatatatatatattcctacaccccatgtctaaagtctgatcttagatcattgcatcaatcttgatctcaccaacctccatgagagagaagagatcaaagccctcaatagtctttggtatcctaaccccattcatcatcacgtgcaattaaccaacccatccgcgccaaattacagaaaagcccctccatttctcaccttctcgcccaccctcccgtccatgtccatggtggtcgagcaccaccggcgcggccaccgcgagctcctcctccccctctaatggcgcagtacaggcagtcgggcggcttcttcgactaccgcggcggccaccaccacgcgctcccggacttagggcggccatgcaaccggtgacgcattgcacatccctaagtttgctggggggcgcatccgctctatagcccgtatcttctcagggttggcctcaatgcctcgggcagagaccaagaaccctagaagcttgcccgcaggtacaccgaacacacacttatcggggttagttttatgcgggcggagcggagactctcaaaagtttccgctagatctgagagtacatttcctggttgcgcgtctttacaaccaagtcatcgacataagcctcaacattacgtcctaattggttacccaaagaaattcgagtagtacgttaaaagtaggacctgcattctttaacccgaagggggctgcagg

SEQ ID NO: 48356 - DNA, 1689 bp, Oryza sativa
tgaatcaaaatttaaccaatgcttgttctaaatgtgtctaattggataaaccctattcgcaggtgtggacactgcaagaagctcgctccagaggtatgcttctgtacagttggatcacttccttaacagcacattttcacattttggattaaatggtttgatcccatgtattaattttctttgcttgatctgtttcagtatgagaaagctgcacaagagctaagcaagcacgatccaccgattgttcttgccaaggttgatgccaacgacgagaagaacaagcctcttgctaccaagtatgagatccagggtttcccgacactcaagatattcaggaaccagggcaagaacattcaggaatacaagggcccgagggaggctgagggcattgttgaatacttgaagaagcaggttggtcctgcttccaaggagatcaagtcaccagaagacgcaaccaaccttattgatgacaagaaaatctacattgtaagacctcgattcaatatgacacattctccaacttatattttctgttccgactgttcatgctttaaaattgactgctgacttgaatgagcaattgaaataggttggaatcttctcagaattaagtggcactgagtatacaaacttcatagaggttgctgagaagctgagatctgattatgactttggccacaccttgcatgccaaccaccttccacgcggtgatgctgcagttgagagaccattggttaggctattcaagccctttgatgagcttgttgttgacagcaaggtatataactcctcaaatatcaaacttcattgttttaactattcatttggccactatgtttcctacaacttgtcacagcctttattggctggcattattttggttaattgtcaataatgtgttgtttgcatatctcttcaggattttgatgttactgctttggagaagttcattgatgctagcagcacccctaaagttgttacttttgacaagaaccctgacaaccatccttaccttctgaaatttttccaaagctcagctgccaaggtaagcgcttggcattccttgctctctgaaaagctccattcttttaataacagctggcagtagttgattgatactgtatattaatagtcaatttaaatgtttatttctcgtgtttcaaatagactttgcttagactgtaatatctgatacccttctccattcatatatttgcaagttctcactattaaacgcagtgattcaaatattgttctttaatactccgtatatcattatgccagtaatttgcagttgttgatgactgacactaaacgttaccaaattatatgcaggctatgctatttttgaacttctccactggaccgtttgagtctttcaagtcagtttattatggtgctgctgaggagttcaaggacaaggaaattaagttcctcattggtgacattgaggccagtcaaggtgccttccaggtttgttacctcactttcttataatttttttcaaacaattattaatgtacttgatgctaactttaaatctgtcactgtacagtactttgggctgagggaggatcaggtaccactcatcatcatccaggatggtgagtccaagaaatttttgaaggcacacgttgagcctgaccaaattgtttcttggttgaaggaatactttgtaagtagtctttt

SEQ ID NO: 48357 - DNA, 1986 bp, Oryza sativa
  unsure (1)..(1986): unsure at all n locations
gttcttgagttctttcctggcttcgcatcacgatcagaatacaaaacttattgagtttggcatgcatgaaatctgtaatatttccatcaatgaagaacgcaataccttaagctttctaatttacctttgtttgcatcaaaaaatttcttttcagtgtaccatctctccttgagtcacgcttaattttttatttgctcctcatacgagttgtttggttaatttaggctcatgcccatttccaagtctctttcagcataatcctcatttagatctttcgttcccctaatttaaatgtatgtgcagggtttagggtcctatgattttacaaaaaaacataaataaataaatttgaagtataatatcattaccatatattacggcttagatatatagcactttatagctacacttcttgtgaaattaatgatgtcgtacacacacttatttacattgtaattatcattataaattcaaacttattactataaataacatgttaatatatctaaaagagaagaaggttatagtcgtacacacacagtcacacagacttgatggcgatgctggctctgccaccggccggtcacacccggcacacgggatgcaatgcaagacaaggtgatctgatccgctggttcgtacgtccatggtttttgcacgcatgaccgtgtgctagtgctagccgcttccagcaagtctcgtatgttgtttaaagcatctgactaagtatctctgacatgttaattataagtaatcgcaacataccaaacgggtctagatcacagccactctgcaatataatgttctatcctaatcatcatttgattcagaccccgtatcgatggatcgcaggctgctcagagccgcacgcggcggccaccgcgagtggctggaggctgtacttctgggggccgctccggcgccaaaccacgtcaccgtccacgtcgccgcggccggggagccacagccacccaccgcggcggcgctgctcctggacgtggcgcgacgccgcagggagactccgcgctgcacgtcgtggcggcctccggcgacagcgaagcgttctgagctgcgcgcgcaccatctaccgcagcgccatggccctcntggatcgcgccaacgcgaggggcgacacgccgctgcactgcgccgccagggcggggaacgcggcgatggtcaggtgcctcctcgacatggcgatggaggagnacgaggagcgcggcggcgcgaggttcagggtggccgacgtgctggagaagcagaacggccggcgtgagacggccctgcacgacgccgtcaggctcggcgacgagcgcctcgtcggccacctgatggccgtgcatccgcggctcgcccgtctccccggcggcgacgggatgtcgccgttgtaccaggcgatctcactggggcacgaccgcatcgcggagctcctgcatcagcaagggggcgacgagctctcgtattctggaccggccggccaaactgccctgcacgctgctgtcctacgcggcgcaggtacgtgcctacaagtgaagattgatttttttttcatttctcgatgggatatatttcttatatatcatctaaatagttattatttttcttaaaaaaattaacagcatatattaacatagattgatatgaactatgtcactcgtaatatcaaattggactcttacaactaataccaaaagaaacaaattcaacttaaatagttaacacacattcctggttatatttgtttctttataattttcaaaagttgatttttttatttacatatttgtaaagtaatatatttcatacttggctatcttattgttttttataactatttagggatgaaaacattttctccgcacgatcaatttagatcatatgaaagacccacacgtatacatcgacaaatacactctgatgaggcacgatcaaagaaacagaagcacatcgacaaatgcacctcttggcataagctgggctgcagga

SEQ ID NO: 48358 - DNA, 794 bp, Oryza sativa
taacgggaacaaaggctataagaactttccaaagaaacaacaaaaaactacaccatgacttagcttcatctctaacatcctgcatgacggaattgaaattagctgaaacctctccaaagacacatccacctatgtttccaaatcaaccaagccaccaacacaactaatgagttaaaacccttgcgatgttgcttagccactttctgcaaagcttaaagccaccacatggtgaaaacagtgtcatcgggaccttatctaaggtgctgcaagccaaccaaggacaaaactgagaaccatacacttcttgtgaacacacataaagtgagcaagtgctgcacattctcctcctcttgattacacaatggatattgccaagatggtcaacactgcgatgggccaatcggtcagcagtccaacaacgatttagcgaggctaaccacacaaaagaattgcaaagaggccaaagctcaagttttccaaacttccttccacggctcaaattacatgcccctgatgagtttttttttttgtgtgtgtgctctcattgctgatatcatcatggcaaaaagtgatgtcatacctaaactgcacctcaacaacaaatgacaccaactcatcaccaaaatcagtggcctccatgagattatagctcaactaaccaatcacaaactatcatcaattattgagttattctgctctccaaaccaacaaccgtacaacctaagattccaaattcctaataaatttggaagaaaaagactgaatatgcttttccaaaaaaatacaaaacatat

SEQ ID NO: 48359 - DNA, 4249 bp, Oryza sativa
cctgataacaaatcagacaaccaaatcgacaacgaaacgtggacaatggcgttcgatggtgcactcaacagccaaggagcaggggcaggattcatcttgacatctccttccggagaccaattcaagcacgcaatccacctcaacttcagagcgaccaataacacagccgaatatgaaggactactcgccgggataagagctgcagccgcacttggggtcaagcgactgatcgtgaaaggggactccgagctagtcgcgaaccaggtgcacaaagattataaatgctctaaccccgagttatccaagtatctcgcagaagtcaggaagctggagaaaaggttcgatgggatcgaggtccgacacgtatactgcaaggacaacatcgagccagatgacctagcatgatgtgcgtccagacgagaaccactcgagcctggcacttttctggacatcctgacaaagccatcagtgaaagaggttagcggcgaagtcagcccagccgcccccaacattagctcggaggccacagaggcagaacacgccgtcgccgatatcgagaccacagacgactggcgcaccccactgatcaaattcatcaacagcgaagagttgcccgaggacgacgcagaggccgagaaaataacccgtaaagcaaaaatctgctgcatgattggcaacgatctatacaagaaagcgccaaacggggtacttctcaaatgcgtctcgtccgacgacggcagacacctcctccttgatatacatgaaggcatctgtgggtcacacgccgctggtcggacattggtcgggaaagcatttcggcaagggtttttctggccaaccgccatcaaagatgcatgcgacatggtccagcggtgtgaagcctgtcaattccacagtaaacacacaaagctacccgcgcaagcgctctagactatccctcttacttggccgttctcgtgctgggggctagatatactcgggccattcccacgaggacagggcggctacaggttcctattcgtggcgatcgacaaattcactaaatggatcgaagcagtacccacgggggaaatcaaggccgacaacgccatcaaattcatcaaggggatattttgcagatacggactaccgcaccgcatcataactgacaacggctcccagttcatcagcgccgatttccatgattactgcatcggactgggagtctagatatgcttcgcctcggtctctcaccctcaaagcaacggacaagtcgagagggcaaacgacatagtactacaagggatcaagacccgcgtctacgacagattcatgtcacatgacaaaaaatgggtcgaagaactcccatcagtactatgggccgtacgcaccacaccgacaacgtctaacaaggaacacccttcttcctcatgtacggctccgaggccatgctccccagcgagctacgacatcagagtacacgagtacagaagtattccgacgaggatcaggaggaatagcgaaacgtcgatgtgaatctactcgaggaacatcgcgaacgagttgccgtccgagtagccagttaccaacaggctctccgccgctaccacgaggagcgcatccgagcacgcatactttcaatcggcgactatgtcctccgacgggttcaatgccaagtagggcgaaacaagctctcacccaaatgggaaggaccttacacgatcacacaagttttgcggccaggcgcattaaaaattgcagacggtgatggtcgcgagttggcaaactcttggaatattgaccaactacgtaaattctatgtatgagtcaatgtcatccacacctgtaagacaccttacagtatcaatggagcctatttttaggcgcatattacaatcaaagtgttcctacccgatgatcccttacccagatgtgttgacagaaaacacgaggcctgggagatctgcttaactccagtgtaggtccaaagctcgccttctggtgtactagcgtgccagttgatttgatcccgtaatcaacaagaaataaaggcaaagaaaccgtggttaaatctataaatgatagccgatcggctaggtgccgatgacataacatttatctttgagccgatgtcatatgtgaatcgatcggcagttgtaaatagacaataaagaactaaatctattcgatcggctgtagatatttccaatatatagttcttatatcgatatatacttaaatcgagtgattgggatagatcggtcgccatgccgagacagtataaatcacttagatcgaaatatatattaataacagggctatatatgtttatagcatagccgatcagatagatctagcatgtatcggctaatactccaatactactctatatcaggatattaaaacagacataatatattaaacaaaggactaatatacttagatacagcaatatcttgacataaaggacagatttaatatgtcaatgaagcatatagagcaaatatagttagatcagataagatcggctgaaactccgatgctaccctaattggcaaccagaaggcatgttagagattgatattctaagcacgacttaatagatcaaactcgactgatgcaacattaagtatgaaaagaagaacaatatctagacaatcaagtcgctggaagtttcatagagtggtggataccttatataatctaagtcaacatcgatatctaacctaatcggctaccctctacagacagatgttagccgattgtagattagatagcggtattgccggagattatgtaagatatatgataactcgatgaattacataaacgagatcagagtgtcataaagatggaagcactaatcccgagaatacaagccgtcataacaagttttacctctcgttgaagatcgaaaccgatgcagctcaacctgaaagcaagaactcatcgaaacaaaactaaagcaaaagggtggcgatgcgccgaaattgtattgaacgtgtgtgtgtgttaaaagttacatagggctcgggtctatttatacccgagaatcacaagatatgtccataacagacacgactactatcttatcaaactctaggataccacaagtctttgcggcagacttttgcccaatcgtatctctaaggagattacataaaacaccctaattaatagatacaattgacttctcaggactctatccatgtgcggcaatcaccttgaagcacctcaatccaacccgatatcatacatcaagctgcattgtcggaatcggctgtatcggcttacctagtccgactcagacctagccgatgccaatcgcatccgatttggactccagccgattcctgctttgtttccgaactcaatctctgcctccgactttgcttcgatctaatcttctttcctgatgccgatgttaccaaatttggttgttaacaagatgacacctagcgttgaaacctatccccatgtccctttacgtcatcttgagaaggcctccgatgaacctaagggatcttctactggggacgcccagagccgataaggccttgtcagatcctgtagagacgaaagaccatgtaagacctggtcgtgtaagagttctcgccgtgcgtattaaccaagccgcgtaatcggaaattcactttccaacttcacggctgggggctaggatcagtgcttattcaaccaaggcaggtcaaaggtccaagaggcttatcctccgagaaaaatcctccgatgacaaggctgggggctagagagagtgtacgactcaaacgactaactaaagtcgtgaactgagaacacacccttacacacgatatccagagtaagaaggatttgttaagatagatttcttttctatttcacaaaataccccttacaattttacacaagttcaaagctatattacacttttccctaagatatccatcacagggtacaaagactaccaagaaggccaactccagtccatagactagaagaccttctccgccaacggcgccatcgactttgccaggtggtctatctccgccgtagttctccgagaacgagcaaaaccttcatggagaaactcgaggtcctgtcgcggacgatgatctcgtaggcaagccaacacgtgccctccggcatatcggctcgatcgacgacattcctgcttcaaggcttcgtcaatgcgtttgccgacgccttcgagctgagtacaggccccattcagccacgagatgtatccggccgccgactcctcaggatctccacg

SEQ ID NO: 48360 - DNA, 1859 bp, Oryza sativa
tttggctatgcatacggagctagacgtggtgttggcgatatcctgcagatctggtgaaggtacaaagactaccaagaagcccaactccagtccatagactagaagaccttctccgccaacggcgccatcgactttgccaggtggtctatctccgccgtagttctccgagaacgagcaaaaccttcatggagaaactcgaggtcctgtcgcggacgatgatctcgtaggcaagccaacacgtgccctccggcatatcggctcgatcgacgacattcctgcttcaaggcttcgtcaatgcgtttgccgacgccttcgagctgagtacaggccccattcagccacgagatgtatccggccgccgactcctcaggatctccacggggtactcggagctctctacaaaccttggccatggacgtgcagcaactcttcaagtacaagttgaaccatacctcacaacctcagagcgtttccacagcttgctctttctttacttccagcatagttctctcgagctccgctacttcaaatttcatcttccaatattggatacgacgatcttggccagcaagcgcactctcgagatctgttcaatatggaaacgactaagtcaagctgcactcctctttcgagaacacggttgatcaagtcggaggagcaaaaagggatgaagagaccactaacctaaggaagtcatcgccatccccattctcgcgggtaaaatctgatctacatcgtccggcgacgcgtgtggctcaaacgcaagagccggaatgatcgctggcgactcaggctgcccaccctgctggacatcctcgacttcaacatctctacagggaacaaaaaagtactcaagatcaaaatgctaaagcaactaaggtgatgactgcacgcacaaaggcggttggagccaattggagttttatacagcatgtcgaaggagtacaagagagtcaaaatcctactcttcaaaaagggggagaacagactcccccagatcaccgacttcttccatcacatccttatgcgcgtcgctagccgccccctattccaagatctcccgcagatcgagttcagggtgcgccagcctcacacacgcaaggacgtggcatgccccggtgtagttcccgttggacgtctcctctccgatcctggccgcatgcttggagggaatctcctccatcgccgccgccagctccgcaagagaagacgtcagcgagaactcattgggattcgcggggatggtagacttgataccgcattccccggcgagctggtgcagaccagtataggtgacccgcaacgagccacggatttccgataagttgttctcgagctccgacatacggtgctcgagcccctgccgttgtcgctcattcccggccaccagtttcctcatcttcttgaggtcctcacgagcctccgccaagtcgtgtgccagccggtcggcgcgctcgttcgccgacgacgacgccgccgccgctctcacctccatgatctcgcggccaatgccgcgagcaccagcctcgaggaggcgccacatctcaacctggagctcctcccaggtgaggacggcagccggcgaaccatgaccagccacgagatcgctggctgggccgcttggtgtcgcctcgtggctcccgggcacgaccacgacatccgtcgaggctacagcaggagacgcgctggaagtccctccagacccgtcctgcgccgccttcgcccgcgccgccctacaagaaggctgtggttcagacaaagttcgacgaaatcacgaaacctcaaattcattcactcacttctcgccgagtgtcacaagccgctgccgtcgtggaggcaggggagacgcgtccaaggct

SEQ ID NO: 48361 - DNA, 1394 bp, Oryza sativa
ccgcaacgcggcaaagccacggtctccacaacgcggccacggcgttctcccgcatgccgcacgccctcaagttgtcagagagctattaggccatttacaatgcaaagacgtggagttcagcttccacatgctagctcggagattcctctccacctaggcacttttcactccctcactaggaacggggagccaaagtaagcattagaataactaacagccacgattcatcaccgttattagatcagcataaaccaaacaaaacaagcagatgtgatgcgaccgaggcagctttattcaacttgtccagaaccacttctctaccgactatcacttttgcatgggtaaaattaactaggtaccacgggttgattgtacagtatttctcaatgggacagacatgccgaaacatcaactatttcccccactctcactactctccatctcaccgtctttcagaaccttggcaaaatctggcgttggagctgtcaaacatgttagccgtcaggtcccgtctcctccatgtctacagccacaagcatccatgccctctcctactcactgcacatcaataacagtttaagaatagtaatattgtggtgaaaaggatgctcactgctcaggcgatcagtgtacaaaccttgtttagagctcatccttgagaggctcggctggggccgactctgccttctccttcgcctgaccagcggtttccttgttcttcttaatgaagtcgacgatctcgtcggctgtcctgccgctttcatagggaaccatctttccactgggggtgacgaagtacagggtggggtaaccttgcacatcgaactcgcttggcacatcgttcgcagttgcatcctgcatacaaggtagcaaaatagtagttagatgaactgtacttgtgataggaaagaatggatgaataatgcactcaaaactaatggcaccacccagatagaaaggaaattaccatcttagcgatgacaacatccttgtcgcttttaagcgtcgtagctgcctcatccaagattggagccagcttcttgcagtgtccgcaccatggtgcatagaattcaacaaggactgaaacagaaaacagcaaataaatgagagctgcaaatcaaatagaggctttgccagcactgataattgaagaagctacaaaaaaatagcaaacttgcttttgaccagggaggaatcagtcgctcacaatactaatataagaactaaaaatcatctcactgaaaagattacgggggacaacagtatgtaccgtttttgccagacttgaagacaaaatcatggacgttatcagcgaccacaaccttaacaggctcgtcgttgacctcaggaataggttcagacttcctgaatggagacaatttaccatcctaaaa

SEQ ID NO: 48362 - DNA, 1396 bp, Oryza sativa
atgcatgaagtataaattatagataaaaagaaaaactaattacccagttatgaaggaaatcacgagacgaatcttttaagcctaattagtccgtgattagctataagtgctacagtaactcacatatgctaatgacggtttaattagtcttaaaagattcgtctcgcggtttccaggcaagttctgaaattagttttttcattcgtgtccgaaaacccctttcgacatccggtcaaacgttcgatgtgacacccaaaaattttcttttcccaactaaacacaccctaactcccctcgtctagccataatctgccccaccaataccgtcaatctggccccgccagctagccggaaggcgcgaatgatgtcaacgaggcctcctaactagagatggcaatgggtgcataccatcgggttctcttagcttgccccatactcacacccgtgatgtttaaatattctcacttaaatatccatatccatcgtggatacaaaatcgtccctatacccacacccgtgtgggtaacgggtatagatacccatacccatataattgacttgcagcatttataattttgtactataattagccatattagagttgtaaaccatcaatattttctttagcaacaatactattaattaacattagcgttcaaaggtgaggaaaaaaaattatacaaccacattacataatcaagaaatcaaataacaatttcatataactagactagaacaatacttaagatgtgaaatgagttttatgctatgatttagtagtcatcgatacttatattgctcatagtttgactcaatcaacggttttttttcacccacaggttggtgggtacgggtgggtaaagaacggacccatagccatgtacccaatagataagagttttcgcccgttagtagacccatgtgtataagagttagaacaattagcttctaatagagtaaaaacctgtcgggtctcgggttatgggtctctattgccatctctactcctagccgacctccaccctttcccgcatctcctccttaagcaggcggcggtatggtgcccttgccccgctgattttcctatctctgcggctgcccgctttcggattcaccgtcatcctaactagtcgatatagttgggtcgtttgcccctaccactagcacgggaccactgtccaccttgtggctctgatgctactaagggtgtgttcggcacccccccttcccaatcccatctccctcgttttccacgcgcacgcttttaaaactgctaaacggtgtgttttttttaaaaaagtttctatacaaaagttgcttaaaaaaatcaaattaattcatttttgaaaaaaaaaatacttccaccgtttcataatgtaaatcattttattattgt

SEQ ID NO: 48363 - DNA, 1504 bp, Oryza sativa
tgctcggaggagtggctgttggtgctggggcgcgtggggttgcggctgtggtggtgtcgcaagctcgtccaactcgaaccgcggcccgagggtgtgttggtgtcggagtcgatggaggctcggggactggggtagacacgcttggtgaagaagagctgcctactcccccagctctctcgaagtggacatactcgacggtgaagtcgtcgtacgtcagagtcgaaccatcgtccaccgtcttgtcccatacccaccctcgcccttagtcgaacactacgtcgtgcgctgtgcgcacacgctgtgtctccgggtcgaggatgcgataggccttcgagccctccgcgtagccgatgacacccctggggtgctcctgtcatcgagcttgctgatggggccaagctccttgacgaacgcgaggcagccgaagacccgcaggtgggagacccctggcttgcgcccatgccaagcctcgtacggtgtcctgccatcgagggccttggtaggcgagcggttgaggatgtagacggccgtcaccaccgcctctccccagaagatggccggcatccccctctgcttgaggagagcccgagccatccccacaaccgtttggttgcgccgctcgacgacgccgatctgctgcgggctgtacggcacggtgtactggcgctgaatgccttcatcagcgcagtacgacgcgaattcagccgccgtgaattcgccgccgttgtcggtgcgcagtacgcgtagcttgcggccgcactccgcctctgcagcagcctgcgcgcgccggatggtgtccgcagcctctcccttgctgccgaggaccatcacccacatgtagcgggagaggtcgtcgacgagcagcaggaagtaacgtcgtcctcctggtgtggccggtgtcactgggccacacaagtccccgtgcatgagctcgagccgctccttggctcggaaactcgtctgctggggaaaggggagccgcctctgcttcgttaggacgcagacgtcgcagagctgctccacgtggtcaaggcacggcaggcctcgcaccatctccttggcgctgagccgcttcagggcctcaaagtgaaggtgcccgaaacgctcgtgccactgccacgcctcgccgtctcgacgagcggcgaggcaaactggttgtgcgacctgcgcgctgaggatgtagagtcgattagtgcctctggttaccttggcaagaaggcgacggcggcgatcccaaatcctcatgactccgtgctcgaccaacacgcttgagccgttctcatccagctgtcccacgctgatgatagagtttctcaacgcggggatgtagtagactccggtgagcagcctgtgctcaccggacttggtggtgaggtgacggagccgacgcccttgatctccacgccggaggcatccccaaacttgacggagcctcggacgctggagtcaagctcggtgaagaactcccgccggccagtcatatgatgggtggcgccggtgtcga

SEQ ID NO: 48364 - DNA, 3401 bp, Oryza sativa
cggtaacccgattggaggaaagaaaatcgggcgcaactaagctactatatggctgccatattagtatactactttgctttttcaccactttatccatatatgtatacatgtggctatcttcaaaatttttttcctcctaaattacttatcggattttcgatccgatcgtactattatatttgttacaattaattttttttataataagagatcacatgattattttgctaaaatataatcatatgtttataaccgttaatactaaatgtttcatacgtaatgcgacatgtttcaacatatatttttaatgtattacacatgaaaaataaatatttcaatgtcttttttttcaccttgtatagcatgacgtttcagatgtggctggtaaagtatcggacataactacccctactctctcttctaccatatacttgctctctcttcattccattcatgcatataggcttgtagcaatctttgaaatatttttcaactaaattacttatccaatatataatccaaacataatataatattcattataattaaatctttataacaagatatcgcatgattatattttaataaaaaatatgtttcaaaccaataaaacacattgtttcatacgtaatagcgacctatttcaacatgtgttcttactatgcttcacaaattcttaaatgtttcaccatgtactactcaacatttcagtcatcggtcaattgaaacgttagaccgtctgattttttttttttaggaaatcagacgctcgatttgtagagggcttgaattttaggtgactggaaatttgtattttcaagagcttaaaatctagcaatacatttgaaaaggacacgactacatagtgcacattattggaagtaactacacttctaaaggagttaagaaaataaataaataatttaaatatactcaatattagactcattttatcacatattttgagcaaaatggatcttaaaagtaatataaggtctaaaaatatataggtcatcaaagattctataaaaaaacattatactagtgtaatgacatgttagcctcagtagcatgcacgtgaatcgacatgataactagcagatagtatgttgtcctcttttcctgtcaagtggtctcatttctttgactcttcgtcaatataatatttacgtgtccgtgtctcagtcaacatcaattgattgatcaatataacaactttcaatgcttagatagttacctctattgcagagctaagttactctacgattttactaaattacttttgaaattaagtaaattactttaaatgtttgaatatattaaatattaaatttgttttatcgtatattttgagtagagcacgatggtacaaacaaaaatgaaaataatatatgatttaaaatatataagtcatcattagaaaaagaatagactcgtgtaaccaatatttagtttcgatggttggtggtgtatagcgatacctgacgccacgaaggttcctcgctttgatgccattgcaatggaagcaagcctatctctccgacaacatgaagacgcggatggatggctggcggagcgtcgtgccataagacaaaatcaagaatgctctccatttagatttcccacttaaagaaatatccaaacgtaacttgtgcaatgtacgggttagagactagtagtaaattaactgctcctgtaattaattttaacatcatatcatctcatagagagcacggtagcagtagtaccttaatactacatccgtcccaaaataagtgcagccatggatattcgtgtctaacgtttgaccgttcgtcttatttaaaaaatttatgaaaaaattaaaaatatttagtcacatataaagtactattcatattttatcatctaatagcaataaaaatactaatcataaaaaattttgaaataagacgaacgatcaaacattgaatgtgaatagtataaaactgcacttattttgggacggagggagtaatagtttttctcacgcttttctccataaattgaagaaatgacagaaaagataatgcaatggaacgccgggctctccggcgaagccgacgcgtccggcagcacagcgctccacttcgccgcctcggcggacggaccaaagatcgacatcgagaacagctcactcctccggtggctcctcttgccgtgcccgttccaatgccgccggacaccaaccgaacttctcctggagaccgacccgtccttggcctgccagccggacggcgacggcgactaccccatccacgtcgccgcgtccgccggcaacctgaggctcgtcgccctcttgctcgacaagtgccccgagtgcgccggcctccgcgacgcccgcgggaggaccttcctccacgtcgccgtcgaccggaggaggcaggaggtcgtgggattcgcctccgacgtcgatggacggggtttccggcggcggcgatcctcaacgcgcgggacgacgacggcaacaccgcgctgcacctggcggtcgtggccggggtgctgagagtgttctggtgcttgtttcggaatcgcagggtttgcttggatcttgccaacaacgacggcctcacaccggctgacctggccaggagtaccattccagcgggtctttactccaacagaacggtacatcacttttacctcactagggcatgtacaaaaatagtgtccgatatggtcttttaagtaagacatattatttaaagaatatactgttacaatagttgagacaacaagaactcttaatcattaacgtaccaaaatatttttttactacccttcttttcttttctccaccctcatacaacaaaattttctttaataaaagttaagagttgactcttacctgttgtcatgtatagcaaccatgctttttttttctctcctctctctcttccacgttatcaaatttacttacatggcaataaagagagaccgctattatacacgtttgtacgtgcccttagatcaggccctttttaataatgtttttcttttaaaaataaattcacaacaattaaactattttatatcaaatcatgtaaatctgcattttgaaaaaaaaatagtacgaatatacttgtagtattgtatttttgttagaaacatggaacgaacataggcacccatagcacgcgcacacactatttttgtgagcatcttcaggactgagtcggtatatcttgagattgatgaagtcctctctattgatggaaacgccacctaccactaaaaaaataaaagcggtaaatacgagcccctttatcaaatctagaatttaaactagttcttagaaaaccacaccgtcaactaacttaactattaatattatagcacaataaaatataattaactttgatggataaacgaagggctgcagg

SEQ ID NO: 48365 - DNA, 853 bp, Oryza sativa
ctatagctgttgttcttttgtcagacgtagtgcagtgacatggctttcaacttttcagtttgtgaagcacctttctgttactgcacttttccagtcctttggacattacaattgtacgaggacaaacctgaaaaagaaaaggaaaaggagatatgagaataatgcttattctcaatataaaaagcaagtcatatatagctggtacaaaggcatatgattcatgtgaagtcgttggggaagagaacaaaagatgaatcatccctgtgttcgtctgaattgtatatgtggtttgcacataaatatgtcgtcatttcttgtaccgaaaacaattggacaaggcgacctgactaaaagtttttttgaaaacatgaattgaagctagaagaggacaatagaatgatttcacatgtcttgaaagtgtttaagtgatacttcgtattttctctagtctctactgttgtaaaagtgcaatcgtcttttttccatcccctccttctactgcgcgcgcaatgtgtacatccgattttttttcacatcatatgcctaacctcttagctcatccctaatcgaatggacctgcacgttgtaaggtttgaagaactacgtacaagtcaggattggtttgaagaagttgttttctccaagtaagaagtacacacaaggttcttccatagaagcaacgtccgtgcaaagattgacttaccatgtgcaagatcaactctgtgcaacaattctttctgaaagcaattgctacaatcctttttcttccatttcacacgcatcatgcttcatgccatgtactccctcgtcccaaaatataaaaacctagaactggatgggacgtgctgtccaa

SEQ ID NO: 48366 - DNA, 719 bp, Oryza sativa
caatctgatctatgtgaggcagggggtaggaatccttaggacatgccttgttaaggtcggtgtagtcgatgcacatccgaagcttgccgtcgccttgggaacgaccaccgggttcgccagccactccggatggatgacctcacggatgaatccggcttccagaagtcgcgccacctcctcgcggatgaaggcttgacgttccagggcctgccgccgcactttctgccggaccggccttgcgcccggccgcacggtgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgttgcctcggggtggcgggggcggaagcgccaagcctctcgtcgccaccctcgggcttggatgcagcggcgaggtggtccgcgcgctgctccagacaagcgagcgcgactttgaggtcgccatggacagagatggggccaccggggcccggcatcttcatctgtaggtaggcgtagtgaccgccgccatgaacttcaccaacgcgggcctccccaggaccgcgttgtagggcagactgaggtccgccacatcgaagttcacccg

SEQ ID NO: 48367 - DNA, 5634 bp, Oryza sativa
aacttatgcccaaatatttgtttataatttcaaataaatattttaagaattattggtggtagaaattttaaaagtttcaccatcaattaatcatacactttaagtaggagggagtaatattttttcattgcttagttttctttgccgagttggctgaaaataatcgactagtttttgctatatataaaggagaggagagcaacttgcgagccttttttttctcttctgaatagcagaatgattttacaatcactattcaacgtacgtacgttatagacaaacaaattaactgttataaagttaaaggaaatatgttttaaatacattcatatataatttaatttaaaaaaaaactagataaaggtccgtgcgttgcaaagaatattaaaagagataaaataaaaaataattagaagtttttagcatagttagttcattaagcatatcatatgatgccatatccaaagaaaaacatttacgtgtaaggaccatatgatttcgcatgttattttgtggcgttagagacggcatcatttaaaatttaaagtagtatagaaaatcgccccatgaatttatggagtatatataggagcttgaaagtgtgtcggaagtcggatctatcaattcttccttccaaattagaacagacccgtacgtataaaacaacattgttgttagttggcaccccccgttagaacacaaaacaccaaataagttcgttcgtcaatttacatgcctgaatttcagaggttgttgacacgagcgaacgtaagtaacacgcacaaaagactttaattagcgcatgacttcgaacacgcacgtgcggtctcgatcacaactcgcacgggcccacgtgcatgcacacatatagggtgtatttagttggggaaaaagaaatttttgggtgtcacatcgaacgttaatttcagaactaattttagaatgaaaaaactaatttcagaactcgcttggaaaccgcgagacgaatcttttgagactaattaagccgtcattagcacatgtgggttactgtagcacttatggctaatcatggactaattaggcttgaaagattcatcttgcgatttcctccataactatgcaattagtttttctttttatctatatttaatgctttatacatgtgtccaaatattcaatgtgatgtttttggaaaaaaaatttggaactaaacgggcccatagtctcgcgcgcgcgcacacacgaacacacttagtacacgaagtagtagcttgtatgcttacgccgactaagctgctgatgtcataattaggtttgcaaatggcaatgacgtcaggatgacatgtcacatgtcgcttgtgggcatatgcatgcgagtgtgggcggaatataatgcttgtccaactagagcccttccagaaggctacaatttcaggactaattctataaaaaatgatgaaagaaattactaatatatttagggtttgtttagattgatgccattttaaactataccattttaatagagttgttaaatatatgcatccatttagtttcttgccaaactttggtaaatacataagaaatcttatcaaacttttgacaatgccaaaatttgataaggtttattttggctacaatctgaacagcctcttggtgtgaaatttatgtgaaatttcgctgtgctgttaagggtgtagtagtggttgttaagttagtagaggagctttctacctggataagtactgctccctccgtttcgaaatgtttgacgccgttgactttttagcacatgtttgaccattcgtcttattaaaaaaatttaagttattattaattcttttcctatcattttattcagtgttaaatatatttttatgtaggcatatcattttacatgtttcacgaaagtttttgaataagacgaacggttaaatatatgctaaaaagtcaacggtgtcaaacatttcgaaacggagggagtatgtcgggtcctaatcgtgtgggatatgtatgatagaaggccgttgaaaaatgatcgataaaaaattaagaactaatttataggtaaaacttttgtatttactcatgatttaaaatccaatagtagtagcttttaaattttaaattttggttgtgcaggctgataaaatatcaagaaaacgacgagggacgtttttttgcacatgatgggtgtagacaaaaaattgtgaagcggagataataactacagaaaattcgagattttagcattattattgatttattgtgtggctcaaatgggagattagaccggagaaacaatgcatgccatggtcaagattgagcagagtccatggtctatatgcatttgttttttgaactgtggtctatgcatatatacatccaaagactactaaacttgtgttacacggttttgaacttggacaagtatatacaagcatgctaatagccagctagtgcttctagtgtccaagacacagagtttcgtcaccgtggagtttaattaggtctaaatttaggtcttcatggaacattccgttaaaggtgccttctttagaccaccttggttaaactaattttacaaattattacaatggctaaactgattaatctaatgttatatattttatctctttgagaaaactaaaattggaccgcattgcaagctaactagacgttttttttttgcaagctttctctattaattcaaaatatgtaggtcagtggcggatcgagaaaatcgatttattgatgtcataatatgtctattggtgttatagtatgctaattatatttagatcatgatgttatattatatggataagcagtttcgctataggttttaccgaaatttgtcggtgtcgcctgacactagatccgtccctaatgtaggtctcaaagcattctccgcttttcgtttttttccctaaaaagaacttattttgtactgtacgtggtttctttgcacttaattttaattcttttgttcatgttctattttccaataatcgcacccctaaatgtccatttttctctttgatttgatgatgactaaaatgtcttcacgtacgacttctactctcgtctttgatccatagctagtacacaaaggggacaagaagaagttgaataatccctttttgataagatgggtgaaaagttaagctgacgttgttgggttaggcgtgacagataaatgccaaacagagccgctcatttcgtaaagatatactacttgacttgaaatcacaagtacacaccaaggacaaagctagatggttagtgagatcagcagtcgagagaaaagacaacttcataagtgatattggaagataagtagtttgaaatctgaacctctgaacatggcatgaaacttcagaacagtttcgtgttgtcttcaagcttgcaaagactattcaaagttttcttaaatgagaaaaatatattctggccttctggggttcatgagatcgaacggtaggcacggcacaggtgtgtatcatcatgcgaagatgatttgattatttgattgttaatcacgcttaccaagtgttcctgccattcagattctgttggaaaaagcagaactacttctcacaactttctgttctgaacatcagaacatggacaactcatgctagagaacatttgatggagttgcaggggctggagctttcagttgaacttgtctctataaaatggcagttgaatggggctgaaatattgcaactgaaacagatgattttgctgtgaaggtaaaggagtttaggaaactgaatttcatcttgtcagtgacagtttaaggagttcagtttgctccaacatcttacctttggagcctcaaccgatagtggctgcaaatatgtggagatttaggccgcgttctaaactgggtttcagctgtactaattcatcgtttaaagtgagcaccctttccaaactgataaacaatatgttttgtggtaaaactttatatagataagtttctctaaaaaatcaaatgaatccatttttaaagtttacaatagataatacttcctccgtttcaggttataagactttctaaacatctatataaatgtggacaatgctagaaagtcttataatctgaaacggagggagtacttaattaatgctaatggcttatattattttttctgcggctaactagctatcctaaccgctatatagagcgcacccttacttggctagacatcgcatccaaaatctttggcagaacgagaaaagatttggttctctgtagtatctcatgttcacttgccaaacaaggatagtgcagagcagtgatttttaacttctgttcttctaactttctctgaagaaccttgcttggaagctgaatgtgtaagtaggatgggaccaaatcttcagcagttaataagtttcagttaagcaattgattactagttgtgaaatcttgaggacactcttgccaataggtagaatgttagcttggaattggatggagcaacgcttcactgatgaaacctggttctcctcatgcaattctcagcattcagtagtaatcatcaatcaagctgctaaacagaatagccatggcagttactacctcagtcctaaaatatataaaaatctataatcaaatgagacattttctagtatcagattcgtattactaaaaaaaatattccatccgatactaagttcttatatattttggaacggagagagtaagtcggaatgcatcaaacggatcccaatgaaattgatccgaatctacgagagcgcaagcgaatattactacagaatatcaggggttacatgcaaaaagttcttcttcccattcccctgaaactgaaaaagatttggcacgaatcgaaccctccaatccattgcttgcccttttttgtgtcctccagcttctagaaacttctagaacccaagtaagtccaagccgccgccgccgccgcctacagttgcttgcaagccgcattggcccaggtaacacgcccgcgatgtgctggtcattctggtgttgataggaattcacagttttgatctctctgctccattctgtagcctccaggtttggcgctcaccacctgttcgacgaaatgcggcaagagggagcagatgtgcgcggcagccacaagatcaagaagacgactgctgatgtggaaggcgggggtgaatggatcaacgccctcccggaagaggtcctgcagcacgtgatgtcgttcctgccggcgaagcaggccgtccggacatgcgtcctcgcccggcgctggcgccacctgtggaaatccatgcctgctctgcgttccatccatggtatctgaacaagcacgatgtcaggaacctgaacaggtttatgaattgtttgattcgctaccgggaccgcagaatgccactagatatgtgcgagatcaaaatcggtgcttttggggagggctgtggtgaaccacaggttgactcacttatcagatatgcctctgttgcgcaaagctcggataatgaaggtcgaattgcatgagcacaacgataactttttctcatagccaagttgcctgttatctcccagcgcttgacgtaggttagagattagtaatgtgccattattatgtggttttgttgattctttgagcttcccagcatggaggccctatg

SEQ ID NO: 48368 - DNA, 2751 bp, Oryza sativa
  unsure (1)..(2751): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctaggatttgaactccgggaacaacttcgtgaacttcatcattggtgatctcccttcatcctccttttagctttgcttaattgtgccgctatagatctagtcgctatttgtgctttactcttgtttgtgtgatagatctacttgttgtgcttcattggtggatcagacagtctgatccaacatcagactatctgatattttcggatagtctgactgtggatcagactttccgaccttatatcagttttagcttccgcataaagttttaaattagcctctaggccgaattgaccctttcaggtagatgcatatgcgcacgagtgaatttaacatgttgtgcggcaagcaaataatatggctccgatgtggctgggtgaaataatatcatgatatctataaggacccaaggcttggcactagatggtacctaagtgaggacaaaaggatatatatacacaatatgttttttaaaaaataaatctaagtagaatcatagtcacgtaaggatggaccatgtagcatatatggaggaagagatgtggcaatgttgtagctaactagtactccactcaatagcggtcttctttgccagcaaagagataggtgtgaacccccttactcatgtgctgagtaggatatgagcaggaggaaagtacgtgaatgtcatgacgggaggggcaagggacattgagcatcaagtgccaacatgttgagtaggaggagcagagatcatgatgggagcaagcagcgagaaagcaagtgacatggaggttggtaggagagaaaatgatgaggaaagggggagatttggggtttgtggctatgatagaagtcaggagtgagatgacaaaggtgagcaattttgttgatatataggctaggatgagaaatgtgggtaatttcaacaatgtataaagtggagttcaccatcatcattatgtccttttaaagtagtaaagatgtttcgtgtctatagtcatcaaattttattagtgcctattacacattaaactcgtcacaccacctcacacacttccatacccaaggtgacctcacgtagcattccgctgtaggaataatgtgtgcacttgtaaactttgataatgaattaggggtgaaaacagatcggaatagcggttataccatatcaccaaaatttaaagcaaactcaaagcaggcggtgctgcggggagtagaagatggggacgaccagaggaggcgtcaacgttgagagccacaggcaatgacgcgtcgtacccgcattcctgcttcgccgcttgtgtgcgcatgggagtgtgacggcaaacctgcctagcagcttgcattggttcgtcctgtgtgtgagagagataggttattaggtcaactaatagatggtctgtcttatgtgaaatgggtcaaatagagtggttccatgagatgagaaagtcgggttatctaccaaaccctccaccagatctgcaggatatcgccaacaccacgtctagctccgtatccatagccaaattcgtatccgccgaatatctataaacccttactatatcctcacttcggacggatttggagtggagtggattagatattatccgattcactttcacccctataacgaagcaacttttctggtaattgaaatctaggggctagatatgcaaccttatttttatttaccataacctttattatgaacaaacaaaccaacaaaaaattatccaaaatgttgccaaacacacctatataagggcatgagtgtagcaacaagctagccaacaaatgctaaataatgaccttatacccatgtaaattgtggtttttgtttgttgcctttggtgttaccagtgaaagacggtgatgagttgtgtggactatgggaaaaatcaaagtgaggctgggaaaacatgggagcaacaccgccgtcatttcgcaacagaagtcaatatagattgtggcggtgttgtatggtgaatatttgtactaaaaataagaccatcggcaatatagattaatgtatattggcaatacaatacctctgcttttttaatatagggtgtgtttgaattttattttatcaaactttgatcaacacaattacttagctagtgaaaagagtgcaacttgagctataaccaaagctactttaaacatacttaatatatttgtctatttatataaatatttttagaaaatgaataatcaaacatatttcaaagactagaaaaaatgtctgtgcgttgcaacgagtgaaggctattttaatcttattattgttcaatgtaaaatttattgtgagaattcgcttggatatatattttctagaaaattatgacaagttagcatgcgagtttttttaaagagatttcttatatgagcctttctgtattttcaaaaacgaataaagttaaaactcaactcaaatacggatctgtatttctaaaagcgaacgaatttaa

SEQ ID NO: 48369 - DNA, 4948 bp, Oryza sativa
  unsure (1)..(4948): unsure at all n locations
accaaataaccggcaaaaacatcttcattttttataatagtaaagatttagttcatgttttgagaaaacgaaggtagtacattttattaatctacattcaggaacgaatgaatctaaaccccgaatcatggctgattcgcaggacgaaagaccatggtgcatggcttatggttcacccctgcctatattgccaaacgtgattatgatgggtgatggcattaaagctactgtctctattttaaaatatatgggattttactcatgtagttatacacgaataaaatcgtttaaattttaggactttcaccaggttgctgcctgtttgacacgtacggctacccagagcctggaaaaacccggtcgtccgggcagtgagttagtttcgacgtaatgggcctagagtgaaagcaaaatggacgatccacacaggcctagggccattagcaaatacaacgccaattattcgtggatggatgaaaattgaggcccatcaaaacacgtgggatggcctggaatggaataagttcactttaggtctcttaatttgttgccggtctgattttcgtcctcggtcgaaaaaaccggatataatgtatcgcccaacttataaaaccagtgcaaacgagatccctcagcagtattgaccccgattctggctaacgtggtgcttacgtggaccttttaactatgtcttcgtcctacgtagcattgacgtagcaatctgatatggaaaaaataaaattgaaaaattaaaaattacaacaaaatatgtggggccatatgtcagtcaaacaagaagataaacatagtgggacccacatgtcaatgggtcccactacctccacctcacccccctctctctatctccctccccctcgctcctaatgggnnggtcaacagcgagtcggcgacctgcatatgcatagcggcnnagcgtcggaggtgccctagcgaggcagcgaggagnggagctgcagtgtccagcatgtggagaagaggatgtaggcgagggagcccggtgagctcgagctcgccatcccggctcaagcatcactaggcgttgaaggagtcggaggaggaggccgagccatgtcgagggccaccactagcagcagtgacggaggaggagaaggcgtgggtggtgggaagacaacgatgacaatggggtcgaggccgatggtgcctatgggcgagccctggtagatcggggggggtggattttctcgacgctggggagaggttggcggttggggggggggcgtcggcagcggtagaggggggagatggcggcatcgatgccgagagagacgtacaacagagctccttgccggggacggaagtggagaggcatcggcctggtttgtagaacgagaagggtgtgtggcggatgggcaagtgggtggcaaggagacaacgtagcaggcgagctagttaagcatcaggcataacgaaccgatggcgggcagtgaccttggcgaggtgaggaaaccatgactgttatgagggcggcgctgcggtggtcggccaactcggcgtcaccgatggggttggggagcgaggagggccacagaggctaacagagcaccgttgtcccaagctctcccgcccgatggcccaagcgacgaacaacttataggtgctcgccccccgcccgctgttggtccgcccactgcccctctgttccagctgccgcccctgcttcgcccaccacccatctgctccactcgccacccctctgatccggccgctgccgctcgcccttctccttgcagtgcatgggagtgaggggggataaagtgaagaggaaggagtgaggatgacgtatgggaccatatggacccccatcttttttttattattttgtgtgtaactgacatgtgggtcccactatttttattattttccgagatcgaattgccacgtaaacatcacgtcaatgtcgcatgggacgacgacctagtcaaaggagccatgtaggcgccacgccatctaaaaaccgggcacaatactactgagagacctcgtctgtatggttttgtaagttgggggatgcattccggttttctggactgaggatgaaaatcagacttgaggacaaattgagggacctaaagtgaacttattccatggaattaagcctgggaacggatgaaccgacaaccatgtcaccaaaattatcgatttgctacaattccacaaaagaaattaaggttttactatttcacttgcgatagatttttgaactcttatcttttgatttttcgtccgtaggatcttgtatcaagattcgtgctcctataaatccaacttgcaattacacttagttacatagcactacttaattacaatacaccaaaattagattttataactactagcatagcatattgtccatgcattgaaacaggatctaattgatgaaaataatcgttaacctattattatcattattttccgtactattaaattctacatatttgtaaataacatatgtgcatatggcctcacaatatcactttttcttcataaaaaaatagagatggtggtgggtggggtggtggatatgtgggtcattcggccacacatatccttttttcactcaaaagaagtagggagttgttggtggaaccccacgtgtcattttttcattctaaaaggtagagagttggtggcatgggtggtggcacattcaccgctaactaccaccactgctattttttttaaaggagtatagatttttttcttagattgaggaatttttattaggtctctttttttattttatttaaaacggaatgtatctgttggttgaaaattccataagatttaaagctccgaatctaagaccctcttttgtttaggctaggcttattggcctagacttttaagtcagcttattggcttatatgatttataagacaatggatttaatgtcctaagtttagtggttgagtcatacatctacctcacataagccaaaaatacctcacataagccaaaaaagcttctccaacctagcttttggcttaatagtgttaaagtggcttgtggcttcaaacaagccaaacggaaaagctgcttgtttgtttaggtttagacttttcgacttataagttggcttataagtctaaacaaagaggacctaatattaataggcagtccaaaagattattacaataatagttgaacgttttgttataaaaaaactgaaaatttgtttatctggtaggtccgggttgcaccttagacccgcaaagttaaaattgtagtgccgctgcagttttgctaaaagagttgtattattttttttaaaagaaatagtcttcataattattgtagctctttgtctttttaggagaattgtcatggaagggattttaagccattattccattcattcactttttatagcaccggtgcatctcatttaactttttgaacactgtcagatttttgcacagttgctagtagtacgtgaggctgtttgttgatagccacccttgtggttagacgagtttgatcatattaaacgtgtgtttggttgacaactataagtgtgggtaagattacttcactgcaaactgaggatccatgcctaagagcatctcctacagtctcttcaaatctaactctccaaatatcaatttggccaactctctatctaatttagccagtcaaactcttatttactccaacagcctctctattcatcctctctattatgagcctatgatagggggacccacgtgtcagtctttacaaccctttcttcttcctcatctatccccctttccccaaacccactctgctcagctcgcagcaggtgctgccgccgccgccgccaccgctcggggcgagctcgcgtggatgcggggtggccaatcggctcgggcggcgaacacgatgacaggagtgagatggcggcgtcctctactacatgccgcaccggctgaatccgccggggcatggcgatgacgacggcaggcgacgatgacctcggctggcgacggatctggcgacggcgccgacaacggctggcgacggcatcgacgacggctggtgatggtgcggcgtccggcaatgacgacctcggagatgacggttgacgatggcgccgacgacggctagcgaggctcaacgacgacctcgcggatctggcaacggcacgatgacggcggtgttcggcaacagcggatctggcgacgacgcgacgacggctggcgacggcgacagcgccgacgacggctggcgacggcggcgtccggcaacgacgacctcgacagcaccagcgatggcatctcgacgacgacggttggcggagagagaaagaggagagggatgttgttggcgtggggcccacgattggctaggctattttggctggccaaatttggctagtggaaggaggactttggccagcccaatagccagtctgttggagggtgaaattgagccaaaatttccaaaatttaacttaaagagagggataaggagaccgttggagatgctctaactggtcttaaaaagtatggcatggttttactttgtggctaaattgtagctttgattttgatggcaaaatctttggtgagcttggacaaaaaggtttggcaaatctaggcagatgaaccttgcagattgtgacaatctcatgtgtccaatgagaatgatgatgtccatgctctgctcccggaaagaagaggcaaaatccaaggagaaagaaaagaaaagagagaaatctactgattcgccgcagcagcacatggatatggataagctctgctgcgcactgcccaaataggaccatcatgtctgggactttatatccttaccctctgttcgttcgtcttagagcagttacaatataagccagctataaatatattttaaagagataaaataatagcagactataagctaactataaacatattttaaaaaaataaag

SEQ ID NO: 48370 - DNA, 733 bp, Oryza sativa
tgatgtacagtaaacattctctaattatggaataattagacttaaaaaatttatctcgcgaattagtttttatttatgtaattagttttgtatatgtaattagttttgtaagtagtctatatttaatactctaaattagtgtctaaatgtagagactaaaattaagtccctagatccaaacaccaccgtagacacgaatcaactaataccgtagcacacctagatgcagatgcacctagtcatattctctttctcaacacatatctgagcacctctgttggcgctaccctccaaaagagaattagaacgcacagcggagtgcagaagggtgcaccgaagatgatcaagtagacaatgttggagatgagcaggtcgatgccgatcggggctccaatcctgagcacgaccctgatccccatcctcctgcgcaccacgtgcgcgcagctcaccatcagcaccagctccctgttcctgaacagcatcgtgccggcggcgagggcgcagacgccggcggcggtggcgcgggacaccggagccagcaccaggtacacccccagcgcgaaggccaccagcaggctcctcatcgacaagcgcatccaccacacggaattcttgaagtacctgtgccggacattcatctccaccgccgccgtgccggcgtacatcaggctgagcgtggcgagcatggagcaggtgaaggccagcgccacggcgtacatgaacgcgtcgaagg

SEQ ID NO: 48371 - DNA, 949 bp, Oryza sativa
gctggtgggtgtctacgtcgacgactggtgatcaccggcaccaaggatgcggaggtcgcggcgttcaaggaggagatgaaggccaccttccagatgagtgatctgggcctctctccttctacctggggatccaggtgtaccaggacgactccggaatcacgcttcggcagaccgcctacgccaagcgcgtcgttgagctggctgggctcaccgattgcaacccagctctcactccgatggaggagagactgaagctgagccgcgacagcacggcggaggaagtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacattgacaccagcaagagcacgagcgggattctcttcttcctcggcgagtgcctcgttagctggcagtcaatcaagcagcaggtggtggccctgtccagctgcgaggccgagtacatggtggcatccgccgcttcgacccaggcgctctggcttgctcgactgcttagtgatctcctcggcagagatactggagcggtggagctcagggtggatagccagtccgctctggccctggcaaagaaccccgtttttcacgaacggagcaagcacatccgggtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggc

SEQ ID NO: 48372 - DNA, 870 bp, Oryza sativa
cccccccccctccgaattttttaatttttgttttatttgtttgatatttttttcacgcttagggacacacaagaaccaaccatagaaaaattgaactcaaataaacgtaatatgtgacatgtagaatttttcctctcctctcctctctccgaactagtgcagaggagagagatgtgcaacttttttatttttattttatttttttgatatttttttcacacttaggaactcacaagaaccaaccatgtaaaaaataaactcaaacggacgaaatatgtggcatatggaatttttcaaagctccaccgaaaaacttctctcctcgaaaacacaatcttgcaagcggaatttggaggttttaatatcgccgaacccgacaaagcggggagaatcggatgtaactttttctgtagatgtccgtgcatatattatttgcctgattccgagtccgtatgagaaagttatgcctattttaatagatgacatattttgtccatttcggtagagttttgaaaaattctacatatcacatattttgtccgtttgagtttattttttatacggttggttcctatgttctcctaagtgtgaaaaaatatcaaaaaaatgaaataaaaataaaaaaaattgcatctctatgtactgtttaacttatatatgtcatttcatgtggttatattttgaattagattaagtaatttcatatagtggtagagtgcattatgtttaacatgctgatcaaagggttttactaaaagagttatggtctaattttagtgaaggtgcaaagtagactaagtggtatgctagatattttcagacttagctaagtggtagttcgagtttaatttttttttgtggttggttgtat

SEQ ID NO: 48373 - DNA, 790 bp, Oryza sativa
ccacatcgacctaccggtcacctttggtggatcagcaaactttcgcacggagcgggtgaacttcgatgtggcggacctcagtctgccctacaacgcggtcctggggaggcccgcgttggtgaagtttatggcggcggtccactacgcctacctccagatgaagatgccgggcccttgtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggagttgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatcccgagtggctggcgaacccggtggtcgttcccaaggcgaacggcaagcttcggatgtgcatcgactacaccgaccttaacaaggcatgtcctaaggatccttacccctgccctcgcatagatcagatcgtcgattccactgcgggg

SEQ ID NO: 48374 - DNA, 1668 bp, Oryza sativa
atcgctaaaaacacttatgcaaaagttttatttataaattattttttgtttgcgaatatgccgtttcggggacggaatcaataaactgccggatgattatatataaagatgataattaaagaaacctcttttggtagcatgttgccgtcacctgtatatagggaaatattcagcgcctgtttggaagagtgtagggttcatatattatttcgttccatatatatatatatatatatatatatatatatatatatatatatatatatatatatatatatatatatatatatatatatatatatatatatatatctcacaattaatcattcttagtacgaggcataggtcttctgcatgtgatagcacgatcgagagcgatcgctaaattaaaccaggaggattagttgacattagcttctaaattcttattgagaatttagtaattgagacgatgagcagtagctagatctcatctgccagaaagaaaaaaaaaaggcaagtacttcacgtggaattaacgggcaagaattcagaaatgaatattggagtagttctagacttctgtttttttaatttcatcatgataaggaatcactcttgtatttatttcagtatacagaagtatccaaggatgtacatttgtacactagttctgacgaacaatctctcaatgtgcacatggacacgtacagatcacgacagcagatcagatcactatgtattttcagtattgtcctacgtattgtctgtttctcttgagaacagttcttcggttcttccatggcgattgtcagtgtgatcttatacagtacatgtgttcagtttatattatgcattcatggatcatactagttcataatttataactttatggatgccaacttggtaataatgtactacatttctttgatctgcaatcgcatttacttgtctgcatcatgtgcgagagcatggtagtgtgtctaatgacgagcttgtgtaatcgctttgctagctactcttgtcattttcctggcagatttcagattctaatctttagtactccctccgtttcatattataagattttctagcattactcacatttatatagatgttaatgaattagacatatatatatatatatatatatatatatatatatatatatatatatatatatatatatatgtctagattcattaacatatatataaatatagaaaatactataaagtcttataatatgaaacggaggaagtactaacctaccagtcactttccagcactgaactgccatgtattaggagcatatataaacacgaattttaaaatttatcaccatatggtgtaatgccaccgtgttatccttatctcgtttgatcaactgtcactgttttcagtgttccagaagctggtcatgaatcatgatcacatgatctgataatttaacttgatcaccatgtgaccttaagctttataagatgatgaatcactggcactaaagagcagtccgtggattggatgaagtccctgaatcccaaaaggcaaattctgaagaagaaactttctcagttgcagtgagaaaacaaatcaagccaaaatttacagccaaatgtgacactttgtgcaccaattcattaatatttcagaggacattcaaagaattcagaaaaggaaatcattcgg

SEQ ID NO: 48375 - DNA, 15457 bp, Oryza sativa
cagtataattttttccctcaggtttgtaacttgatcaagaacttgtgatgctcatgcattttgttggatatacttcttgtatgtatacctgagaaaggagcaggaactgacgagctggtgttctgtgacagttattcctgttctctttcagaactcattgcatcaaccaaaggaagatcctgttgtgaccttggatcatatatttggagtagaaccaatgaagattacaagccccccaacagataatgaaattgctctcgctcttagagtcttggaaggatgttgccttttgtatagccgatgcactgctctggcacacaagtacaaggctgtgaaggtaatatccaattatctgtagtgcttgctttgttctaagacatctgttttatgcttgatggtttaattaggccattcccaacccaagacattagacatagtttccataaactccacatcatcaagaaactagtactagacactactcttccaatgcaaacaccactattccatacttaaatttaatgatacctatctcacttgatgtcttggatgttgtgtagaaaccatgtctcatgcaagacatggtttccttctctttcctcatttatttacttgtcatattatttttcatcctaggtggcagcttatttaatgctatggacaccatcctagtcattgggttgggaatggccttatgtttgttaaatcatactggctagaagttttttttttttttggtctcactcagatggtaatctgttgatcatgcaatttatttatcgcatagccgtagcgtcaaatcgttagttctatattgtatatcactgtcaagaagttcctgttctctgtggttgcggattctttcttcgagcataaatcattgctcaatatggtaccatctgctcatgtgatttttgtcctgtcccatatattcttcgcttgattagctaaaacctttattttctataggtaatcctgaatatattagctaaccgaggtccagctgagcaaggagtgtgcttggacgcgctgatatcgttgatgttggattcaccccccaatcagatggtgctgttacctctttacctaattgttatgattctcttaaaatcttttacatgttagtttttttttctattacattacttagggttagtgtacaattacttgacataagagaaatataaacatcaggtttatttcagaacaaaatgaataagacttactcttagtttgaaaggacattgagcattaaataagttgacatagtttattgtttctgtttcctatcattttttgtgctcttcagttggtccaaggctcacattgtatataacttcttccttatctaggatttcgaggaattcagtggacttgagaaggttgcagagcttttaaaggatgtgcaagtagaagagcacataaggcacgtattattcctttaagcatttctttagtctgaatgcataatctggcagttcaaaccaaattttactctctccctccctgttgaagaaaaccaaattttactcttcatgtgtctgatggattgatctgtccgtatctcatcaatcaattggaaaaacagaaagttaaacaaacgagccatgcaacctactagcttggtgacaacatgccctcaaaactattgatatctgaagtttttagctgttgacctctactcctagtctttgttttagcaaggtttgtgtgctaaccttaatattacatcctgacttactatgtgatattagctttactgttctggggtcctaattttgatgatcaaaatcttgagtctataactccactactaacagagtcaattgcacatttgtttctccaaattgtttgttcgtttttggattaacctacttttgttgaatgatgctttgatgcagattgaaatgtggggagttcctactattgctaattgggcatgtttatgcgaaagaaaactctcccatacacgaacaaatgagaattttgttcggcgagcagtgcgcatcactgatatgggcagcaagtcggtttggctccactctcgacgtggagcagaggcagatggccttgcaaatacaagcaaggagagttgttgaatccttggagccctactaagacaaagcacatcaatgcgttctttttgtcttcctgacaatggtctgatatcactgatccaagcaatgtgcttcatttgcctatagcaaagctttgttgtcatattttctgtgtagagccattcttatgtttctgtatgtacaaactttgttgaaaatattctattagttcagctttgcagaaaagatgttattagtttccattcgaaaaccatggactaggttacggtggtaacttagggcttgtagtggttccccattttgtaaaccgtgggtttaatacgaaatttgcctacaaattgccttttatgcttcaacagcaatattggcaacagtttcattgaaacagaggaaatcccctccaattgggaaatacttaatatattttgttgttgttgttggacgtacatacatacatacgcatgtgattatgacaagtttaaataaaaatgctatggcatgaaattagtttcataaataaaaccgaatatataaatatcgtgatagtatatttatttggtattatggatattaattattagtttttttataaaattggttaagttagagaattttgaccaagtacaaaagctacaaaactttaagtaacttgcattttgaaatggagagagaacaaatttgccttagagtggcgaagtgagcgttgcttaattggttaggtttcttatggtggagctgcccacttagattcaagtccaagacttgacataggtgcccgcatttaagactaattattcttttagtaatagacgacgtactcgctacaaaactttcagcaacttgcattttgaaatagagggagtataaatttgcctcaataatggtgaagtgagcgttgctcaattggttaggtcttttatggtggaatcagtccacttaggttgaagtcgtagacttacatggctgcccacatttatgactaattattttttcagtgatagacggtgtacccgccaccgacagcgagacgttcatgatgacttcgtcaatcttaaaatatatcggtccaatctttgaaagatatttatagaggttgggtgtgcatgtgtggtgagcatatttgtttgtactgttgtattttaaaaaaattgcctcacaaatgatgtgaagtttttttttttcagtccattagcctagcagattggagtattattcgggccatgaacgacccaaggccccagaacgagcccatatccatctcgccgaccaaatccctaaccctattccccccaccgagcacgcggcagctacacgcccccacgtcgccgtcgtcctcctccctccgccgcgccgtcgatctccctcccctcccgggccgccgccgccgcggcgtcctccacgccgcctgttgttcttgcctccttccccgaccgccactcttcttcaagaggtggccgtccgtcggcggagcagcacgggaagtcgacgccgctagctccgcctcccgtcgatcagtcggagatggagcaggtcagtttctacccaagaaaaacatgaaccaccacttcgtgagccgagctagtagaggctggattgatttctttccctcgaattgaattgtactgagcttgtttaccaaaagaagaagaagaattaccttttagagcaagaatgcaagatgatatgacattaaagggtgtgctttcaaaggattcctgaattttatgtattagtattacttactgctcccaaagtaatcgctgcagcggtgcagccactgtcataaacaatcacaatcaattggtttaaaacgactatctctgttctgatgaaatcataatcaattggttgtgcaggttcgtggtgttgtgcttcaaagaaacacgctggtgatgtctgctgcatagacaacacatggaaccatccgatctagttgatggatacaagttcggtgatcaaactacaagcgatgttcgtgtttgctttaaacgggccgatgaccaggcagaatggttttgctgccattcatctgtgctttccggaaatagcaagtattttgcagactggcttagcagaaatgacattggttcaaacaactgcattggggttgactgtataagtgctgactatgaacattatgtcaaggtgttgaagttaatatatcttcctgcagaatcaattatagattcttttgaatctgttaggtcagcggttggcgtgcttcgagcgtcaacacttctcaaatgtgagttaattaccagaagctgcattgaataccttgaagcagcttcatgggatgaaaaagaggaggaagagattttggaagtagctcagagccttggctcagaggaagcagtagctctgttagcccgtcttcaagccccaaatgtttctgctgtgaagaatgtcttcatctctgccattcgttttgctacgtccatggaaagtccatctcctcctttcttggatgatctcaagacttctgctcaggagcaaattgacttcatgctccatgaggacgatgacactgctttggttacaatggatgaggatgtgaggtctgtggtgcgagaaggattgaaaaaactgttctccacgcttaagattggactagatctgttgacctcggagtatgagcaattgcctgaacaggcagaacaaagggttctctgtagtttagctgacattgactggatggctaatgtcttgacaaagattgagatgatgaacgagtttgtctctggttggtcagaaatctctggctatgttctttcagttgttcaggataagaagtatagctcaggattgtggcttgtaaaagcaaaacttattgaagtgactggaaaggcctttgatgctgttggctatggctctgtggttttcccagcatcatccagagttcattttctgcggatgtggcttccattcatgcaaacaacgaagcgcttgcttgatgaaaagtcgaaggatgatgcgattccacagatggatgcagacttgtttcagaacattgagggtgcaatagtctcattggtgttagcattgccatcaggtgatcaggcagacattcttggagagtggatgaagaatgcagagcagttcagatatcctgatctcactgaggcatttgaggtgtggtgttaccgtagtaaaacggcaaagaggaggctagtaggagggctaaacgggagtggcaaccccacagtcagcttgtaactttgtaaggctaccattaattttaatcttttgttgtagcctatacaagtcagtgaaatcaggtggttggtaccaagcaatataccaactagattttcattgttgtatgttgtaaaacaactgctcatgtgtaatacacttgagctttcttgcagtatgttcattacccttgtccaagttcactacttcttcctgacctgagacatttcgaagcatagtccatggagcaactaggttactattggatatttcgaagcataattctgatgcattttttactcttttgcatcataaaacatgataagagttcattaactgactgtacaatcaggtctggtacaccctctgttcctggaattgttatgcatggatcctggggattcttaaattcttaaacattctttggtttaaatttgctactaaaaaaaagaactatttttttccctttatcatccaattggtttctgtgttgaatacaagaaaggcagaaaggtccttctttagtattcttgtacaggtttaatgaagtggtccgtcagataggttggaaattttagttggtagagatcattgtcttcatcaaactgcttgattcaaatattcagactaaattatgatttatctcaacccagctgctcatgcatcattagtcacttcattcctaatcaaacgaaaccatttgggatttggcacttctgcaaaagcatcgcattaattagttgtcccgttgtggcacaggaatcttcagggctttctagctaatcttcaactgattgcggccatcatgaggatgatcttctgctaatgatatcttaaatcattccaagcacttgattaagtacatatattaggtttagccatgtacttattggtacaaagtgctttctttaagacagaaggaatgattgatagcaaatgtccagcttaattcttccaatctcctgatgtgtttggggtagctaaaagaagctttcttcatagtggaacataaaggagatgattaacaactagttgggggtaccatgagtcttcttagtccatcattatttaaccctctattcagagttcagattaactgctggttaggatcattatgaggtcttgttggtcaattttcttctaagtgattattattacctagtaatagataacttgcataatgtcataagttatgctttccagcaaacaaacaggtgagtgattctatggctctctgtccccatttagcaaattgacctgtagtggagcttcagttgcaagcatctttcacttcatttgttgattggtatctttttcctttcctcgtgcataatgtgataaacaattagcaaactgctccaattgagattgggaatgaacctaagttccccttttttcctcttcaattacagacaaacaatttgatcatttgatggtagggcatgattagatgacgtgcaaacagtgaagtccactaatgcatggggccaaaagatgagtatctagtacaatggatcaaataattatacctggtagtggagttgaacatttgcatctaatctagtctaatctagtccaatctagtgtggttgattgacattgaagaagaacatgtggcatactgatctttgcagggcagctcaaaacacactaacacatattcttcttttttcagtgaacactgctcttctgtttcacattataagtttttaaataagtcatttttttagaaattgttgattaactataatagaaaaatatagtaatatcttcaacacaaaattagtttcattaaggacatgttcactttgatgacattttcaaccttaccaaattttggtaaagttgtcaaaaaagtggctacatttagtttgctaccaaattttggtaactaaataagaaatcctaccaaaattttggcaagttaccaaaattttgccaaaatttgataaggttttttctggcatcaaagtgaacaggccctaaatctatcactgaatatattttaatagtatgtttgttttgtgtttaaaattttgctatgtttttgtataaactaaatcaaacttgaaagaagtcaaaacgttttataacatgaaacatgatacagcatatatcacgatattatacatatggtgtaattgtatgtatatatttacatctagcatattcttatacatatctaacatattatcttacatctaaactcagattacagtatacatataccattatactctagtgtttttactctctgtaattactcctctggtttctgaaactgacaatctaacttgaattttcttccaggctctgtgatgaatctctttgaatttgtcgggcgtcggcgatcaaaattggattaattttttttcttcttctggtgatgatgaactgaactgatgatcttgctagctaggcgaaagccaagccacggtctgcattggagctctgaacctggagcctgaagctgccggcatgaacactctcctccttctcctccgcagcgacctcgtcggagaatctccacagcttggcggcctcgtcggcgttggatcccagcctcgacggcgacgcctcgttgcagtcggcgaagtacttgccggacactccggccaccgccgggtgcaccgccacgtagcacgtcgtcgccgccgcctgttgattatatatagcatgagcaagacaggatcagaatttaagaagaaaccagggttggaatttcggactgtccgatacgatattatttcgaccaaaattttttattttcttaatattttcataaattttggtaatatttatttaaattcaactaaaatttgtttaaaattttggaaatttcagtatttcgatgatgtccaatcaaattggctaaaccgaatggtttaaccctggaagaaacatggatcatcgaagattcaattcaaagcaccattttcagtaaattcttgcctacgaaatccactgatgaaactgacctgagggatcgtcttgagcagcttggacgccaggaagaagactgtatctgcagttaaaatcatttcttgggtaaatttcttacttggatgctggtaaatttgttgaaaaaattgaagagggatgagaagaattactggtgacaaggccgtcgcgttctcggatgagccgggtcctgacgataccagggtggacgcagtttgccgtcacgttggctttcatctcctgctcaagccattgatggcaattagcttaatctagagctaattaattaaggttaattgcttaatttagcactggctatgctttgtcgtgtgattaagtcatgagatcagggaaactttttttttatggaatggatatcccttctttattttctgtatgcgacctaaataattattattttttttgaaaactgataagatgtgataaatatacgttgtatcgccacttcataaatatccaacctaaaattcaacttctacaactcgtgaaaaaataacaaatataaccgaaatactctttccgtccaaaaaataaaataataaatctaggactggatctgacatattctagtacaacgaatctggacagaggtatgttcagatttatagtactggaaacacatccagtactagcttgattttttatgtgacgcagggagtatgtatgtgtgtatatactagtcttaatttgatttatgagatcagagtgaataataattaccttgagccgatccgcgagtgccctcgtgtggagaacgttggccagcttggagagcgcgtaggctctcgtcggatcgtacggtctgcacaggtgcatgatatccaaaacgtgaatcttaaagcacggattaatatctccatcgtcttttttttgtcttattttcttttgagaaattaaatttaagtgtgatgtgacagggatttgtaactaactctacgcacatcttcctgcgcgtgacggcgtcgatgtagccgacggcgtcgtcgccggcgaaccagctgtggattgtggaggatacgttgacgatgcggccctcgacgccggtcgccgccgccgtctccgccatcttctccatcagcagcttcgtcagcaggaagtgccctgaattaattatatccaatccattaacgcgataattagttagcaccgtaattaattagcatcttcgataaacacttagcgtaattatttaagctttgttaatcgcatgcaacgtacgtacccaagtagtttgtggcgaaggtcatctcgacgccgtcgtcggacaaggcgaatcggtcggcgaacttgccggcgttgttgctgcatgaattcatcgtgcatggtgccaaattaattaaaaaagtacatactttaattaaattgtgataaaactaaaatttaaagtgttgtatcataaaaatatatttcgcattaattaattttatcccacaactacgtattagatagcaaatttatcataataaaactataggtaaactattacgttcatagttccaatataacggtagtaaaagagatttaaactaaaaaatcaatagttttgtattaacttcaacattgtatttgtagatttgtaatactttagttttatgatagtttagttaaaatatatgtagttttatgaaatttagtctaattaaaaacacctcatatatatttaaaccaaaccaaaccaaaccaaccatgcaaataattcctctagctaggcaatgtgcaatattatttgatggtactaattagcaccaacaattaattagcatgatcgtgattagtgggaggagttggtgataattaacagtagtacacgtacatgaggaggttgagagggaggccgagcgcgaggaatcgggcggcgaagcggcggacggaggcgagcgagctgaggtccagcggcatcaccaccacgtcgccggcggcggcggggcactcggcgagcagccgcgcccgcgcctccgccgccgccttgaggctcctcgccggcagcaccagcctcgcccctcgcttcgccagcaccctcgccgtctccgcccctatccccgacgtcgccccggtgatgatggcggtgatgtggcggaggtcggagcaggccgcggtggcgtcctccgcggtggcgcgcgacccgaagccgctcgcccccgccgtgccggccaggtatctcagcgaggtcagcatggctaagctaagctagcttaattatggttaagctaagctaagctatggcggtgatgagttggcgcgagatcgaagagaagtcgtcgcatctcgtcggagaagaagatgagctgagctgggtataaatagtgagtgagtgagtgagtgagtacagttgcactggaaagccatgagctttacataatataatcatgttgttattaggaaataattaagctgatttaagcttttaattaattggaagaagagggggtacagtttattttcgttaatttttagctgattttgtgcgtgtcagtcagtgtgtgagtgagctgtgagcatcagatcgatcgacccaattaattaattggtgataccttagttttaatcatctgtagtattcatctttcctttgcttaacactagctttccagtagagacaaaagtagtacaaatttaagtcatcttcttcctcggttcttcctcatcatctcctcgtttttttttaaaaaaaattcctctctttaatttggaacctttccatcggtcatcacacacatgtcatcaccattgatgcgcttgcacacacgagagatactaattaacaaggaacatatcatatacacataaactttccgtacacacttcgtacacaccaattagcaaatatcatagaaaattctagaaaaaattagacacatatttctaatagtattgtacccactgtgaaatcttatctcaaattcattatattttagccgtaacaaaattctaacagatttttaccctaaaaattgtcagattttccactttttttatggctaaaatataatgaatttgaatatgagattttgcagatatgtgtaatattatattaggagtatgtgtctaattttttctagaatttgtgacatttgtaattggtatgtacggagtgtgcatgggaagcttgtctgcatatatatatatatatatatatatatatatataggacactcatatggggcaccatggtgcccgggcaccatggtttcaaatgcacaaaatcactcaaatttttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattggatatatactcaatttcaacaatggtgcccgggcaccatggagcaccaaacaaatttactatatatatatatatatatatatatatatatatatatatatatatatatatatatatatatatatatatattcccaattaacacattgcaatttgaaattagtactaattaattagctctccatcgatgcaggtcgctctcatgcttgtcgctgaatgcgaaggcgagatcatgcaggaatgggcgaacgattcatggctgcatgtacatgctctaaacacaaggtgttgatagctatatgttcgtcttggatcgtgcagcttatctgtaagcgctatcgaagatgacactatgtgtgactaatacaacaaggatgtaaaatggttccttggcttcatctgaaaattttctaccctgatgcatatgtgaaactacttgcattgaccggtagtggactttaataatgtctttctccctctgtcctaaaagtgtaacattttttaagagattgtaggtattagggaaaggggtagaaaattttgtttgtcttattaagatatgtaatgtgtaggctcgaattataataaagccaaaagaagcgcgtggtggcaaaattatcttttatatgtcctacccctgtcaaaaaaaaaacccatttttaagtatgaatgtgctttttttttttttgaaacagagaggggtaggttgctatcgatctaagacaaaatttgaactctagactttttatatttggagatggaagaagtagtatattggctaacacgtagtcttttgttctactagaagaactttagcgcaagttctatctcaggttgttttgttgtttcaattttcttggctagagcaaaatttaattttaaggcttactcatcgtagtttattttttcaatattaacaatttagatataagagttttacttataatttctttccgtttgttagttgatttttttacagcttattagctgtagatcaaactagctaagttttcctattaatactctgaatggtaagttggtgatcccagcatgaattatttctactagcttgccataaaagctgggtccatctgggccacctttcaaaaaaattttttgaatgaacttaaaaaaacctttgataaggtcttattctaaacaaagatttataatattgtaaattaatattcaacagaagtatagatatacagtaagatttttacactttcaccggtcattttcctccttcatggttcatatattaatctggcaaattaaagctctaatatatgatatatttacgtatattagtttgagaattaaattaatcaagaattgaaaaccgtttgaaacttgaaacaatgttaacaattattgggagtttctgaatataaaaaggaaatacatccaaactgaaggagctgttatcagttagttagtagtgggagaagtgggcttgataatttgtaaacttgtatatgaatatagtgggtgtttgcagatcaaatcaagcttgcaataggccaatggtggtgggtggggagcaattagctaagctagctccaagattgggagcaaagaggagtaggtcacatttgccccaaaaaaacataataataatttggcaatttggcattgctctaaaacaaaaccaaacagaggaggaaaagaagggggaaaggaggatgtgatggagatgggagctaatgaatagtggctatagtggtaatccgtatccgatgatggattttatgagcattacttttgtatgtgcgtggtttgcacagctaacaaaaataattagagcaagatgtaccatgcgtagatgcgtattagttgaattagtagttttctgtgtggttcctctttctcatttcccacaaattataggtgacactagcatatatagacataaaaaagctagataagtaaaataaatagaaataacgtatgagcgaccgtgattaattagcatcatgatcttatactgcttttctctcatgcaagccccttttaatttagattatttagttgattattacatgaattatctacatgattatagaaataaattaaatatattcatgattattacatgaattatctacatgattatagaaataaataaattaattaaatatattgataaataaacttaacaaatagtttaaaataagtgatctaaaataatactgtagaagaataagagaatgttttttttaagtgtggaggtttcaataatccaagtaatcacgaagtgacttgtgacaagtttctgtatacattgcaggagatcagcttcccatttccctttgtcttgtgagtcgtgactacttttggctggaaggtcccaggaagatcctcgatctttgacgcaaaaatattcttggaacacctataagcgatagatcttgcaatcattgtaacagtatataaagagctttgcaaattgtgcttattttttagtggtctccccttaaaacaagttggatgtagcaacaactttgaattggttgtgtgaaagaattgcatctattacattcattacagagggctatatctgattactctgataattagacacatgcatttcagttatgttcttgttgggttccaagaaaacaaaaaatcactactgataatctatgtcagtattcagtagtgtacacaattttgatttttgaagaacaccagaaaggtctggtaaggtgtcaacttgatggattctctctgtgtgcaataatttgcttaacttttgttctcatgttgttactatgctaaggccttgtttagttcccaattttttttcaaaaacgccacatcgaatctttgtacatatatatagagaattaaatatagataaaaataaaaactaattgcacagtttgcatggaaatcgcgagacgattcttttgagtgtaattagatcatgattagccataagtgctataataacctatatgtgctaatgacgaattaattagatttaataaattcgtctcatggtttccagacgagttatgaaattagttttttcattcgcgtccgaaaaccccttccgacatccagtcaaacgttcgatgtgacacccaaaaaatttcttttcgcgaactaaacaaactctaaagccatgaaagaaacaaaatatacaaaattttgccatgagcccatgggtcatgggtggctgttaaacaattcagcaagatagagctgcatcagctgtgaaggtgatgcccattttggctacaaatggttgttgcaatcatcgctcaatcctagctccttgtttagagtttaataattaaacttttctctcttcttttttttatttattgtagggaatagaaaatgatcctactatacgagcaccaactcaaacatgctagatggagaaaactatccgtatacatggtacctatttttgacatgaaattctgatagaatgaaatgcatagtcattacttatttttattttctttacatggtatcggctaatggtgagctaatgatcatgcataagtgcataacttctgcccatctagattcatgcaaatatgcaaaccacaatacgcacctgaacaataaatctagatgcaacaataaaaacggagtgggcgtccaaatctatgcagaatactggtcggaagagtaatattggttttggtcaatcaatattgccttgtcacatactcacattattgccttgtcacatcctttcagtct

SEQ ID NO: 48376 - DNA, 6184 bp, Oryza sativa
ataatagtaatatgctcactctatatctccaaaaatctttccttgatgcatgcaggttggtggttggaaccattgtatcatgtactcacttgaacacgcgcgccacatacttgtacctttcttggcacaacaatacaatactttgatacctttggcttgtctttttggttaggatgatcaagagcatagtgtaatgtaatgtaatgaaatgaaaagagggtttggcgcgtgcactgaccgaaagcacattctctgccacgaagaactaccaatggatcagctcgaatcctcaccgatagcaactggataggtggccaagtcaaacgcactgatgaacttatgggttccaactttccaacaccctgcaaaaccatagattaagccttaatgatgagtgactatacaaaggtgatgcttaattgttttcaagtgaaaggcatgggaagatgatgaaggctatcttaattagactctcagcaaacacttcacacactaaagttggtgaaggcatagtcaatatagcaaaggtgtatgaatgagagactgaagacatgtgaagtatcaattgttcaagtacctgattgcctatcttactaacttgcaaatttgcaattagtaacaaatacatatgcttttaattgtttttaatgtattatatcaatctgaaagaaacccaacaaagatgataatatggtgatatttgcaacctcatccctgattggtgatccactttgcaaaatatgatgccaacatgtatcttggatgacaaaagaaaataaagttataaaatcattcagtatgaacttgtgagcatgtgctctctcaatctctgtacttgcaaatgattgaagatgacaaaaaagtttccttgaattgcttgtttacaccacatgaattcagatccttatcgaaatgcatccagaaatccagtgatctacatgttgatgcataagactgttgatactgctataaattgtttcatggatataacctgagaagaagaaaatcacttcttttacaacagcaataatgttggcttaccatcgcaaattaaattgtgccaactgataaacagctcgttgatggattgaaaaatgaatcgactgttcactcagataagagcaggcaccaattgtttagacgcaaacatagatttttttttttatataaaggatgggcagacccatgaagatcatcatgcaagcaggttgaacactgcaaattggattagctggttacaaagtaaggatagaagtgaccatcaattggcgcaaagagaaaacccaggttgaaaaggttgacaattgtgcaactggaaagtgagcagggtgaagggcaagcatatttgtcaggtaaataagttatccaggtcacatccagatatgataagacactaataagataaaattcagaatagattaagcaacagtttcatgcaatttttataaggcaaataaaataagatatggtagttcaaactgcatcccatttacaagccataagtactatatagattctccgaaaacggatgctgtaacaaatatgcagtgtggtatggcccaaaattgtgacacttaagcgagaaaagtaaagtacttggcaaaagaaaggaacctatattacgcaaacaatacaatcaggtcagtgggctgccaacaacattatgcaagttgcacatactgccattgctgttgtagtgagaaaatttgaatatattattgtgcacaagcatttgatatgtgcaatagagaagtcataataaggcataagcatctcacagaatgatgatgcagctcatgtagcatctgcaaatctagacttcctctaagcttgtattgcagagttaactatttttttcagtgcgcctggctttgcagtttgccacattgacattcagtaagatcaaagaataacactgaaaaaagaatacatgcaaaggcattttactttgttgaactggaagcagtaagtaagatactcctcaaacgacttacaaatgatattatatcaaagatatgcttttcaagcttcataccaggtgaaaaataattgattcattgatatgcactaaagtggatacagtgatagtacaacagggtgactgaccagtcagttttctgctcaacgtgtagagaaaagaacaacctgaagttgctcctctggtaaagaacagacaaggaaaaaagaaaaatcaaagttttgatccagcaacgtcctccaacaaaagaaatgcaagccaaaatcttgtgccgtgctatcaaaactccggcaatccagtgtagaacctctctatcaaatacaacctccatctgaatcaatcacgcagaatcaagctaaaaaagggattgatcacaagacgaataaccatccacgcttgtaaaacacgagcgtgcccacggtcaccgtcgaccaaaccgcaacgatccaccgcgccgcgagcaatgcagcctccttcatggcaaccgaccacccaacaagccagttcagctcctccacgccctcaaagtaatcttttccttgcactcgccacaatgccagcagcgagagcacgagcagtggcggcgcgacgagctgcgtggccacggcgcagagatggtggttgtgcaggaacaccttggcgcggccgtactccgtgtccggcgagcggctgacgtgcagccgctggtaccagcagaagacggcctcgttgagatacatctgcacggccgcccgcgaggccagcagctgcagccccgccgcggcggcgagcagcttcacctcaagctccgggctgtccaggaacccgcagcattggaggatcgacgccgcggaggagacgaggacggcgaggtagaggagcaggcgcgcgggcgcggacgacgcgagcacggcgagcccagagcggggctggtcggtgccgagccagaacgagcgcgcgaaccgcgtggcggggagcgcggcgagcgacgcgagcgcgccggcgaacgggctggacgagagcagcgtagcgacgagcagcgcgccgagcgcggcggcgaggtaggcggggcgcggggacgggagcatcacgaggcgcagcagcgcgacgaagaggaacacgacgggcgggagcggcgcgagcggggcggccgcgccggcggcggaggccgggagcagcagcgccggtggcagcagcgcgagcgggaggaggagtgcgaggtggaagtcggcgaagcgcgggcgcgtggcgagcgtggcgtgggagaggcggaggcggtagagctgcgcggagttggacccctcgtcgaacggagacgccgccgccttgccaccaccaccaccaccaccgcgttgctgcttggggttcccggatccagcggcggcgccgggcgggcggaggacggcgcgaggggtggaggaggggacagcgtccgggtggatgtaggtgtggagggcgtagaggaggagggaggggaggtggaggaggtgggtgacggcggcgagcgcgagtgcggcgacggcgtagaggagagacggcgggacggggacggggaggaggaggagcacggccatcgccggcggcgagtgggtagatcgccggagttgagggtggagtggatctgaaggaggcgagtggaggtggttgggagatgggcttttctgcttcgaatctgggggcttttaactatttgccactcttacgaatggtccttaacgatttgccactaggcccacatgtcatagacacatgagggcccacgtgtcattgacagagcgtggcaaatcgttaattgccatgtcacaagagtggcaaatagttaaatttccctcgaatgtgggctggtttggacggcttggattcttccctgcttgccttgtttgtattttgcatgggatctagtacactatatttgttgggatttgctagatttcctgaaaaaactgtacacttttgggtcacctaaaattgcacattactaaatctaaattgcagataaaataatatacaaatgtcattagagaataaatacaagcgcgataaatgcgaaaatgagacatctacaatagtaattttgttgttgccaaggcaagaagaagatagacaaacagtacggtatgtctagtatacatgggctccatcggttgcctaacgagttaaagttaaaagttaaaatttaaattttcaaacttaattttgaagttaattttaatttattttcaatatagtttcatttttagcattagtttttaagtcgctaaaaacgcatatataaaagttttatctctaaattaatttttattttctaataaaatattttgacttattagggaatatgtgtaaccgatgaggccgtatatttgttgggatttgctatatttccttaaagtttttagatttttttagtctcctaaaattgtacgtacgtagattgataaatctaaattgctgacgaatgagatacaaatgtaattatagaagacaaacttggcatgtcattatagaagatactacccacttatatattttatataaatatatacaaacgtgataaatgaagcgtctatatataggagaagttttgttgatgcaaaggctagaagataagagacaaacagtacgggaagctattgaatgtggatcgaggacatctctaatgtgagtggcatgcttatactttaattaacttggtacggctaattatttaattattagtggtagacaaatatacttgtggtggcatcattaatctcggaataaaacagcctaatcttttttaggtgtagatgtgcatgtttttaaaaaaaaattaagaaaaatgtgtgtatttatatgagtgtatatatttgtagcgcgttttgtaaataaaaaaatcaaacatatatataagaactatattttatctctcatattattgtgtgagtaataacaagtagtactaacaactaacaacccaatccggtctcttggttcgtgacatgggcctgatcttttctttgagaaagaggacgctgtgggcctgatctgagtcctcgttatatagttttcttgggcctcgttttgatggcccatcatgctagcccaatcaaagtaagaaaatggtctaaaaactcccacgtcccccagtactttttgcttcaacttgctcgtttcccttgcattccatgaagattcctccgtagcaactcgttaataggatattaatcctgcaactgtatattaacctttcagatacgagaggacaacggactgttcacatataataatttgatagaagctaaccatccataattaatactacctccgttttttaaaataaatgacaccgttaatgttttaacatttgatcgttcattttatttaaaaaattagtataaatatgctaaaatataagtcaatgagtcatacttatagtttcttcaatgataaaaaatcacagcaaaataaataaacattcaatgaagggagtacttaggaaaaaaaatgatgtctcctacgtcacttgtaatacgtagaggttgcaaaaattctactcctagtctcttatacgcttaattttgacccgtcacatttacacaagtgactagaatatccatatgatattgaatagtccctgtcaaaagaaagaaagaaaaaaataagaagaagaggagaactacaagtaccagcatataacaactacagtatcgatcaagtgccaggtgtcaacaacaatcggatcggaatagtcatccttcaaactttcaaagtataagttccacgaggaatcaggcgttgtttagtttggaaaaaaaattctcaaagtttgattttgatcgtcccacgtaaacttttgaatcgatcaatcaatttgaaaatatacatatcgaatcgaattgaatttccacgtaggccgcgcgaagacgccaagaatgcgcggcaaaagggcgagcagcgagccgaactaacagctgaaagcgaaacgaagcttagatatagtaatagttaagattactttctctgcggtttcgcgcgcaacgaagctactcctcttcctcctcccacctcccttctactttccacctctcgcccgccatggcgaatccttcaaacctcccatgggtataaagcgtacgaaccatttttcgatgatccctcgctcatgtcggaggcgatgttccggttcatgtccaagaacggcaccggccatgggtgcggcggcggcggaagcggaagaagaagaagggt

SEQ ID NO: 48377 - DNA, 15137 bp, Oryza sativa
  unsure (1)..(15137): unsure at all n locations
ggcgatgggcatcccggtgtcggggacatccgccgccgtggtggggatgccggcgtgggcggcgtggggcggcgaggcggcggcgtcgcggtgatcgatcgcgacgcggcgaggcaacgagagagactacccgtggaaaaacggtggaaaaattcatcgccgggtcggacttatttttatttattttttgttctgatcgagacgttgactaacccggtaatgggttggtcaaacgtctcgtcggctcgtcgcgttgttctgcgtgtgtacgtatatacgtacgtacatgcccggaagcttcctctcgcagctatacgtatgtacatacaacccacgtacgtatagtatcaatcataagtggctgtactcggattggtggtgtatatgtgactgaactgtgggaccagggggttgcaggggttttgtaattgtaactgtataaatgattgctaccacttgattgtgagatgaattgataagagaaaccctaagtcgaaaagaacttattattgctttttgcccccttttggattgcttgataatgtacacatgtattgctaacttgttatgattttgtgtgtgtgtgtggggtgggggggggtcaaaaggggtccaggagctccttctttcagtaggatgaggagaatttattcagtttataagtaaaatcaggtgttaaagaactttagaaccacatgattaatttgggaaaaacaaagaaagcgtacgaaaaataaatgattagatcttacaacggtacagagagaaacgctcagaggtcttccgactagcttcacgaggtggttggctagacaacttaaatttgaagcaccaatccttctaattatttaatattaaatcttttctaattatttgatattagttaatttcctagtatccgcgtcttacaacggtacaactactgagatccatcaggaccatcacaagccatcgttatcgagcacatctttttaaaaagagaatgccttaatttaccatagaatgcaaaaaaaataaaaaaaagtttattctttttccctacagcccaccctacatacattcagaccaacccaacacaacacaacccaatactcccccagccagcatcaagtcatcaacgccaccaccaaaccaaacaaaacagatcaaatcaaatcacccatgtacactcctaaccccaactaattatacattgcatacaacaaattttaatctttatcagttatcaccttaatgatctttgcttgacgaatcaaagaagagacacacctctcccaaattcagagctgccttttttttgcgagacacatctcttcagaaaccgagaaacatatctctctgccaaattcagagctcttgcaaagacaaacatttttgcttcagaactgaatctccaatctccgatcaggtcaggatggcagaaggcgcgaagggcggcgcgtagtagagggggacgacggcgccggcgtcggggtcgatgctgccgtatcccttctcgctgccgccggagttggaggcctcgtgctcgccgccgccgccgccggagttgttgcggcggctgcggcgggcgggcgacccggcgaggctcggcggcggcggggcggcggttgtccggaaggaggctatcccggtccggcagagcgggcacgggatctcgccggcgatccccgccgagtcgtaggatttgatcaccgagcagagatccatcgcgcatttcacgcacagctcgtgatcgcaacctgcacagcacaagtgatcaagtactatatttaattcaccaagcaaaacactattactagtattactaatacaatcattgcaggttaatttaaattcaccgcctaattactgtctaagtcatgtcaacatttttcctagtccaagttcaaccaattttatagaaaagtataacaatatttgtaacacagtgcaaacatattatcaaaatataacaatattacatttaatgaatttaatttagtgttgtagatattgctagtttttttctctataaatttagtcaaacctaaaaaggttttactaagagaaaagttagagcgacttatattatgaaacggcgggagcactcgattgcttctttcgctcacaaatatctaaagtttacagtaatattacttcaacttttgaaattttgagcatcatattttattttacattcgagtaagttcatagaatctaattaggtacaatactatgataatacctttcaagataaatctacgcatgccattcttttctttctaaaatcagcatttgagaaattattgatgatcaaaatgtctgattgaatcttataaacatcaaatatgtataacaagatggagtagttagttctttgcctcgatgtctgaatgtttttgtgcatggatggagataaacaagaaaaatgataccttcagcagctacagtgcagggcctctcaagacagacggcgcaggcatctgctccttcatcgaagccatcagaaacctccgaagacaagttcagaccttgctccctgcaaatctcaccaaaccaaacaaaaccatagtacaaaacaacacacaaaacaccactccaactcagtgcatttcaagttctgaatatcactgatcagatcacattgaatttgcagaattgcattggtgatcagcgatcagttaaagtaccttgcaatggcgatgaggctggggagtggctgggagaggtagccggaaggagggaacttggggatcggaagatgcgacttgggggagaggacgtgttcaagccagttgcagccccagattctggctgcgtcgattgggagccacctgactaccacaatccttgcagcgatgagcatcaaatttgttgatatgctagtgacaattaatctgggggataattgagctggctaatttacccattgcaattgatggctgttctgtctgctcctcttgacacgagtatctgaacaagaacagcaggaaaggttttggagttattcagagagcaatcgatgttcaaagaaatgatcagtcagcaacttgaagaagtttgtgttattcagagaggaaaatgatggccaagaaatgatcagtctgaaacctgaagaagtttctgttatttcagagaggaaatcgatggccaagaaatgatcagtctgaaacttgaattcgcttttttaactgattcgttttaactcgagtgagttaacatttcaactcatccatctattcaattgatgggattgtcgacactaaccgactaacaaccaaatcaacaataaactaatatttttcaaatcgactaattgctcaattaatgactgaatcataccaaccaaactttcactatcacacactaaatttggctatcatcaaagaaaggaagaaaaagggaatcgtatactacctgacagcacttgacctcgccgccgcacgcggcgtagtgcagcggcgtgctgccggcgccgatggatgccatgggcggcgcggcgcagggcagcgtctgcgcggcgaggctggcgcgctcgtcgatgagcaggtggacgcactcgacgtgcccgtgcagcgccgccaggtgcagcgccgtcacgccgccgttcgccgccttgttcacgtacctgtcaattaaccaactcgagatcaccatggccgccacctcgctcgagctcctcaacaacaacaatggcttacccgtctctgtcgccggcggcgtccgccaccagcagcctgacgcacttgacatgtccgccggccgccgccatgtgcagcgccgtccgcccactcaggttctccaccctccacaccttcagtaaaaacaaaagttaatttctaatttactgattaatcgttgcaattaactgaagtgcaggagctaatcagtttactgtacattgcatctgaaaaccagcagcgtctgaaccacctcccagtgaccgaaccggcaagcttgcatcaatggcgtcttcagttcaatcaatccccatgtgcattcagaattcaagatccaggtcagaaacatggactagctggttggtcggttgggcgatcgatcaaacggctcgatattaattcgagtcaaaaaccgatggcttggcttagcttgtgcagagctaagcttgtacagtttgagttcgctcacctgtccatagatgttcctcgcattcacatctgctccattctccagcagcaatgcagcaatctgagcacacagtttggttagttgaacactgtcaaaactggtaagaattcagaacatatcgattgttcagagattgaacagcagctgaatttttttctccttttaatcgataataagacaattgatttgagctgattaccgaagattctgggcacacagttggttagttgaacagactgtcaaaaactgataagaattcagaacatatcagttgttcagagaatgaacagcagatgaaatttgctccttttaatcgataacatcacagttggttagttgaacagactgtcaaaactgttcaaaattcagaacatatcaattgttcagagattgaacagcagatgaaatttgctctctcttttttgacaaaataaacaatggtttgagttgatttagcgaaagatttgtcgtctgaatcgtcagggacgtcggacacgtacgaccacgtccctttttcgttgatagtgttctgaaccgacggcattaaattttctggtgcaacgtactaggctgtacgattggggaacaaattagtatgggtccatggccatacttttcataatgattttgcagcaaataacttcacacattttttagactaaatttttagtttatctctctctctctttccatgatgaataattgtttttttttgttttgtaattagtttttaccgttctacaaaggagaagcatgataattgacgaattccattaatagtgtcactttcttttatagttgcatcgattcccaatcaacatgaaaaggaattttaagtatataagtgttggtacacaattacaaatcacacacatcagcataacaataacccgcaaaatgaatagaggcaacttgcatgcgtaaatgttacatctcactaatgatgacgttttcttcttcatttttggcacgcaaatcagattaagagacgagtgatcaattggtcatttgaagaattaatcatcctgccgttaggttttctgtcacctcattcagccatcgcgggataaagctagctaggactgattgtgatttccattttttgcgcaacacttaaaagattaataattaatatgggatctaccaggacagcagtaaattcttttttttttactctctctttctttcgaattcttttttttctttaatgacatgcatatgtgtgtgtgtgtgtataaactttttccaaaaaaaatcagttgaatatattcttttggcaaattaattaaaaacgaaaagattaaaaaacttgttcctagggcaacatcactcatatgcctggttaatagtaaaaaacatagcaaaccaatctagctattacctcgtctgtgatttgatcattgagcatattattacagtaaattatctattttattatagaaataaacttaactaatatcttaaaacaagtactacaagtggtttcttcaatgcaatataatgaatatttttaagaaaagtttttttttctaaaaaaatgagtgcagcaggattgcnnnnnnnnnnnnnnnnnnnnnnnnatttcaatgattcaatgaacaatctgaaagaaaaaaaaacaggagaagctagctcatagcttagctagcttgctgcaccatcaatggagatggtttttgtactagaggtgatcagttcattgtggacgtatgcttacctcgtggtggcctttggcggcggcgacatggagcggcgagttgaggttgccgaaggtggtgcaccgagccagcccggggttcgccgccagcagccgctgcgcctccgccgcgtcgccgtccttcgccgccgccgccaacctctccccaagccccacgcagccaagcgaattccccatatatacgcacccccttcttcgccggccgccgtctcaccgacgccggagacgacgacgacgacgacaaccaccaccacaccgagctagctatccagctaattaacttagcttgatttggtagagagatagttaataagctcagctagctcacgccacaaacgtgaagatcagctcagcttagctgggttgttggcaaaagctagtagtactagagctaagctaaccatgtacacaaactacacatccatctcatctcctctcattttgtgtccctcatatatagtgagtgatacatgatctcttaattggtatgtatgtatgtatatcaaggggctaagctggctggagagcctagaagctgggcatgattagtgcattaattatttgtgtgtggcctaatttgcagaaacatccctgtggatctgttgattatgtggtgtagctaggcatcttggttgcctcagaaatgggtacaaatttggatgtgagcttttttttttttgtcacaaatggtagggtagggttgagatcatattcatgtatgccgctgtcacatttttgcattatatgtttgaagtggatttagaggtagtgcccatctgccaaccccctagcattaactactgtagaagctagtacagtcctgtactcgtatgaaccttgaatagggagtttttagattcccaaaagcagttcaaagaaatttacctggtgagaatttagagaaactggagaaaaacagcttctagcttttaatttattttctgcagctatatatagcttctggtgatttaatttgaagagcttctaattctagaaaaagttataacctctataagctcctaaaatagccctatatcaagctagagtactactagttactaatcaatcttggcaacatatgccataacagtcgatcggtaattagcctccttaatttgtctttaatttgatctatctagtgcttcaggcaatttttttcatctgatgggaatttgtcttgtaaataaaaaaacaagattagccttggttagttgtcgcttgacagtacacagaacatgtaaacctcttacagatctaaaggaggaatttcccattgcaaaaattaaagggggaacgtcctaatattaaattcgaaatgtaccctgatcaaataatctagtcaaactaggcaaccacagacctctaagccagctagtaaaaataatctagtggtaacaaagataatgcaatattaccagaatacacgtccatcatgtctcaacaaatttgggcccactatatatctataataattagaaagataacttatttaactagagtccatcgatgagccggagtagaaaaatttggagaagaaattaaccagcaaactcttttatatatagtatcaatgtattccatgtttatcttataaaaataatagaagatgttgttgttattattatcaaaaaagataatagcgactttgaataagacccctcgaaatgaagtcagtgcctccaatggacgtagaggataccaatcaattaatgttataatatctcaaattttgttcaagagcaatggactctcaatctctgattggtttcaaggaattaggtaatcgttaggaaagtagtccaatgcaaaggacatgtcatctcattacaattaatatatatatataacatcatactaataccaaaccccatgcatatatctatacactgatgaatttgcaggcaacagaataaaaggtaatgataacagcatacaacgaaaaaatatatgttgttaaggaaaagcatttcaaatgaacaattgtaatttaacaatcaagtagtaatattactattggatcagaagattgagtcttctatacgatatgtagtttgcattatataaggtatagctgcattttggaatggagcaagtatatagctgtgccgtgaagcagcaatattcgatctcttgtcagaaataggatgtgagaatgagatggactgagttcaaaataaattgttccatccaggacacctacgtaaaaaaaaagcatgaacttgtcatcgtcacaacatacttcctttgctaaaaaaacaacctaagataagaatttggcactacttagaatgatgaatctggataatcttatgtccagattcattgtctttttttaactgatggagtaattattatcgattaaacacctaataaatattttttgtctggggatatatatatctatcgttgatggaatctacatccgtaagctgaaagtaacagaatctagtaggaatctggaagcgtggccacagcaaactcatctctctgaggtgttcgattcttgcaagaaaacaagaaatgctgaaaaattgcttcatccacgccaagtcatcagccttgtcaattttagagaggcatgtgttatccacaagatgaaaccgtttcaattgccctctaaaccctttgcataaaattgtcatttcaacttgattacttgcaaagagctacataattattagtaaggatgtacatatgctaatttggagacaccaacatgttattttggaccggatgattgactaacttatgataattattcgagggtataaatgattaaattttataaagttaaaactagatttaaaatagtcctaaaatttatatacacaaagttttttaaaaagaaaaaaaagtgtcgctttgaaactcgagaagcgtgcgcactcatcgcttaaaaagaaatatttaatattaaactacacttaaaaattcctagcaaaaccactagttaccaaccacatagactttgccaaaaagaaaatcactgtttagagaacctacagaaatcattaatatttaatacaagcttttcccctaacaatgtttcaacttgttagataactaaaagacaacatgcctctatactttatttacatgcaagattcaacacacacaagtacacaactactcaggtagtagccagaaggccaacacatcttacacgtgtaagaaataaaacaaaacggggtgcaaagcggtgtgcacgtagcaggacgccctgcatacgtgtgcgtgattgggtggcgcaaccgaaaacgacctgatccaatgcaacgcaacgtagcaatacgattgcccccacggaatcgcacatcatcactagccggataattactttcgtttacggcagtatcaacactcgcacccacttatgtgccgctgaattatacatgggacccactgctcgtggggcctacacagtgtgataatactccatccgtttcatcgtattataagatgctttgaattttgaacgcaaaacaaatataatatcaatacatatttaatattagatttaatataagtactttggggttgtagatgttgctgtgttttttaatagagtgaattcatgataaaatgataatatgcttttgagaggaatctatgcatatgattttcttttattgatgactaaagttttaacaattttaaaagtttgatgagtcttatcgtaaacattaaatattcaaaatcagagtgagtataagttaacaatgaccggtgactagtgatacaagttccgtgtgtattgcggacttttgggtgatatatctatctgctggttaattgtcagtttgtcactacttctagctcaactgtggtggacgaagcgtcaaagcaaagcatggcgaaaaacgctacaatcaaataaatgtagaggacatcagagaatggcaaacattctccctttttctaagaaagaagaagaagagaaatgtgttccctaaaaaaaaaaggagagaaatgtgaatgaaggatatgataaggataggcaagaaggggtggttggcaggtgagcctggtttaggcagataaaactcccttgttctgaagtgcagatctcagattaatttaggcctattttagaacataggatttattcaaggaatttcgtaggaattaaactgtttcacatgaaattcagtaaaattcctgcatttcaaagatccatcctatattgcgtcggatagcatatgacaaatagacattgattgggtgtaggagtactgtattttctgactgttgataatgtcgtagcctcgtcaaccaagcaggccagtgctgtacctttaacagcagcaatccccaatttcttctgaagacagcaaaacaaaacacaattatgatgttcacttgcataatacttctaccaaaacaccacccataaaaaaaggtacatattattaatttgacggccacattttgtcaaaaccggcgtcggtacatcatccgttcctcatcagcggcgccaaaaaaaataattcagaatcgtcagctgcagcaacgggcagcctaccaggctagcagctgtgccatctttgtttcagaagatacacacacccatttgacgcagcacaagatctgctgctgacacaagtctcactcataatcagtcgtcacatgatattttggccctgcagtctgcagacagctaccaaatttcttgctttcaggcaaaattgacacctgaatctgcatggcggtaaccaccgccaaccactagcaaactatgagcaattttctcatggacttaacagcaaacttttattgctgccaagtgaggatcagaacagtacagtgtacttgaaactgacagaggaacgaattcgtttctagtgaggcagaaacatggacatgcaaaacacattgcatggattctagatgacatcaaaattattagccctggagctattaatgtcaatagtatagtaggatctttcaagcattccatgggtatcaaaaggatccagtcttgtaccgctttccgagataaagaatagcatacaacagaaaagaagcagatatttctaaaaatagctactcgtcctttcaaccgttaatccaacatgaaacatgaaagctgatcaaagggcgttgatcatccgcttcatttctgcggatctccttgggtcaggttctgctatggccctttcagtcaagacatgctttattcgacacattgacttcttcacctgaaatcatgacaagaatcaatgatgcaatgtttcaactactgattgaagaacagaaaagacgccatgaaatatgtttgatatgcaccctgacaagaaattctaagaaaatgttatcttaggaagcaagtcatatccgtagtcacaaaattatctgtaattctgctatggaaattgctttcaggcattccacataactgtctatcgacaatatatggaagggatcatttagtttaagtacaaaaggacagtgcttctggagtcctaacacacaaatagtaggtgtgaagaatttcagttatatgattaaatcactaaaattagcattattcaaggacaaaaaaaaataatgttctaagagaaacaaaattgtgtaacttggatcagttgtggcattggattaactagacatgattatgagagaggccaatgtctgctctgtttctcaatcaaacaagaacaagttgtaattgataaggatattccaataagtaaagttcaaacgttaagaaatgaacagccaaaccaagaagtcaagaaaccttttgatttgcaattagcatattaccgtccacagaataaacaagataacgtctaacaaaaaacatgttgtcgttagattaccatccacagaataaacaagataatatcaacaaaaagcatgatatagttatttgattagtcacaattcttccaaattttgtcccgtattgacctagttacacaaaactgagaacttaaatagtctcagttacttgcatgaggcagggtgttaagatggccgtgcaataccttggaaacacgttcagggtttggaaaacgcatattctctgaatgtagcatctggcgctgactcataagcatgttcttttccttcagaaggacataccatagcttctgaaggtcatcccaggattttaggcgtaactcggaagccttccaactacggcctgccaattaataaaaagaaaaggcggcactgataagctttcttgacaaagatcattggataattttatttgatcataacagagaacttcatacctaaacacctggattaaatgcaaagtgctagggctatgacatgaccataaagaagcaccgacatgttaataactatgtccttgtcaagcacagtatcaaagcaacacttcaggcttctagcattggcttagtgcatcagaagaaacccaaaaactagatgtcaacatgcaagaaaaacatttgcaaactaaccatagtaaattattaattctgatcggtaagctttaaaattcctaatatatcattcttctgatagctgtaccatatgtacgtgtacctaggcttgctaatggattcaatgggctggatttcagtgtgggttggctttcggtgggtggaaatggattgatgcagctaatggataggggtggattggatggagatgcagaacggttttgattgcattggttttggttaggaaagtattggattggttttggttaggaaagttcagatagaaagtggattcagcccatgggcatccattggattgtgcccaaatcccgttcgtcttcctgcgacactggcaggtgaaagccacggcgccgccaccactgtgctcaacgccaccggtggctcaacacattcctctccacctcctgcacccttctgcgccaccagtcattgccggcggcggcaggagtacgacagggagatcaccatggttcatcatcatcacttcgttgccgtccacttcgccagtgccgccacagcaccccaccggctcatcatcatcacctcgcgccgctcccgccggcatcggtgacctcttcccagcatgcgggcctgctcggctggctgttcgcgctcggcgcggcgccactgctggtggggagcgcggcatcggctgtcactggtggaccagtaacagcaaagacgttttcgcctctgctctggctcaccgggctgttggacagcagcaataatgtggtgacatgcaagctgacggtcagcagcggggctcccatgtggccggagttctcagcaacagcgacagcggcaccggtggtcagcctgatgcgtggaggagggtctcagcaaccacagcttttgtgatactgcagtggatatatacgcatccaagcatggtgtccaatgcatggtgcatgccaccatggttttcccagggacagttgaatcaaggattggacactgcggttccagtccatggatttagaatggattgaacccactttactagaatggtatggactggtttggtttgaaaatgttcatggattggattggtttggagcttgaagaaggagaagtggtctgggttggtttggttggggcaataatggattggatttcaacccattagcacccctatgtgtaccgacagaagcacttaagaacacatacaatctaccactggcatcaacagaatgtatctggagatgcctggtttctggctttacaaagaccaagacagaagattcatacacagatcatcgtaagccgtctatatagaccctggtatacgaaatcattaattttcttaaaaggaaaactcggctctatgcttgaccagcaggtccaaaaattgtgctattattttcgttaatctggattacaatcatgagcaatacaatgtaatggcatgctctctaacagaaccagttgttctgtgcttccagagccttttccactaactattaacacaatgaaattcccaaccataagacattttagagccgactcgttgcgaatttcgcaaaccacacgcaaacaaaacaaaacaaaataaaatatctagtggagatgtagaacgtgtgaatgattatataggaaggaaaaatgggaggtatggataccgtagtgcggagggggcttgtcttcctcggtgctcctctcgacctcgaagaactcctccagtgggttttgcgccttcctcaccaccgcggcggccgcggcggtggcatcagatgcggcggcggaggaggaggagaagagccgcctccccagcgccctcgacaaggacagcatcacgacggcgacgaccgacggatccgcagattgggacgcgcgaaaacttggtccgacgagaggaaaggtcagcgagataccggcggcggcggcgatgatccacgggaggggagggtttagatgcgaaagggtttttgcgtggatttggtcggggaaatttacggttgggttggggattttgctacctaggaggctgacagttcgggcccacctgtctgtctatgtgctgtacagttcaggcccaaattttctcaaatgagcaaatttgtggtttggattgaagctattttttgactatttcaatagtgtactgtatggattttttgtttggttccaaattttacctaggctagtacgaattctcaaatttgatagtgtcaaaaccggaactgggctttgacacaaccaataattttgtttgattccgaagagtcatcctatatatcaaaaacaaaattcatttaaatttctactgttacatcaaaacaagccattgcgatggatttgtagtatggtaccatgtcatgaaaatttagagatgtgttctttggagtggattgggaactgatcccatgcacagaaaacaaaacagattagttcatggctgattaagtattagttaaaacaatttaagaatgaattaatataattttttaaacaactttcctataacttagtttagaaaaaaatacagtttaacagtttggaaaccgtgcgaacaaaaaacgtaagttgggaacatccaaaaatgaaatcagccttagaaaggcgactttgaggagctttaaatgacaacatttcaagttgccaacacaagttcaacgagaagagctccaaaaactcaggccacaagagatacataaacatatgtgataaatttctcaccaacaaaattgtgaggcacttgtcctctcatgaatctcactatgctagctgcctagctctcgcctaaaacacgttacatgaaaggaaaccttttaaggtgaccttgtaaattacaatgtgtgtaccagaacgctgccaattgtaacctcactgtcgaaagaagacaatgacgattt

SEQ ID NO: 48378 - DNA, 1023 bp, Oryza sativa
tctgcccctccctctgcctctgcctgtgcctcctctcctaccaccaccacctcctcctccaccttttccaccaccaccacctcctcctctcccacgacctcctcctcctcctcttcctcttcctctgccacggcttccaccgaacaaatagtactcggctttgccttgtttcaagcccagggattgcacacctctcctcttgaaatccttgggctcttcgtcatcagattcttcggtgcgccttcttgagcctctagcgatgaatgagattttgcgtgaaccaccaggtccatactttacctcataaagggcatggagttccgctgcctctccagagcagctaccctatcgccaataggtatagcatcctcattggcaagggaggtgctattcaaaaatgcctcagcgtgacggtcatccttgacttcatacaacctgcacggtggagagcagttggcataactccaatgcgccacaagaaaagcatcctcgggaaatagaacgaatagccccctcactaatctaaaaatgaaatgaatggatgtggccagaagccagatccctctataggatagatagaatgcagcttaactcatgtaattatgcacgttggcattgcttaaaaccagtaagcatgtgcctattactcaatcatcaacctaaccaaccgaggccattgcaaacgatttttttataaaaaaaagaatcaaataatggtaaatgcgcaatttaacctaaccaactcaccttatacgctttgaactttgcatgccattgtcactgtcagactctgctgatgcatcagatgaactagcatcttcttgttcctcatcatcactaacagtctcaaaatgttcctcaattagacgaggctccttcaaagatgtttgaggatgaagtgcaagatattctcttgattgttcatcaatttcaaagtcctgcccacgtgattaatgggattagaaaaccagattagcttaaaaaatataacatatggtcaaaaggcacagctgagacatgact

SEQ ID NO: 48379 - DNA, 1716 bp, Oryza sativa
tgggccgggacaaggtggattgcataccttattttcaaacatttctttgaaacgaggatcagtccactatgccttggtcatttccaggttctttttcttcttcttgatgcccgaattttcatccttctccaaatcagcatccatttcctcttcctctttaaggatattatccattatttggccggtaacccttggtattttccccacctggctgctgaaggtaaaaaagggccaccttccttaaaggggatggtccggacctggtaccatgtatccagccaaggacccctttttaagggcagacaaaccggtattgcaaaatttctccggttctccaatttcttttggttaaccctctcttggatattctcaggatccacagcactagtagctagtaggtggaaagaaatgaaaatgttagtaaagagcatgttcaatgtattcgttcctgccacccaaccccacatacaaaaattccaatataggcaggccatttttatattcaactctaaggtcagatggctttagatgggatatacataatgacaaaaaaaaactggtccacaaaagagtcttcatgttactagagaggttgactgcaaccatcctacagcagcatgaattcacttagatgtccacgaaaacagtttaccttcttatatagctgaagtttcatcacatatccatgcatatgcgctctcacaagaccctgatcaatgtacttagagagatcatatcgatccatctcatcttttgttaaaaacttgaaatcttcatatacaatattctctgtcttctcttccatttcttcctgttcaggagaaattcatagttggtagtgtcagcaaggtttattagaactagaaaaatagtgaaaattattcactcaccgttagattatcaagatgcgagcaccactttggagcagggcccaatgcaggaataaagtgggcagggatctggctattgtccaaagctaataacatcaaaccactgttccggaaaacacaaacatcattgatagtaccaccatctggttcaatgctagtcatgttatttccctgtagaaaagggtaaggccatcatccaacaaagttaatgccttccaggaaaaaatgaagcctgcactttccaaagaaagaaaaatggaagaactcactgtattaggatcccaaactctcactatatgcttgtcagcagtaatcagcttaggttcagtagaattaagtgtctggtgccacttaatacttaatattgggctaccatacctgcaataacagcaagtacatgataatatattatccaatgcaggaacatttcagctattggctaccacggctcaatcccccaccagcagcacctttgcttttataagataagatgatcctgacttggagccaagagaataactttttgaaaaactaggtggggttcacaataagattttcatagagaatcacatctagtaagagtatctcattttctccaaaagtccttatagctttgacatgtactaaaggaatatggtttatgatgaaagcatgaaaccttttctttttaaaagaaaagataccgaacttacatatgatccttaactcgcaaaggggaagacatacgtagatcatatattgctacctgcagaaaatcccaaacatttaagactaaaaaatgataaacaaaaatcgtcatttttacagattgggttgtccatgaaca

SEQ ID NO: 48380 - DNA, 24944 bp, Oryza sativa
  unsure (1)..(24944): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaacaacatgtagggtttggactttgcaaccgtgttatcgttgtcgagcttgccgccaaagcgacacaacagctccgactttaccagcaaccgcttgttatattgataagttaattgatggtaaaatttctatagcaaatactagttatattaaaatttgttcggactcaaaattctttctgactccatcactgcgagtagcgtggcggatccaccccgcgcgtgactgcctctgtgtttgtatgtcagtatgtgttatccttagcctttggttggttcagcgagacgggcacgctggcctcctcctccggtttgcttgcaaacttctatcgtgacacaacacacaggaacggctgctacttgactttgctttgcagcgatttttttgactcgttttttagtactgtagtactccagaaaatttgtcatggctgttgctcacggatgagatgactcttcttatgaagttatgattgattttttttcttcttcacacatattgaactgatcttaggtatggtttagttcctaactttttcttcaaactttcaactttttcatcacatcagaactttcctactcacataaacttttaacttttctgtcacatcgtttcaatttcaatcaaacttctaattttatcgtgaactaaacacacccttaaataaaagggagactgaagatatctgggggcaaggaaagctggttaaagggcgagaggtttggataggaaattcttcttgctgtcagtcagtacggcagcatacatacgtcttctttttctctttctttacaaaaaggagacgaggaaaacacttcagtacacaagcatattgcgtgcctacgcttctcctactttacccctcttttcctcgtgttctcagcaaaagtctaaataacacgagtttcttcctttcggcgcacccgtcttcttcctgttttttttttaaaaaaaaaaagaaaagaaaaagaagaagaggaggaaaatctgccggaccacacgtgggctttaaacaaacaaaagcgttgtgcaaatctagcccagcaatatccttctggcccattacttctgaaccaaaacacagaggccaatctctgggcctctgaatctccgaccagcccaactccaccacaacagcaacgccgccgagtcgccgacgacgccttttggtgctcgcggcggccgatgtaacgagcggttttagagaaagaaaccatgggcaagaacacacgacttcgccccgcgccatccaccatcttcttcttcgccgacgtctcggccggggccttcccttcgtcgctctctctatctctctctgctgctgcacagaaacagctcgtcgtctgcatgcgtgtctggctctctgtgtcgcgttaactgcgtgcatcgatatctgtcacctgataactcaatgcacctggcaatggccacgcggcgccaactgctattactccgtccagcctaaaataacaacttgtattctctaaagtttattttaaaatataacaacttctacactaacattcttttctcaaacaatcaggtaatcacaaccctctaccattcaattttttcacatacatctacttctcatccaaacacaattctttcctatttaattctaattactttcttaataactgtgtccaactttaaaaatacttatattatgggataaatgaaattattccatatttaattttaactactttcttaataaccgtgttcaacttaaaagttaattatattttgagacgaatggagcagagtaacttgtactacctctgtttttcaatagatgacaccgttgactttttctcacatgttcgtcttattcaaaaaatttacgtaattataatttattttgttatgagttgttttatcactcatagtaatttaagtgtgatttatatcttatacatttgcataaaatttttgaataagataaatagtcaaatatgttaaaaaaagtcaacggtatcatctgttatcaatgaatctgaacgtgagaaatttgttctttataggacagatgtttcacaaggctggtccgctggtgtgctcatgatgatcatgcatgcgcagcaacagcacaggtagcgggcacgtctcatgaatgccgcgaggagtacagccactgttgctacgtgtactcttctcctctacttttgttttatactccaacaacgcagcactggagtaaatgcgagggcacgtctcaggaggatgcatgctgctgcgtgtacactttgcgcgtgctactgcgacaactacggttgccggccggccggccggccacccgcggccgctacaggacgcaggtgagggtggtcctcatagctagattggccatacatggcatcacactcaattcaacacgggacaacactaattgtttttcagctagcggaaatttaggccctcttcgattcactgaaaaattataagaatttcgtttctataggaattttcttatatggattttaaaatcagaagaatgaatattatggaatcctacagaatatctcattccatacaagttttaaagtaaatttaacatgaggtataatctctagaaagctttccgtcgagtctttatgtctactcaaatttatatgtttttcatgtggttaaatcagacaaacattcttatgtttttttatgtgttctacaatcatttattttacacttgaattactgttagaatcctgtgtttttttatatgcttttccattattgcgattcaaaatatgtcattaaactataaaactcgtttagaattgatgctgatgttcttttttgttataatttatttttcagcattgtttttgtaagttgtgagtcgtgaccatagcagctacactacatggcatcacactcaactgaaacaggacaaaactaaagcagacgacactccaaataccaccgccgttcctgcatccattttgaacggacaaatttcaggctgcatctgcaattccgcacccatccactactccctggaaaaaagaaaagaaaaccttttctgctctgaaactcgtgtgaagcttctgtcttccaagcaaagtgtgaagcatagcgattcgaatttttttgaacccaaattcggttcaaaaattaaatataaatcacagcaatcaaggaacagcacggatctcgatgcgcacactggacgccgagtgagatacgctacgccctgcggatggacggacgcctgtactgtatgtagtagtagaatggaacccgacaagagctgctctctcacaacatcggatacccacgcgcggtttccgaggcacacgccaaagtacggttttgccccccgcgaataactgcacgggcctctggttttttccttacggagcgaagggtagaatcgggaacagaaaaatatttgttgcgctccggggcgaaacgaggcgacgactcgccgattacgtgcgcgtgggacccacccaaaaggctcacagcgctctcgcaacatttgcagatgacaccctgaaaaattctcctaatcccctccatgttcaaccttacgcttttttagtacggggaggtgaatgtgatgaagtgcagggggtgatttgtaaatgctgccggggtcaaatccggcactggcccgatttcttccggtcccgaccccgcatttcaaatttcctcctccgccttctcctcctcgtctccggccaccgttaaatacctcgccgccgaccaccaccaccgcggcggccctgaccccaccctgcgagccctagccatggacggcgacgacgaggatatgcgcgacgtctcgtccacgtcgtcctcctcctgcggcggaggggagggcgcggggttcgaggaggggatgggggagggggtgatggtgatggaggtgaggtggttcgaggtggacctggagtacgagttcgacgcgcccaggtggttcgacctcgccgtggaggagtcgccggtggaggcggcggcggcgcagctgtggttcgcctccgcgcccagctacccgccctctcgtgcgtgcccatccatccctacacctcttaatttattgtgatgtttttctgcatggcggggatgattcgggaaggggggttgggtccttggggatgggatttagttcgatcgatcgattcgcggttgaaatcgtcgatttagtatgtgcgccattggtgggatttctattatgcagtgtgttctcccttgcattattgatccgagaaaggaggtttgggagtccctaatttcgaagtgcttctaggggcagcatgcacatgaattttctgaaatactcccaacattttcagaccagcatgattcaatagagtgtgaaatggttgagtgtcatcaattcgggtcagcattgatcacttagatggatgagggatgcatttaacagagattttcctgtttctaattgtgtaatttggcctcgatgttaaagtttgattgtcaaccgcaatgagtccattttcctgataataaatgaagaagaaaaagctatgctgttctcaaggaaaactgatgttcttgagatgttaatggtagagaaggcacccacaggtatccaggcccatagcaaaaaggaatgtatgatgtagcaaggcaatggccattggccttttaggtttctttcatgagcatccacaactaagagacatcttggaacatgtgactgcaacaaacagactttggttagttgcaactaatttggtgtattcaccctaaaactttgacaactaatgctagatataaattgtaagctggtagagttatgtttgttagtatatactttcctggtatttctggtcttctggaattgattaaatttacatgtgttacaaacccaaaatgatatgggaggtgaaagtgaaatatcatccttggttgtatgcatcaatttttggacaaaactacgatggatagttcattgttttactactcaagccttttctattatcattaatatgtaagtacaaatatttttttggttatttctgtagttttaatgtttagctcatgacaaagatagaactatcatattacatgacagggaaacttatggttacaacactagcaaggtagcataaaaaacagtaacaagaagtgaataaaatatgtactactactataatgacacttgtttgattatttgacctgtatgaattatggaaacgttagatgttatttttacagtttaactcgctattgaactgtcattacattcatttttcctttttaattggttattgccctttgttgtcaacttaatatgactgaaattttctctgttgtttctgcagccttaattgccaagatgttggctgaagatcttgggttgcaaagtttaagaagcactgtggatatagatgcagcacattgctctaaatcctctcatgaatgttccaatggtgctgaacaaacgatccatcggccacatataccaaatgaaggtccctataagcccaaagttttctccattatgttttttcctattgcatttcttaccatatttgagcatttcatttagcctgttatgctttgatcttttacccagcttcttttatgtaaaataggaaggataccttgccatcaagtttcagcgaacgagcgaaaacatggcgttcgaactattggaaaaggaactatcccaaagaggtctacactgatgaagcctacagccagtcaattagccaggcaaaacagacaaattgaagtgaagaactccacacagtatgtaaatgttatgccttatgctaattcatattctttagctgtcctagggttggtacatacaaaatttggagtattattctctgttggatgattttataacaattttctgattttgaagagatgcatttaccctgccatacttgcagttccatgaacatgtgtttcttgttggtttactcacctgccattcttgatgaattaaccatccactagcattgatcttaaccgtttatgtcagtatatgcttgtgtagccatcacgtttttctctttcacttcattatttccggactttcaccacctttccttttgttttagatttgcactgcaaggatttttcaatacatttaaagcaaatgctgttttcatgtttttgaacttatgtaccaatttgctttactatcaggagtaaaaagtcggttggggtgagaagtgatagaagtaccatgagctccaatgactgcacctaccaagctgctaaaaggcagagactagaaagagggcatctcaacaaggtattttgctgttttttattttctggggggtatgaccaccccaaattatctggtgaagttgtttcttaactgtaaaacacagtgaagtttgtcggtacagttttaacttgaaataccacataattttggtagggcatttacctttagttttgagattgcatactagaaactagattatatttgtctggattaatcgagaatacttaattgactacagtcatggttctcatggcaactgacaatggcagctaattttttctgttagcatcgccaaagtaatagccacaaaaccatttatactgttttttcactacagagtgatcagtgcctatttgatattgatttgttgcataactagtcactgaagcttctttacttattgcacaggttgtttcaactaatcaacctgagttgatccataagaatcatgcaaaggtcaagacacctcaaacatttacttctctctcatttcctaggaatatttcagctgttccatttcaattctatagaaaaaattagaaaattatttggactttttatactatagtttttcttaaagtgcttgacatactcctgcaactagccaatcatagctgttatactatgcattaacaattagggatgcaagcgggccgacccgcaagttcacttataggtcaaataaatgataattcatgggttttcgcgtcgtggtccggtttgccgcatctagatatgcaagtggatcgatccataaatccatttataggtcaaattaataggtaacccgctggtcaaacccgcgggttacgtactaattttgcctataagcgggttcgcggacaagcccacttgcacccctattaacaatctctaatatagaatataccttttatgatacaaaacatgctcatcgtgcaagtttatacatgatttctctgaggctgtgcctcaaattttgcttgacgatgctttctcatggttgacacagaatgttatgactagtagctctgatcatgccattgctgtaccaaaattgaagattacaattcccagagaacctgaattggcaacaaagctaagagcagagaggtcaaggatactcagagcagtgtaaagtcattttctctcgctctcctgtttgcctgaatgtcaagtactttaggcagctcatgtccttttcttgaaatttcaggccaactaattcaaagcagctaaacaaacaggcggcacaatccatttctatgacacaagcgtcatcgattagaaaggtggattacattactgttgggtttttgcagcttgttctggttgtcttcactaactattaaaaaataaagtaggttactcacacttacatacatgagcgagccctgccagacaatatgtatgactcattctatggttttcaatttttggaggatggcaatactcagtttgtttgatagagttccctaatctcaaagaattttagaagacggtggcacctgtgaggccacagaaatattcatagcagagatgtacatgtcaagatctcaagagaatgttgcttttttaatgtataatagcacagcgtcttggtggctgatagtgtaactgtaactgtgacagttcagaaatggtttcatttatgttttgtccaaagaaacaaataatttgtagaaatatttagaaaaaaaacattcagttcaatcagtgaaagtcatacacatagtttttaaatcatcttttccaatttattatgtgcccttgtacactattctggatctaattgcatggttgaagctgttctgtttactgctattttctgccctcaaagttgaatcattgtcctgtactaggacaggcacctctacatttagatggttaacttttaatttgcactatataatctttattctctgtgaataggttgaaacgacttatcatatacacactatccatgcctactaaaaacttggttctctggcaggttgtgcaaccttctgggcgcaatgatcatcagcatgcaagtgttccacatcgcggtattgggtcaaatgtgccagtgtgtactgctaatcgtccaaggcatcttgacaagtaaggcttgttttttatatacctcctcacttctagtcccattactatttacataatatccatcctattcggcagtacaaaggaaagtaaaatatacctcctactattctcttgtaagtatttcctgtaattttctagttttggtcaggacaggtttcttcatggaaccaaataatgcaatagtaaagactgttatgcttttgattctacccagtacctatgattttcccaaggcagtgaaacttcagaatgatgtgatcttctgtaaatagagctgaacttgtggctattttctgtgctctgttaacagcatttgcaaaacgccggatgagtgcagagatgacctgtttaaatttaaagctcgaccagtggataaaaaggttggtgctgtggatggatcttctatgcttgctttgaatcttttagttcatactgctctggacctgtttatctttgaagtttgaaccctagtttccaatggcctggatagcgcctagttgtattgattgatatacctgttgcaatttcatgttctgggtgtcagtggccctacttttataatacagataggaattaattgctgaatatgcagttgcttaagaaacaaccctacagacagaatataggaaagttctagtttcacatatttgattaactgcaaatgcagccattgaatcttacattttctttgccttggaacagatactaggaagcaaaggagatattggtgtatttcaaaatgccaaaaggagcacaacagttcctaaggttctctctttctctgtgtgtgtgtgtgttgtggtttgttataaattcctcactcatatttcttgcttgaaaatcctaggaatttaagttgtcaactggtaggaagggtaagcaggctccattatctgaactcttcaacaaggtacgtactgatagaacagaaactgattgcccttactccttagattatttgctctgatgtttactcgtattatttttgaagctcactttaactactgaagcacgccgtgctttagatcaccggactgctgatcttccaaattatattaccaccaaggttctttccttgtttcaatttagcttgtttttactcccttgcgcctttaaacaaagtaactaaaatatcactcctaatctaatgcaaggactgcaaagagaacatgattggtaacatgcaaagctagctatggtaggtaagtaatatttcactgccatacggggcatttatcatgtcgcttctcaagttagaaacaagtgcatcacacccttccacattttaccatttttcagatccagtcagtcaagacatacaaaacataggaattcttctctttgacaattcctggttcagattccttttctccacctgaacaaaggtaaacgttaactcctaatatttcaggtttcatgattcgcaatttcgcacagtgcatcatgtcatttcacaccctggcaactttccattatttttcagcaatacatttgggtattttcatgacactgatacttggggtgaactactgcattgacattgctctctactaccatgtaggctaagcgtctgttttggacagtaggatctcgacttcatttgagttttgacaaagatggagcgatacattattttgacttgaaggcaccgaccaaggcaccgtcccggccatccccggcaacctcccgtctccgctgccgtgcagctgaacataattccgtacctgctcgcggccatggcggagatcgatttgtacagagaaactaaccatgacgccggtgtgtactccagatctgtaacttgttgccaatcatcatccagcaaagttgcttgcttgcttctctctccttgcatcgttcaaattactgggaaaacaatgttagccaggaaccatggagatatagtcacagagatactaactccatgggacccgtagctctgaattctgatgctggtcgggcaaagacgggcatacaggcttgtccaaccagaaaaatactgtggcatggtcagggtgagcacctgatggctgatgacctgacctgacctacatagagtagatgccatggcagtggtgtcacggtgtacgtgtgagccaaactgtacatgtcaaacaagtgtagccatcatactggagtagcatgggatcagaacggctcaggcatctcatctcaacaaaagttagctgctgctgctgctgttgctgtggctgcgtgttggcacgtcgcgtcgaccggggccaggccggctaaagcatggaagggacatttgctcgcagatctgccattgactagcagacgatgatgcacggaatggtcaggacgccctggccgtggaggacactaggacggcttgcgttttgacgccccaataggagttcacagtccagtccagtttctgctagaacctgtgacagattcaacatcatttgacgaaaaccaatcaaaaaccacggaatttcgaggttccaacgcaggacgaaagtagattccgggtgaaatgtcgaatggtttttgagaattcaaatttgaaatggttaaattcaaatgaaatttattcaaaatttgcagaaaaatgcaatctcgttgggggctgggatccagcactcaatccaaaaggtgaaccctagtcctagccgagaagattgctactgctaggaagggttaacgtctcgacgaatttctaacatcttttgagctggctcgaaatgtgcatatcgaatggttttgttcaaaattttctgaaattcattcaaaattaatggaaaattgatgtcttgaaggggctcgggaattcgctagccaatcaagatcataaacccttagcctaggaaacaagtaaaaggacaaggaattggattactgttctttcaatgcaaaagttaacagtgacatgcctaggagtggatacaggcagcagctatgaatatcattcaacagtaagagcagccagccagctacactccatgtctgatgaacagacacagcaacgagccaacgaagcaggacataaatactaggcatggagattcagagtttcagaggcagcagcagcagcagcagcagcagcaaacagacgtacactaacagcacagcaagagtgaggcagagcaactaataaataccgtcaaaaaaagggcatttacattagcacaatcctgtcgatgcaggaatgcatggtttcaattcaatgcggcgtcgtcacacaccccaggatccaagaactgatggcctccctctgcctctctgatcaaaatatattacatcataaagacggcgacttcatggcgctcacgagacatctctgaacctgacactgatctactcactctctcttgaataccatgaacaacactagtatgtcactgcaaattcctagggacaatctttgggcaatcctagatcaacaccaagaagaagaaagagtcaagaacaatggcattaacatcatcatcatggtcatctaacttcagatcctacatctagctactatttcctgcactgtgctactatccttttagcatcttggggaggagaaaattttggaggtttggagaagatcacattgtgtgcttggatatgacctcgccgaacctgacgaaccactgctcgtcggaggagctgttgtcgccgatgtcggtcacgtcgtgccctcgcatgtcggccgccgtcgtcgtcgacgccagcaaccgggagtagtccaccgtcttgggcgttgtcatggcggaggccggcagcagggagagcagcacccttgcaacctcgtgcatggtcggccggtctgaagggtgcctcttggtgcacagaagggcgagctggaaggccttcctgaccagtcccatgtccgtgcacgtcactgacacctccgagtccactgcctccatgactgtgttgtcatcagctttggagagtatctgaacattgacacaagatcttgtcatacaaatcatccattggatcatgctagaaaagttctagaattggtgataattttgcacaatgtgatgagaggatggagtggaactgtggaagtggggtggcttaccaattgatgcaagttcgattcgttgtcgacggccttcttccctgtgagcaattccagaaggacgatgccgaagctgtacacatcagatttctcattgagcctggaagtcctggcatactccggatcaatgtagccgatggttcctagcacataagtggaggcatgggacttggcagaggggacacatttggctatgccgaaatctgagaggtgcgcttcgaagttctcgtcgagcaggatgttggaggacttgacatctctgtggattatgcgagggttgcagtcatggtggagataggccagcccttgtgcagctccgaccgcgatcctcagtcttgtgtcccagttgagcttcactttctttgatggacctgaaaaggatcatatatagatcataagggagatgcataatgataacaaattatccatgagccaaaggtttcaagccctaaccgtggagaagatcccacaaggaaccattttccatgtaatcatagaagagcaagtttccatgtggagatagcgagaagccatggaggctaacaagattcctgtgccgtatgctgccaattgtctctagttctgtttcaaactctcggaggctatggttatactgactgtaaagccgcttgacagcaatggccttgccgctcttgagttcacatttgtagacagtgcttgaggcgccatagccaatgatgtatttctcgctcaaattctctgtcagcctcatgatgtcctcgtaagtatggatagccatgtccatctggagaacaactagctttggaggtcctgaatatgattaagaaaaggttaagatgaattccattatgccagcatacttgctgttaatttcatcgacgacaactggaggggtgagatatagcgcacacataccttgcactggcttatcggatcctttgacaagtggctgtggttgatttgttttatatatagccaacagcagaacgcagagcaatatgataaagcctaagataatgcaagcaattgctgtctttgaaatattaactgcaatagaaattaagtgaacatgtgtttagcagaaaagcaaatggagtgaaaagctacaaggggttagcttcttgtctgatacctctttgtccatgagagtgtccacagctggaatcttggcagtaaacatgcagtaatggattacccaagaagctgcatttatgatttatgtactggttgcaatcagaaattagaagatgctaatagaaggataacagagattgtgcatggtgccatcttatacctttccattgggaatttcgagaagttctttgccatcgggacatgtccagataaattgttgtatgacaaattcctgaaatgcacttaaggataaataatcctgcccaagttatcaccagtatacaatgctacagagcagagcttgcacacaaaacttacaggttatttaagctgaagcagttggccaattgagcagggatctccccaaccaaattgttgttgttaagaatcctgcatgataacaccatagctcagtaaaatatttaggtgattttcgatctcacacgcataatatgaatttatgatgatatacaactcacaggctatcaaggttttgaagttgtccaagttcctcgggcagactaccagataagttgttgttggacatatcactgagaatttaaattttggttcagctgaatcatgatgataggatggcttcaaacagataatagttagttacatgtgtttcaagggaacacacttacattacttggacgcttctcaagtttccaaactcagcaggaactggcccatcaagatggttcttactcaaattcctgcagtcaaagcataaccatttaggcatcaagtaataatggccatatgaaataagttatggttttttcattaaaaacagtatggtttctaggaggttggtccgcaacatacagttcaagaaggtgctctagatcaccaatggtagcaggaactggtccagagaattcattgtaggaaagatccctgttcaaaaaataataataaaggaacatcatttagcgcccacaggtcttgtaacaccaggtaaataattatagctaaagtttctacttacaatgtgtccaagttgatgatgtgaccaagctcagaaggaatattgcctttgaaattgtttgaagataggttcctgtattttttaaatgtatttttaagcaagaaaaacattaggtgaactacaataatttcgccgagtgaattaaatgattactgtaagcataatgcaacagatacaattactcacaagtaagtcagactctccaacttctggaaaccagcaggaatagaaccatttagcttattgccataaacattgctgagaggcaaaaaaaaaacatgtttaatcatgtggagtaaaaaatgccctgttaacttataagttgacttagtaccggctaacttacaatttgtttagagcagtgcaagaactgatgtttgcaggaataggaccttgaagattgttgttggcaagatttctgcatgcaaaatttggtcaacaattgcacagaataaaataaagcatactacgtaactcatagacatgataaaatttcttacagttcaaaaagctcttcaagtttgccaagctctgctggaattgtgcccaccaattcattatcattcagttgtctgcatggaaaaatttctgaacatcttatagtgttccacaccaactggagcacaacaatatctgcataccatataatcacttacaggtagctaagtttactcatgttcccaagctccggcggtatgactccagtaagtttgttcccatgtaaatatctgaaggaaaaggtgacagtaggtgttagagaagagaagaaagcaatctcagtgaaaaagaaagtctgactgatgatactaacagttttccagtataggatagattgcccagtatagaaggaatgggccctaccagctcgttctcactcaggtctctgagaataaaaaaaatgaatataagaattcattatccaatattacagaaactactgaatttcagtcaaaaaaatattacagaaactactaaaacctatggattgaaatgtcgtgctctactcacagaacagcaagagcttgcatcaggccaatcacatctggaattttcccagtcagtctatttccttgaagtgacctatgaacatgaatagaaatggttcaacataaaggctgtaagtaaagcatctatatgcataagagtgaaacagcagattacatgttagaggatttgcaataactcaggaacacttacagtgtggctacttgaagaaagcctatgttgtaaggtatttctccagagatttggttatacgaaatgtccctgcaatacaaataagaaactcgcattatggtgtctgaaactcatgaacactgaaatattactgaaatcttagcaagaacatacagaatctcaaagctggtgcagttccctatgctctctggaatggtccctgtgagattgtttccccttacatcactgtagattaagaacagtaaccactgtcaacaaggccaagttgcacaatatgcagcaacatctccaaagggagaggagatgacttacaagtaccacaggccagtcagttggcacatgtcaggtgacaaagttccagtcagtgagttacccctcaaacctctgaagattaagagaagcaaagtgttaatgcctgaaaaataccttcttatactaccagctaaaacagttagacaattttcttttataggattcttacaggtattgcagaacttcattccagtatatgagccttgggatatcgcctgtaagctggttctgtgccaggtccctattccaagataattaaggaaggattttatcagtaagtaagaactagtagtacttaagatgcaaaaaatgacacagcaagccatgtttcccgtggcacgcacattataacacaaaaacagttaaacaagtagaagtcagatcacccagtttgtccaagaaccccaaagaagtaaatagtcacggatagagtaaggtactaagaggctcacaatgtcttgagatttggaatttgggacaatgtggaagggatgggtcccgtgagctggttgttcttcaaaatcctgcatcaataaatgagagagaaaaaatgttaccactacaacccaagcatcgcaaaaccatgaaaaaaactactactactccaacaagatgttcagtatcataatctggattctagaacaagatgttccaaaacttaatgtaaatcaattagtctctgatgtctcagtattagcctgaactttccaaagaagggagaggaagtgcccatatctcaacagctataggccatagctcttgctaaagaaaaggtaggaaaagatttaaaaaaagtagagcttacagctcctcaagctgcttgagcttggagatggagaaggggatgtctccatacagcaagttgccagacaaatccctgcatggcaagaatcaaaagagcccaattaaaaaattagctagaacaccctgttacaaaaagtaacagaataaaagaagacttagattaggtgaagtacaaatattttaaggagatgcagtccccaatctcatctgggatttggccagtgagcttgttccccttgagatcactgcagagaggcaaatcattagagcacaaataaactaatcagcgagcaaatccacaggcttaaagtaaaatagtaaagaactgtgtcacatcatggcatgaggggtcaaatcaggtgaagtgtgcaggattataaaaagaaaatacaggctagtcaaatgcacaaaaactcaggtagatgcaaagcaaggggaaatagtactctctactcatatccgtactcacacgaactgtagattcttgagctctccgatggccggcgagatctcacctcctaggtttagatttgacaagttcctgtttttcacacagggaaacactctcatcacaaaaatcctttttagcataacaaacaagatagcctcactaatatccaaagacctacgcaagataacaagaaaaacccgtttcttttccattagatatatacgataacaacaagattatcaagaagaaacattcacagcaatctaggcacaaatagaccaaccaagaaaaggtttttattcagaaaaaaaagggaggcaagaatagaacagaacagttgaactatttgctcctcctgatcagaatgccagagcgagcacggcaagagagaaaaatcacatgaagcacagagtgcacgctggaaaaagaaaagaaaagaaaaaaccaacagccaccacaagagaagattgcaagaacaagaacgcaaccacccgcgccgccgcgcgccatgtctgcccaggaaagaacaccgagcttcgcagggaggaggacgtacagggcgaggacggcgaaggaggcgttgtcgcaggtgacgccgcgccacgcgcagtggtcggcgccgccgtcccagtcgacgagcgcgttggccgcgttcccgaaaccggccttcacgcccatcagcgccttcccctccccatctccccctcctcctcctccggaggccgcctccgccaccgccacaccaacaaccaccaccacccaccaccacagccacggcgccctcgccgccgccattgatccaagaaccaccaccacctagcttattccctctcaagccgctcctcctcccccctttcagggcactcgcactcgttgtgtcactagtgcatcgaccctggccgagttaccaccaccaccacgaccaccatggctctctctctctttctctgagctctgatcgatcgatgggggggagcaatggtgttttgtgggggtggtgccgatagcgacgtgactgttgttgctttcgggaggcagccgctgcactgcactgcaccgcagcacgcagcagcaaccaagagagagaaagaggagagagaagagagagagaggggctcactgtgtgggtgtctgagctgagctgagctggtgccatggtggtggtggcaggagagagaaagaggaggaggaggaggaaggctgacaaagtggggcccacctcgtcagtgagtggacccggtgggtaggggggtacgtgtaggcgtaggggcccgtggcttccagtttttttcaaaaaatctctctaccacggttggctggctgcttgatgagtcgatgacatgtgggcccgggtcggcttgggcgatcacatgtcagtgggtgtgggcccacatgtcagtgtatcggtggacgagggggtttaagctaggcgggtttagaggaggcgcgcgaaaaattaaacgcgatttggtttggttggttaattttagggggggggctcgggatcctctgcggccgtaactctgtgagcggctgccaggtgggcccaccggggccatctcgtgtagtacaattttattttcaattaattaatcttgtagtacaagacggaatgtgtggcgccgttggtgatgactgatgagtgatggccatgaccagccgtgcaccgtacggcctgtcgtctaaaccatcgtcaagagctgatcaagagatgaagagagaaagataatgaaggcaatgaggagtgtagcagatgatactaacatggatggatgtttttgtactgtttgattgccaattaatttctggctagctaaaccaatcaatcgtatgaatcgtggtaggtggtggtctcggtagaccagatgtccctggagtagggtttgctcaattgtacacatgcatgcatcccacatgagctagctgattgacatatgcacctttgagattattcctattaattcgtgaagatggaggtgagatataaatatgggtaaactaaaatactatggctgtgtttagttcctttttaattttttttacgtatacggacacacatttaaaatattaaacgtagactaataacaaaataaattacatattccgttggtaaactgtgagataaatctattaagcttaattaatccaccattagcaaatatttactgtagcacaatattgtcaaatcatggcgtaattaggctcaaaagattagtctcgcgatttacatgcaaactgtgcaattggttttcggaagtttgagggaactaaacacaacctatacatgcaaattaactcggctattgtgggtgtttttcaaattttcatataatatttaatccattcctatagttaacatgatcatccatcagcattcatttatagagatgacctctgaatctcgtgtacataaaaccgaaaaaggtaaaaatatttaaaattgcccacccaacctaccctgaaaaggggaaaaaaaacacttgggctttctttggaacaaagggaaaatgtgaaggatttttagaggatttaaattcttaggataaacttcctatgatgaactcattcaaaacaaaggatatatatgtccgaaaattcctctggaaaacccatggaatgagctagttcatagaaattttggaagaaaacaaaacatgaggttgtacatcacagttctctcttattgtgtctataatttctctgttttttctgcatatcgtctaaatgactatattagagtattcctacatttctaattcccataggaattcttaatataagacattgtaattctatgtagtggcagagccacctctcgggcaggtcgggtaactgcccaggattcgctgttgctgtctctactatcgatggccatcgacacctataaaaattaatcgatcactagaaaacactattagtcatccggacttgacactccgccactgatcctgtgccctctattcttatgttttcgaaatgaacccttagttattagcttgatttagctaattagcttcctctcagcctccagaatttcaactgttctctgcatgccaagttgccaactgccaagtatgcatgcatatgcagttgtgcaggcaggcaggcagccacgtatgcatgcgtacgtacgaaagagaaataccaattaaggacattaacaccttacacaaacatgtagctctgaccccctctcttgtgcagcatctactgcatgcaatgtaattacacatagtatgtgttcctgcatctttctgctatggccttcttcacttcatcaagcctacagctaactactatactagtatatagtataactgctgctgctgctgctgcatatatgtatatgcatatatatgcagtgtgtgcattgtcacacttgctacatgatcgatcgagatgcacacaaggctatccagcaaataatgccgcctctgcatcatgcacacacacataggccgtgtgtatatatgtacttactacatatatctagctaggtgtgccccagtttgtgtatatatgccaatggttcagagtgagcagatgcaattgcaggcttggaattaatcctttcattgatcaactcaccagatcacaggatccaagatgggaaccaccatgtgttgatctttttatttttttggagaactccatatgattacatgagtaaaattttgaaggcctttgttgtgattattttacctgccttagcttggttaatattcagagttgagagttctgttataactttgcataatgagcgcacttattcatatctgaaatttataggtgtattattggttttcattgctgatgtgaccaagacggtacaggtgtctgaaattagacatgcctctacctcctttcaacctttgcaaagctgacctatgcatgttatgtgtgtgatgtagcctcctttgagcagcccaatgcaatgcctggctacttgtaggccagagctgagacaaagaaaaagagtagatgtagaggagagcaatgctttgcaagaggatagcaacaacaatctcaatggctcatgcaaaagtcataccacaaatcagctcagggcctcaggccaactaggactagcttagctcagattttatgctgaaactttgcagccttcaccacaactagagctactagccagctagctctcctctcactgtgagccatgtgtgccatgctaagccaagaaccccaaaggaaaaaacaagataaaaagatgagcagatcagatcagagaaaaaaaattaaacacaagggtcagggcagctcagctcagctagccatacagcaggcagcagattcattcatgcacatgacacaccacaaccaaacaaatatgaacattccaaagactctatctttctcattctctctctctctctctaagttgtgtttagcaattgccaacaggatgcatcaaatctttgccttcaatgaatccatgacattgctgatgaatctctttcttttgctttgggtgaaagttttttgccagaagtatgcaaaggagctgcacctttataactgttgtgtagtaacaaacagagcatggggacacatcacatacataaaaatacatgcatgccatgaccagtgggtaaataagcaattgcagcagcggcagcaatagcatcatccagccaggagacatgggaggacaagagctgcgtgccttattctggactagtcaaaaggttgctgctgccattgtggagatcgatttgcaatgccatccatggaacaccattgctgctgccatgttgttcttggtttggttctcgttttcttgctgccaagaacaccatggagatgatcagatcagccagcccatttgcattgctgattgctctgagtggatctgaactgaactgggtacgattacatggcaccggtttttggcaatgtgaagagctgcagcaacaggagagaggcatgtggtaggggaccagcttgctgcaacagtagagagaaatttttaccatctctctgggtctcatggcaattccttggaaggtttcaggctcccctgcaatgttctgatccctgcacggtggttttttcactgcttcagaaggatcaggtaaaaagaggatgcatactatgtgagtgatccaccaaattaagccaaatgcatgattagtttctttaaagcttcataatatactctgatcaatcatatgtgccatgattgcttagcttgtagattttcttttgggtgcatgttcagagatgcactgtattttcttttgggagtatattttcagcaagatgagtacagtgcaatgtgtacgtaaggaatgctgttgccctgcaacagctgtatgcagatgcatccaggacccttatttgtgcaagatcacaggtcccatcaatcagcaacaggccaacacatgtaggagagtttctcccctcttctatacacaaaaaactatgggaactcaatagatattggctttagtatatactactattgttctctttttcgccattgccggaaatgttctcagtgcggttgtattaacttgatgtaattggctgagttggataacagtcctcctttatccaaaaaaataataatattgttctctttctaatttttctttcttttcatttctcccccttcttgctctgagagttgaattttactaaggcctggtttagttctaaactttttcttcaaacttccagcttttccatcacatcaaaacttttctacacacacaaactttcagcttttccgtcacatcgttttaatttcaatcaaacttccaattttggcttgaactaaacacaccctaatgataatgtaggtgcactctacaatggataatgcaggtgaacagtagagccctctctcaacttgtttgcatttcataatcaattaatgtatgtactcccatggatcatactactactactacatacactagctagctaggaccatgcagtgaggatggattgattgaacccatcatagaatccgtgatgggtagccctcctttactcctctcctaatgaagaagacatgatggaagaaacatatagcatccaaaaagaaatgaaatgggtagtagtagtagtagtgtagtacatgtgtgtgtctgcatgagagaggctgttgttggcaatggcatacacatgtttgctttgcatgcaaatgtgtgttttgcttccacacatgtcccactcttcagagttggatattgatgggcttgagcaacatccataagcaaaatatgaatgaatacactctagaagcctctgaacccatatctccttttagggctcctttggaactaaggaattttggacgatttttgaacaattgaattcctatggaaataattcatatatggtcctttggaaaataggaatgactttcctttattcctttgaaattccttacgattgtctcagattataggaattttggaggaattacaacatgagcttcaacctctcggaaaaattcctttgtatctatttgtcttttgattcgtgtgtttttcctgtgctccatccatatgatttaagatgctacattttcgctatccctgtgtttccaaaggagctacagtcttgcatgtagagtatgacataaacttttttctttttgcaacttcatattatccatggataataactaaagcatttgtacaacaaagagaatgagaaacaccatggaccacagctaagggcaggtgccagcctagctattctgcagacaatgcaaacctacttcatgtctagccaaaggaaggactgaaaggggagggaggggtaaaagttgatgtggttgagaagttgaggggtttgtttgcaaaaggggaggccaaaagaagggcacagtggctgtgtggcagaggtactgatgccccattactgggtccagtggacatattattgttgggcacaggccatgtgaaggcagagcaaagcatgatgatggcacacccagaaatgaggatagataagataacaaaagttctggtatttgttggtctggtgacaagaggtaaggacagcaaggtgaaaactacttactttaagcctatagctaatctgatcagggtgtgccaaacacttgcactatgatgatacatttcagttagggaaagctgatgttgatttgtacaacatgagtttcttgtgttttctatgtgtagtacattgtaatttgcaacaagataaaagatgtacttctactctatctgttccaaaatataagtatttataacgatgatacatagtcggaaatgattatattttataactgccggactaatatgttagatacataaaggaccaacttttgtccctccttgaaatgaaataactccactactagttctctggatgcctgatagtaatggcatctcattagttgatctattcccatgacaagtgacctccttttaggcaggttcttgtgatgactgtggcacggcactcactca

SEQ ID NO: 48381 - DNA, 4054 bp, Oryza sativa
tactgtagcatcacattgtcaaatcatggtgtaattagactcaaaagattcgtctcgcgaattagtccaaggttatagaataggttttataattagtgtatgtttaatactctaaattagtgtataaacatccgatgtgacagggacttaaaatagtcactgtttcccaaacaggccctcagttgcatggccctgaagaggggagcagaggaggtttctttcaatttcatttcaattggtacaaggaaaagagaaaagagtgatgggataggagtcctcatacatcttggcactcacaatggcacccacatgccacatccatccgttcatccatcaatgcctcctgaactgaagcatttctttgaacaccatttctagatccatcatggaatagagatagcctcccttgtgtagaagagtagccgtactgtagtactgtagttaaggatgtgagaggtttcttgtaggtgtgaaaagtggctgccatgtggggccatggtcgaacaatcaaaacaaaagctggtgctatcatcttagggggatgggaacctgcagtgcatagtactgtatatgtatggtggtagactgtggagtgtatgctggtagaaaactttatttattaattatactactcccaaccaaaggtccttctatcaccttcctataggagtgctgcatttttggagtatgtgtgtgtccatgctccataaatttcaagattgacaaaatgctgcattttggatggatatctgaactttatactctatccagtactctttgttaggagtatatgatttatgaagaattattgaggtctaatgggtttttatgtgatagcatgcagtttcttagagtaggtgccagaagagcatgggttcttttaccactaaacttcatttgtctatgcaaaaatagtaactagtggagtaagtaaatagactagactaatgactgtacttactgtatgaaaagctgcaaaatatatataccttgaaattcgggcattgggatatggcgtcaagatgataccataaacctgcaattggtgctgaaactgctgaacctgagatccacatcatcaccagccagggtatgtaggagaagaggaacattctgatccaagtaacctggcccacccaccagtggagcacagacaactgggccctcaccacaggccccacacctcagcacaaaacaggattatcagaaccattcaccattgccactgcaattccccaggattagtaggcgtttgcaggccaaagccacacagtgacacatattccctctctgaatatcttgcacagaagatagctgctgtagagctgagaggaaaagatatggcttttcagttacagcaacaactttgcatctgatcagatcagatcagatcactatctgtggagagagaccagagaatgtgattgtagtagtagtaataaccatctaattggcttaattactctggtcaagtggtggtcagctcaccaaaacaagaatcctaagccaggattgcattgatgatcccagcctgatctgcttccttccttccttgtcacatggccatgaagaacaagtctttggcgacactgtggatggacatcactcctcctaactaactcggccgcccaacttaaaaatcactgctccctcctctgcctccatcgccatcaccgacaccagccgacccgacaaccaaatctacttatcaaacccgtcacgagtagctcgcagctgccactgcagcctaaattctccaatttcttatctatacagggatcagaagcattctcaggacggttgtatcatcttgatgtaattggtcgagttcagtaaactctcgccgcgtgtcatcggatatcggcggtttgcaatcactcactgacaggtgggcccctcgccagcatgtgaacttcgtcccagctcacatgtcatctgcaatcgatcgaataccggtggtgagatgaggatttgtttcttggttcttggtaataagaaacagtgaagttcgtatggtcatgatcaggatggacaggggaggtggaccaaccataggtggtgtggtgctgctgctgcgagatccagctttgggcggcggcacaagccatgggccatcgggccttttcttttcttttcttttctccgtgatggcgccaaaaatcgcaaatgggggcgctaaatggcccatgcggatgagtaaacgtccacctgctgctgctgccatggcgatcgcgacgctggcttcgtccggacatgattagctcctcgtcgcctcaccaattggccaccaccaatcattcttctccaatcatgagatggcttatctggattctggatttgtagagcttgcttagatctgggcatcagctgataaaaatggctatatgattctggattggtagagctatttgcctcagtttgaaataggttattgtacatattgttgctgcagattatctacttgattatattttgattatatggatggacaaaatattttgataaataaacttaacaaatgacctaaaataagtgatctaagaaatacaatatataatataagaaagtttttttttgagaaaatgcatttttaaagcgtggagcgcaaataattcgtttcaacaatccaataaataattcaaaaagaactaaagccaaaggttttaatagacctgggcatcaactgatggttcgctcgtgtgttcagtttcagttgtgatggcatctcaagaatttgatcttttcaggctttcagataggcctgcaagagggcagaaagagttcggtttaagtgacgataactgaaataccagtatatggcatggaattcgaaagtatctgcacacggtacaaagaaagtaacggaacagtggtatatgtaaatttttagcagtgtttgtttacatgactgttttggtacgggttgaagctatgggcgtttatttacaccgtgagttcatctttagcttcccctctcaaatggctcatgaaatatagggttttcttgtacatgtacatgttacagatggcaagggatatcaatgcctgaatgggcgcgcgaccacttgcaaaccaatagttatgttgaggagatggtaatactggccaaattaaaactgctgatgcatagggcgcaccattgtctagtgtcaacttgaaccaaattcttcgttccatttctctagctcgtcccacttgctcttctgcaggcttggcctaatcacagtcatggctttcttgaaatcttcgtatttcaggggccgcaactacaatgaagtaagaaaaggagggatatgattaggacacttcagaaagctcacactgtatgaagatgtaactcgaaatacctgatttgcttttatagtgagaatattttgtggaccaagctctctgattggcatcatggcagcttcctcacacaatgctctcagatcactcccggaatatcctataacatatttatttcagcaccaagtaacacatatgtcgtcttatcagaatggcaatataccagaaaaataaaactaccttcagtatctgcagcaagcctttcaagatcatgacctgaaaggggacagttccagatttagagtggtactacatatacaaaagccgaaagacatgcagacatacagaataatctgggaaattccccagttctttcgaactagtctttccacaatgcagtgatcactaagtgagaagtccatgtttcaggtaaggaacaaaaggctgatttccaaagaagcttttagtatgaaaatccagagttggtgacttttgaagggggccattgcaaatttaggtcactgtgatttttgaaaactatttagggatcatctaggaaaaattaaattgtgatatagactcaatcatgttaggattaaaagaagaggcgaaaacatcattttttaatgatctccagtagtcaaatattcaaatatataaactgtaatccagggcgaacttttgtttccaagaaattttacttttggttaatgtacttctgtgaaggaatgaacactagtgctgtagtccaaagaagctaccaaga

SEQ ID NO: 48382 - DNA, 6639 bp, Oryza sativa
cttgtaccaggcattaagcagcagaaactattgcatagaaattttgaagacctaaatgcaatgcaggaaacatgaagccaaaatagtggcagtagtcccaaatatatatcaatcttaccagtctacggagaacagcatcatccagctcttgtggcttattggtagcacctaaacaaataaattccattaatagatgacgcaagtaataaaagaagacacttagtataaaaaaatattggcgacaaagaatttttgtttttcgttttaacatacactcactaagtgagaaaacgacctacatacatgcactaaaatcaggaaagctgtatcactcaagatcacaaacttttgctgataatgttggaaactatttagaagtatcctagtatacaaaaaataataccaaaaaaatgagtttggagttatttaacaacacccgaacacacttttaacaatttcttatataaatgaattgaatcaggaaacaaatcagtagcatgtcataaatactttccctatttcagaaatgcttttaacatggacactcagtaatatatgaccatgacaaatagttatacgatactagtagtaaataaatattttctccataaccaatcataacacaagctaacttcaattaagtaactagaaaaagatagtgatgctaacctataacaataacaagatcatcagggtttgaagtgaccccatcaaactggataagaaattcagatttcaaccgcctgctagcatcattctcattagctaaccttgctgacatgacactatcaatctgtaaaaggcagtcaacatgggcaataagcaactatctaaaataataaaaataaagtagctaaacacattaagatcctagaccgactaagctagcacagaaagccagatatgcagataacatctttgcattcatctatatttcttgatagatttgaatggaaaggaatgctttagaaccaaacgttaacgttctggtagaatttgtggacaacaataacaataaaaaaatattctcgatgtattaaacaaatgacctcagcaggcaagcatcacaaaagttcaaaataataaaaggggtgacatgaaaccatagaagccttaatgacaacatcacagcataacagagtaagcctaatagcagaatgctatgatgagcacattctggtattctgtggaaagtttacacaaaacacgtgtgatgcagaacacatatatttacatgttctaatcacatggtttaaatggatagaagttctcagaagcaaactatttagagaaacatccttttttttcattccaaaaagatgatagacatggttccaactcatgttgatgggctacactaaaaacactcctaaggaaaaaaatggagtcgagaaaacattttgtgttgacatcaatttatacttcataaatttaactacaagtgcactacaagaagggtttataatgaggacctcatccataaaaattacagatggttgtctatcgacagcgaccatgaagagtgtccgtacaagcttttcagcctctcctacctgttttgcaatgaaagaataaacttgattcagagtggggaatatgtgtaagcatgtaacgtatggagggatggccacatacccactttgatgtcagtgaagaagctgaaacattaaaaaatgttgcttcagattctgatgcaacagctttggcaagcatcgtctttccattccccgggggaccaaagagaagaagccctaaggtatattatgatgtacataagatggctattattacaaaacaatgtatataacagaaattatcagagcgaagatgtttacctctagcaggcctccgaagaccagtaaacaaatcccttcgcttggtaggtaaaatgaccatttccatgagtgcttgctttgccttgtcaaggccagctgcagatcaaagcagaggataagaacactacaatgaacactaggttttatttgccatagcatgaaaaacaaattataagcttcctaccaacatcttcccatttaacagcaggacttctatccacaatggtcgtatttatcatttcaacaagcttatcatcatagtttgcaccagctctttgcacaggtttggcacctccactgctactcttctgatgagaagatgcttgaccacctctattaaaggtagggctaggctgcgaagtaggcctatggaagctagttgatgcggctctgtcattcctattaacaggattgtttgtaacaacctgtaaaatataatacacagctattgaaaaaaatacataatcgattcgcttgccacaagtaactcgttaagaaaatacaggttcaaaacctcaacataactttgcaaacaatcttacttaattttcttagattggacattttgctgaacgcatgtcattaaagcagcaaaccgtcaaagccaaataagtagagacctaattgcattttgaagtttcatgagttacttcaattttcaaattttattattgaaattacaaatactcattagaaaaggctacattgatagcaatcacacttgaatggctaagtcagaagtgaagtgtagaaaataaacagctgagtaaacaattattgaacaaaaggaaaaaaaaccaacaggcacgctcgctccacctagaaaacatgccatcttatttagaagtaagagagttgaccctactgcatattcagtttcgcatgcagcactcatgttaattgcaacaaacaaacaccaatgcactaagattcacagcctggaaaacaattaaagctaaatttgacagaattacaacgttaacaactacagttcaatgaaatccataccttctttggcactggtgcagccgctcctgcaaaatcagatgatatagatagttaactcccagtgaactacaatacaaaaccaaagcaagcacaagtttatgtacgttaacaaaacaaaagacaaaagaaactcaagcgtccatgtattatgttggtatgaactatcatagaaactgaaaagcagaacattaagacctgtaactgaaaacacaccccacttgcttgttgtttaatccaagcatacaagcaatggacgttctaagcttctatctatatcatatacgtaaattcctaaattaacaccaacacgcaggggcggaactgggcctagggcagcttgggcccgaggcctactcgtgagagaaattttagtggacttgtactagggatggcaacggggacccgaatcctgaatccccgtggggaaaaactctattaggggctataaataggtccatattactccccatggggttgttaacgggcaaaagcaagccccgtcgggtggggcgggttcgggggcgttctctaggcccccgtccccgaatccccgagcccccgagtgtagcacatgtgcacctctcctcagcccatctagagatcagaagcccaactatccaggcccaattcacatggacagatacacatataaatagagaaaccctaggtcacaacacagctcgtttagtcactcggctaggtacccaagcgccgccacacacccaagctacagacgccggcgtagatcgatgcatcaccgaggcagcgacgactccaggctgtgccccacgccgcgtcctgaccctctgccgttgttcgccttgggcaccggccgcgtcgtcgcttcgctgcgcgcctgggctgagccgccgccgatgtagcggcctgccgatgcaaagcacagcgtgagagctgcacagcagccacatgaactttgattctactgcttttgattggtgcatagcttgctcttgggaattggaatgaatcatgtaacttctctcttctgattcatggatctgatgtgtgtctttatcaaaaaagaaagaaagaaaggatttgtcatctgggtgcatgactaagcatttccttttcttaattcttgtgcatctattctctctactcccaaattcccaaacttttctgaatttgtatttgtgtctcctctcaattcccaaattgatgcaccgtgctgcactgtgtttcctctcgggtgcgcgcccccgtcagagccccggaaccccggttggggcggggacgggaggaagattgcccccgactgcagggacagggatggggagcgggggatttccaactgctcgggggaggggacgggcgggcactatccgtcggggatgtccccgttgccatccctaacttgtacccatatattttcagattttgtcaaactccaatggcccagccctatgcgtggccattctcagcctcgtgtccttcaacccaattggaagcccatagcagcccagtagcaactaaccctaatccccaccaatcccaccgtccccctagccacgacacacgagcgcttgcgccgcatctgctcccaaccacagccattgacgcagcaggatgctcgtcgcctcgccctcacctcacctcctctcgtctcgccacatagatggccacggcacgcatcggcatcggcagcgagctagcaacagcaacgacgtttccccttcctcagcaacttcgtctcccaacccagcatctttgctcaagtctcaggcctcaagtcaagcacccaagaaagtttgattcctaaaatataggttggtcttctctcaaatgttcgatccgtattctcattgtgcatttggtagctattaatcaattagaaatcttgtttgatttcctagatgaagagcagagtgataaaatcattctatcaagtcttccaatgaatccacaccaacctcataaatagtataaattgatgattcctcgcggtattaattgatgaggcatgagatggcgaaaagcaatcgattgtttccgttgccaagtgttgctcttctatcttagattttttaaaaaaactaaactaatttgattgccaacactgttaattaagactgagccttcttagctatgtatataattaaaacatagctcacaaacaagatgaatgatggctggatgaatattgcatgttatgctatattgcgctagatttgtttgctagcattgaaaatcggcggattatactatacttctaccgtactgcagtgtacaaattttcatgggtagttttagccttcaatttgagccctaggcgtcgagaaatcctggctccaccactgccaacacgcaatggttcacgagtaaactatggagtacaagttaatgtctctagacgaataagtggaggacatggctgggaaaccacatttcatgagctcggtggtagttgctctctagacgaataagacggaggtaaattgatggggggaaagaagtggatcgactcaccactcctctggccgagcacccggagtcgttcctccacctgagtctgccactttgcgatcttctcctggtagaccctaacctgccccctctcgctgcaatcaaaaacgcactcacgccaatcagcaatcacaaaccctaaccgcgcagtggggaagggaagggcgcacgcacgcacggacctggaggatacggcgtccgggacgcgggcggccttggcctcgagcatgacgcggagcgcgttgcggtagtgcgcggcggcgtcgtcggggagcccccactcctcggcgcgcacggccttgtcgatctcctccttggccagctcgaagtatcccctgagcttcaccgccacgcgctcccccaccaccgccgccggcgacggcgccgccgcggccccgtccatgtctccccccttcgcagccgccgagtacagcagcgacgacagggagtccgcgagcgcgcggaggaagctcatgcgccgacggcgagcagcgccgccgggagcatccggattccgcgacgcgcgatcgagttggtggggaggaggaggaaggggaggatcgcgtattcgcgtgggcgtccactagtccacgcaagcggcggaggggaacgaacactatcgggctcggggctacatgggctcatgggctgagcccaatacaataccgctatacacttatcaggccagaccagtgggccacactgattcatctcccagtctaaataagtctatttggcatccctccagtcttgcccatggtcgaattgcatcgcatacctccagacttattccgtataagagcacttcagagatactccaatacttactacacaggcataggattattcatgtctgttatgttagcatcctgataattcaatttcaagtcatgtgccattgatttgctcttgtgatgaaaagagtaatacactacttcagagatactccaatacaggctgcacaagtcatagtattatttcagatgaaaaaattggcccttggagttattttctgctgaagctccttgcctttgtagactcttgttactggcttactgcagaactcagcctctcattgttgaattcagtttcatcttccctgagacaagaacaagggagcttttcgaatcattgtagtacttcagacaagaacaagggagtagtatattttttttagaccagaggcgaggaaggtcaaacctatttacagtatttaccttctcgtgtagtcatgtaattattctcgctaaatatatctgattaaaaaaatctccaaaatgactcagtatgttctctgccgtattaattg

SEQ ID NO: 48383 - DNA, 5501 bp, Oryza sativa
caagatttcgaagggctatttaatagctcagaggatccaaacaaggccaatatagctgttgcctttagccttgtgaccttgtcaactgcagagataagattcagtgagtataaagtagagaagtgagcttactcaaatcagcaagcaacatcagtatagcagctatggttacccagctcacctacctagctgcatcagcaggagtgtgcttggcttcagctctagccatcgccttgctgtccatcgccctctacatcatcggcgtcgtcgcctccttcgccgtcctctgcgccaaggagttcgccgagagagcccacgaccggccgccgctcgtcggaacagttttccggcagctcaagaacttcgacagaatgttcgatgaacatgtcaactatgcaaccgcgcatcgcaccagcaggattgtgtatcccggtcactgcgaggtctttacttctgatccggccgtcgttgagcatgtcctcaagaacagcttcagtaaatacagcaaggttttttacttcaatctttcttaccaaaattttccgcctgtgattctgtatgtcaggcgtttattacctgcaagatttgtacaaacgatgatcaaaagcttgcatgctgtacaatacggcatatgctatgatatgttctattataaaaaaaaatatagcttagtgcaatacacatgactatattcatttctgaaataaaagctaaaatgaccgagtaacattaccatatatggctcggttaaaaaaaaacacatttccatataaataattaacttaagagaacagtatatttatataaagttagttagcatgtccatatgagttaaactcataagcaagttactagtaactatggaaagtatatatagttgagcctatgagatcttacagtgtttgagcctgattcacagggggacttcctcactacagccatgaaggatctctttggagatggaatttttgcaacagatggggatatgtggcgtcatcagaggaagctagcgagctacgaattctcaaccaaagtgttacgtgacttcagcagtgacacattcagaaggaatgctgcaaaactggcagagaagatctcatgtgcagcagctaacagaattagcataaatattcaggtacttccatgactaagatcagcacaaaagaaagttttggtaaatgctaagatcaaatttatagctgtaatctatacgcgttttagttcagcacctttacagaactgcaaaaattaaaacaaaacctacatataaatgaaaaaactggtagttctcactatttcacccttttaattgcaaatcaagttattgtcattcaattttcctcaggatcttttgatgagagcaactatggactcaatctttaaagtggggtttggttttgagctcaacacactatctggatcagatgaatctggcattcaattcagcaaggcctttgatgagccaaactcccttgtttactaccgatttgttgacataatgtggaaactgaaaaggtatcttaacattggatcagaagccaaactcaagaggaacattcagatcatcgacagctttgtgatgaaactgatccatcagaagagagagcaaatgaagattgcagctgactatgtaagggactcaaaattctatctgtaatgttgttttctacagtttatgatatcatgcctttccaaatagctcatgtttctggagcaacaagtagatgcataaagttgaatttgctagtgaaataacagcagcttcccaaatatttcattttcaacttgcttgaatgcattctgtggtctgatgtgctcccaaatccaaaatgaactctgaatttagtcactctaagttttcttaatgcaaaaaaatataagacagagctaacatactgcattgttttatttctaattcttttttatggcacgcagaaaaccaaagaggacatcctatcaagatttgtactagcaagtgagcaagatcctggaacaatggatgaccgctacttgcgtgacatagtcctcaacttcctgatagctgggaaagacaccacaggaaatacccttacctggttcttctacctgctatgcaagaaccccatagtgcaggataaggttgcccttgaaatcagagagtttgttgaatggagcaaggaagataacactattgaaagcttcaccaaacgactggacgaaggtgcaattagcaaaatgcactacctcaggctacaatttccgagacactccggctatatcctgctgtcccagtggtatgaataactttcacggctattccctgtatagagtggagttgaactaaaataaatctagtcatgatttggctcgatatggatctggtattaagtaggtcacatgccaacaatggatattagtattggaagtgttatctcatattgaagggttcattcctcagcatggaaacctacattaccatgagatatctgaatataacagtaaataatgagaaacaaagtaaagagaatcttagttatccttgggaattcttgcccaaaagaaaaaaatattaaggagtattttcatttgtccaccatctttttgtaaagtaaggaaatattataggaagaggctgcaaggcaagtgttgttcaaagagaagtcttaattatgcagcatagctttatggtactgttagattttagtgcaatctgcaatattcattaaagggaaaatcaatatcacatttctcaaacgttgtacgcacaaaaaaaaaatatgactaaaaacatcatcgccttcgtaaaaatacttttatattgtttttgcaggatgctaagatggcagacgaggatgatgtactaccaaatggctatagagtggtaaaaggagatggaattaactacatgatttatgccatggggaggatgacatacctttggggtgaggatgcacaggagttcaggcctgaaagatggcttgtgaatggagtttatcagcaagagagcccgttcaagtttgtgtctttcaatgtaagtactaccagcaagaatcatttacctcaacatgtttaaatctagccttctgtagatcaagaagaaaagtcaaatatacaataccgcattccaactgaagcagggaaaaagaatatcatgctacaaaattgcaagtaacaataaatcatcccatgcatgtctttcttttcagaatgaggtgataatatcacctgtattttgaggatgaggattgaaacttgcatcatgcggttacatttagccaaataaaaccataattgcatgtgttaacacttaacaccagttctcatattctaaaaataacccaagacaatttcactttcctgtagacaagaatctccattaataagtctattttaccatgatcaggctgggccacgtatctgcttggggaaagaatttgcacacaggcagatgaagatcatggctgctaccctgatacatttcttcaagttcagactggaagatgaatccaaggagccaatctataaaacaatgttcactctccatatcgacaatggtctccatctgcttgcaaaccctcgagaaatttcaccatgaaccccaaacaagctactgcatccttttgttattttattggaacatatgcatttctaacatccgtcctattaggcaagtaataataatctgtcccaagtagtcgtatgaaaacaacaaagtagcaatgggacaatttgcccggtaaaagtaaggtgcttgtacaatttaatatgcttgtaatagggtgcttaaagaaagaggatgcagctatatcatcaactacgtatttaagcttcatttctttggatgcaagaacctctttgtatgtgcctggaaagctatagcttatattgtccataactaaagatagtctttgtgcataagaaacttttaagtatcaatccagagccaggtaagcatcctgccaatcctatgaggtaaggaaaagtagccttcattgtgctaaaaacctactgagaatgaaaccaaacattttatcaatcacataaaacctattaccagtattaaaaagattacttcaagaaaataaacagagtagatgacccagaacacaaaaatcaacgtttgttacaaaattgcctacaagagggtacaagacctgtactataagctactctgatttcagcagagtaagttcgctaaggatacaatgagaagatatgaaataaatggtcacaatgatttattttcagctagagttggaagctggagcccaggccttgatgtccaacccttgatatttctgtagttctcaatcgcctcttttcttagcatctcacgagtagcgtctaaagcattcttcaccttcgaaagaagaataccacatttaatccagaaaatagattaagtgaaaggagtttggattgagagattagggtgcggagaagggaagataccttagggaatgacaactttggtggagcctcaacaacttcaccgaatttaaccttttcacgtccagggaattctggaagagtttccatcttgtcgcccttgcgcttctttttcttttcatccaggtacctgtgacattgagatatgttattcatgtctataccttccaatgggtgagacagatagcacaacgattccctttaggcaatcatcagacatgtccaacttccaatagagattattagactagcatcaattcataagggaatatccgtgttcttggaaacaaaagggcaatcttcgatttacatgatgcaacaaagaaataatcaaagtgatatctctagtgtatcagacatttagacaataaacaacttacttcttccttttctgcttctttgaaactgcaactgcctcatctaattctttaaaacgaagatccacagctttccccctcttccgcttccttcggttttcatctacactcgcgttctcatcgccaaccggtccatccttgccactaatctctgcggctttgctatcagcagtaggctccaagttctgcttcttagttttctacatggaacatacagaatatgacaaggtaccaactgcggaagcaaatcgggcacaagctaacaaattgcattaatactagagtagtagagttctcttgcatttccaaagagcaaacgatagaatgcgatgaacaaaagtattacagcaaccagatgaacggactaaatgcaacgtaatagcaggaaaatgtacttaaagataccgtgtttatccaggaaattaatccgcagtaccttgtctttgcgagccttgttcttcgccgcatcgctctctccttgtttccctgtagaggacgtaggaatttcatcaggctataactacagttcagcggcagccggggtgaaaggcgtaaggggagcgcacctgaggagtctccggcaacggcgcccttctcgccgcccttgtgcttctcctggatggcgatgaggcggcggagcttggacgggagcgcgtcgagctcccgctgcttcggtggtgggggcagccgcgattc

SEQ ID NO: 48384 - DNA, 2789 bp, Oryza sativa
atcattaggctttaggcccatgtagatataatggaatatgtctaccaacaatccctcttatttaattggcatccgcaacaactgaaatcttgaacctccaacttataaaatcaagttaaactagttgggtggcccgtgcaattgcgcggctagcacccaaacaaaatcatatatttttcagtatgattttacttaaaatttattaaattgctatcacgttgtcttaagactttgaaagaccaaagcttatcatccccgtatttctaattatatagtttttaaaagtcacaccagctactaccccttacttctatcatatcctttttatttgcttgcttgatctaccactatttgaaacctttaaaaatcagatcatatagtttttataatttctagaagtcccgtcaaacgcagtcataatactcctctacgagccgtgaactgtcttttctctatattgtcattgggattttacaaatcgaacataattatcgttcgggttcattttttacgttctaaagtcccgctaaaccgtcagcggctttgccattgttttcctttatggcacgcccgctgcctcccttctttatcgtcattgagattttaaaatcgaacatgattatcattgtgttttttttactttttagaagttccaaacctttaaaaattggacctcgtagtttttagagtttatagtcttgttggtttcttttttataatttttagaaatcccgttaaatgatgtcactatactcctctgcccttccgccacctactctttattgtcattgagattctaaaaatctaacataactatcgttggaattcattttttatattctagaagtcccgccaaccgtcggcggctctactatacatcccgcccactgcttctcctttttattatcattgagattttaaaaatccaatatgattagcattgtttttttttactttctagaagtcccggcaaccgccttgatcgattgcttcacggcctacccgtcgtccttcatttcaatcgttattaggattctatttggtgttttattaacagtttttatatgtcgtatcaaccgccaccattctactcctttataggcatgttacttaattaatctcgccatgtgttttagatggtattttctttcaatagtcttgattttttatcaccaattttagttatttataaatggtattcctagtatttttcttttcctaatttcacaatttattttatttttcgtattgtgttcttttggtatttttattttttattttcaatttcaattgtttcaaaattgtattcctactttaactctctttttaattcgcctaatttcggattttattttattttttattttgaattttaattaatctactattaggttgttatatgtactcttattttcaacacttcttatatttaatttcgaatttaagttaattttaaattgtattctgaactcttcttttcttttttctaattttgatttttttaaaaattttcattccgaattttaattaatcttgtattggattcttatatggactcttatttcaatattccttatttttaattctgaatttcagttatttttaaattgtattcctactcgaactcctatttttcctttttctaatttcgattttttttatttttattccgaattttaattaatcacgtattgagttcctatatggactcctctttcaatattgcatatttttagttccaaatttcagctatttttgattgtatttctatttggactcttcttttctttttctccgattaatgtgggaatttctagcctccacagcaaacgtggttatgtatttttggcttgctaatttttggcttggttatgtatttattggcatgacaatactgatacaattcggaaacggcagagtttgattaggattgttttgcctttcaatgtttctaaaagtggtgtgaacacacgtattcccaaaatattgtccgtttccaatatgattatgtttttctttttttttttgtttttgaccgattgtacatttcgtttccagtagattaggttttcctttttttgtttgtttgtttcttttttttaagacagattgtccgattccgtttccagtagtatgattaggttttccttttttttttgtttttaacgattgtccgattcgagtttcttaatatgccttttttctttctttcttcagtttttaatttttaactaatcctaatctagttctatttttcctttttcttattttttgattaatgtgagaatttttaggccatgagagcgaacgtggagactcctttttctattactttaaagatataatagatagattaggtcctccggtattagagatagttggtttaccgacatgacaaattgacctgatccactcgtattaattagaagtttatctggcaaaaataaagtggacctcacatatcatcctcactctcctcccctattctctccctcatccatccccttgtccctcaggcctcagggcgaggagagccgccgccattaacgtgatgtgaagccgtcgtcattgccgacacgatgtggaggcgttgctaccgccagactcctccctccaccgctttaccccctctcatgcaggccatcaaaaaaacatgtcgtggcgtggatggatgagggagagtccaagagtgctgacggcgaagcggcttaaggcaaaaagagtcaccgaccgggtcaccatctctgttccctcttctttacccttttctcccgtctcctctttttctg

SEQ ID NO: 48385 - DNA, 7750 bp, Oryza sativa
aacgtttggtggacttaacccggagataaactctaggattacattgtaatgggcttttgatgggccgttccggcccacgaaggatagcagatggtggtggactggactggactggacctggatgggtgcgtggaatttctcttctcggcgagatggcggcggcggcggcgcgtcagtgtctgcttggattccgacgagcagcgccgccgcctctcccgctcctgagcacgcgcgctccctctcccgctccgtccagccgccgcggcgcgcgcatggcctcgtccggcgaccacgcgccgcagctcagcaccgccgtcgcggtgcccggcgcgggcgcgcccgtccgcgtcgtggccgcgccgggcctcaccgaggcggatttcacgagcgcggtggaatcctcgctgttcaggcagtggctgaagaacctgcaggaggagaagggggtcctcacctacgggaggctgaacctgaggcaaatcctcatccaggtgagccacgctactgtctcactgtgttgaatccgctacatttctcgatcaaaaatgagctgcgcaagcaaattttttttgcgtgaatcttaattttcgtcgctgcattgggtgcagggggttgacatgtttgggaaacgcgtggggtttgtcaagttcaaggctgacatcatcgacgaggagaccaaagccaaggtgatcgaaatgttgctgccgccgttccctgctctctttttattaaaaccttggataatctgcagcttgctctactagaaatctagaaggaagatccctgaaaaaacgattacatcttagatagtctgctgattactctactggaatgagtatccttgaaaattggttgctactgaaactgatatgaatatctcaagttttgcttgttacaaatagatgttcttcatctgaaatatgttttttgccaccatggtttgcaattgctgatgcagaatatcgtataaccatagtctccacacgagtaagttttagtggcaccaggttttgctttgatcgtggcacaaaatggttatggtttcaaatgaattttttggactgtgtctatgtatatgtttcgtgaattcattgatattccttgtagcatgttgaattagatgtggtcgttgtataggattcaaagtaagcggattttgtgtgtattatattttgagttttgacaatatatccagattccaggaattgtatttgcaagagggcctgctgttgctgtgttgattcttttggagtctaaagggcaaacttacgctgttcttacagaacaggtatgttatcatcagttactgtgaatggctcatattctggtattagaaccttgtgttgagtatcgaccgctctgaaaattttaggttagagttcctgttggaaaatttatattggaactacctgctgggatgctagacgatgaaaagggagattttgttggcactgcagtccgtgaggttagtatccctgtttttctttatctagaggtatgtgctgttgttggagattagtaatgctagcactcgtccggtctttgccagtttggttcacagaccatagtaatactgtatataacattgagtcagaagttcaccatatttgaagtatagtgataaagggtctttcattactgacaggttgaagaagaaactggaattaagctaaatttagaggatatgattgaccttactgcattgctgaaccctgacactggatgcagaatgcttccttcaccggtaaatgacaaatatttcccttctctgcgcaatatctggcataacttctcttcaagaaatgaagctatgtataagcatataggtgtatagtgttagtgtgttactcaatttggctcgagtattaggcatcactgcatcaggggggcatattattcttgcttggtcgtccactagtccttgcctggtcattccttgtgttttacttgtcgcaagtcagatttagacaacacatagagaagctaaaaatgttttcttgcaagaggaattaaaatagcgtcaagatgcagatgcgatgcagagggatgggaaattacatttctgtgcagaatccctcctgcctatatgtaatcgagtagcaagaattacaagagatttccactgtttatgggtctgaaactctgaatgtgctatagatctgtgctatgtacagtaacctgcataaaagattacaaattttttgatctatcacgagctcttcagtcttgaccaactgtctccttacccatagggtggctgcgacgaagagattgggctgttcctgtacagaggccacgccgacgaggacacccttagggctctccaagggaaggagactgggctgcgcgaccatggcgagctgatcaagctgcgggtggtgccgtacagccagctgtggcgcgccaccgccgacgccaaggcgctcagcgccatcgccctgtacgagatggccaagagggaaggcctcctgccgtcgtctccgacgacctctcgccgccgtggcagctcgtcgtcggccaacttgtaagagccagtcagctatagctagctagccgtgtgctttgtcagaacagctaatgagcagagcgagccaattactgtggagtgtgtgccttaatacaacagcaagatcgacctgtgtaaatgactaattgcatgcattttgatgtagaatatgagaaattaataaagcgtatgtaaacaccgtcagtcacgcggcaaacagctatctgcatgatatacatgaccatcagttgcaacccatagtctgttactatttaccaacaaaattgtcttaattgtctaagttcatgtgatcagaatctgaccaccgtttaccaacaaaagttgtcatgattgcttaaggttatgtgattaaaatctttaccacaccttagcaagtccaagaaattctatcacatttcttcaagtcatcaacgcgtgggatctgatttgttcaaagaaaatcttttttctcgaatgcgcaaaaggattgcacgtcaatatattggaagataagttcaaagaaaatcttatcacaactatagttgaaaccatacaattgtttaagtcatagttagctaactttagacgtggcaaaatatgaccgacaaccaattaagcccaaatacatgtacgcggccactatgtatcttcacaaacaaacttcacttgacacaaaccaaatccctttgttactgagagttcgctatatgacatctactccccatacaaacttgtccaaagattacaatactgaatttaattctacgagagtacattttccaaagataaatgatgatggacggacagacaataatgtgatatcgacatactccctccgtccaaaaaaatacaacctaaatggtgatttaatatcacctaggacaacgaatttggacatatcttaggttatctttttttgggacggagggaagggagtatatatgatgatgatgttcttgtttaattattgatatatccatatgctgaatgatatatcttattctattattcgatctagagcagaatgggcgggtggcagtagggtcccctgagccagccgccggcgatgacccggttcgccgcctccgtcgtgtgcgcgccgtcccagcacacggcgctcgacgggttggcgcacgcggcggcgcccctcatgccgcaccgcgccacgtactcccagttgtactcgccgccccccgcgccgcagcacgccgcgatgccgctcctgaaccccagccgcgccggggcctgcatcatctccgccacgacggcgtagtagtcggcgtacatgatcctcaccgccgccgccggcgacggcgacgacggcgatgacgacggcgacctgcggtgcctggcctggacggcggcgaggctggtctgcagcagcgagttgtggtggatggccagctcgttgagcggcttcaggcagccgtagtcgtcgtagtcggacttgttgctgctcttgagctccgtcaggtagagcgcgaagcatccgaacggcatgactcccgggacgatgatgtccactgcacccatcgctatcagcttctgcatatgcgattgccatatgatttactattactagctaaatggcagtactttactatggaaaaatgtgagatatatgcacttcgtccctacagatatataaacttcattttagagatgatagataaccacggtttatagaatgactatcttgtaatatatagtactccctctgtttggtatttattagatcgctttcactattttcatagtcaattttttttaatttgatcaagtttatataaaaatataataattttttaacacaaacaattatgtttattaaaactaatttggtgttgtagatgttgctatatataaatttggttaaacataaaataattgactaagaaaaaagtcaaaccgaattataatatgaaatggaaggagtatgtaatatgaaaatgttggtggcagattttttttttcaaatataaacgaaaatatatttcaaaaatattttgcagagatcaattaatcaaggttaactccacacgaattatttgattatgaccggttctagcttagctactccctctatctgtaagattatttagaccaattaaggaggaaagacgaaaaaaaaagtatcccaccatataaatctgtgcacttgatacaatttactctaattaatattctcttcgttccaatataagtgtaagctagtatatacgtgtcaagatttttagtcttaaataggatatgtcacatctatattaaattatacttatactggaacggaaagagtatatgtgatgttaattacctcgacgccacttgcaatttggtcgacaattttgggcgtgtagttcctggcttgatcaatggtgaagccgaacaagaccatagcgttgtagtcgtttccgcctagtgagccgaacaagaagagggactcggccaggtaggctctgcaacttgatcgatcgaggtcaaaatcaaataataacattaattcagattgtacttttgtcaactactccctccgtttcaaaatatttgatacagataactttttagtacgtgtttgaccattcgtattattcaaaaaatttaagtaattatttattattttcatattatcagggttatggataccatatatctaatagtagtcgactagatctcggcaggacccaccacataccatgttctatacggaaacaacctgcggatataggaggagttccggataaggaaagacaaccagagttctacatggaaacgacaagaaatactcggattgtatccatattggtatccctaattctacttggacaaggggacacctatgggtataaatacaagaccccctaggaggagaggggacaaccaagacaactgtcacgccccgaactagcctcgaacggaaccaacccgtgacgctccaaattaacctgttaacggataccagtcccaggaaacagtgctggtatcacaggaagacagaatatcacagcaacagaggtctctttatatagagtaggtttacagtcatgttgggctacagacagaccccgagctcacaactgcattacaaaagaggaaagcggaagccaagacttggaccatacatcacaggcacgacttaggaactagatggaaaccttaaaactcatcatagccgacttgctcctggaagaactcctcgtcagcgggatccatctcatctttttcagcaactgggggggatatttatatagagcaagggtgagtacaggagtactccgcaaagtcatgggaattttgtgtttaatgaaggattcaaaggaaaggctgttgtttttacaattgatttttagttaaactcctttttaaaacaactaagtgagtgcttctcaaacgacacggatgagacagtgcatctcgtccggtcggagtatgtgtaatgtatcagtctttgatagattcaagatttgccacccggccacaactttcaaatggccacccgggcctagctgatcccgtcagccacagatgttccaaacatcgaacccaagtccacaacagcaatttcacagagcagtagtcaaacaaaactacgctaaggaatcaccttacatccgtccatgactgtgggcacggctgttcgaacagtttaataacctctgcagagggggcacactttactcacacgacattactaacccggatcacccagcccgtgcagaacagccacgtctggtgaccttgaggttttcatgacaaggcatttcgagagccgacacaggtttactatatgccagaccaacaacaggttaggtcccagataatactgtgccaggaagcccaggggtcctccccgacactatcctggcgaatccacttgtctcccggcatcaaggctcccctgattagctaattactcagccatgggtgtcccattccacccatgtggtcgtacttgttatatgtacggatgaaattccaaaggaatcggtccttaagtgcaagagcgggaaaccgtgctcccggcacgtcccccggtctgtgatttttggaaattcatttagttcgcaagcaccgacccaggtgtcgggttttccaagtcttttgtaaaaccccaagttttacccatcgttggatattttaagtttgaggggaggtgctcccatgcacttgctcgaaggcccgtgcatcgaagcacaacagttgacaaaggagttttaattgttcaataattcaaggagggtaattgcagcaattaggattggggccggtaggctatctcgcaagccgcggccgaattacttgtgttaaacctattcacgcaatatttgcggaagagaaatacttagatttaaattataggtgcaagatgatcaaatgtgacttgccttgctcgagatcttgagcttgatcctcgaaatccttgcactgcgggtcttcgggctccgaaactacacgcgaaacgggacaactcaacaaacggcaaaaataaagccctattattgacctctaagcgtgccattagatagatctcgagatttgaggaattttggaagttgaacggagtcaaacggatgtacggttgagaagatttggaattttctaagactaaaggatttactgggctaaaagaaaaggatttagtaacctcctttttggattagaaacgagatagggaggagatgtagacttcgcgggcggcttgagcgcggcccgagaggagttggcgcggctcgaccaattaattgggcggacgcggcctcaggaggcggtccaacagagggaggcggggagagagagagggagacccggatccatcgtgcagggtcccggggcgagcccacgagtcagtgactcggtgcacgggagagagggtttacgcggcacgggggagctagggtttgcggacgcggttcacagatggtgcaccgggtggactaggaggcggcgggcccacgcgcagccggctgactctcagtggaccacgcgcgcacgagagaacggatcgaaggaacggctaaccgggttcaaaccgtcctggcccgcggccgagctggcgccgacgtggcgccttcgtggctgccacatgggccggctggaggaggacgaagggagaccggccggaaatggacggcgggcgacggcggtgttcaccggagctcgttgggacatcttcggccaaggggagatgcaccggtgtgacgacaagaacgagagggatcatgccttcggcttggatgcaccgaaaat

SEQ ID NO: 48386 - DNA, 16368 bp, Oryza sativa
agagagagggaggaaagaaagagagagcgagctctctctctctctctctcggtctgcgcccgggcggcgcacgtgcctcgcacgtgcgggcaaggatggaggggagagaagagatgggctgagaggaaatgggccggggagaagagatcggcccacaaacttgagggaggcaaaatagacttttcgagaggatttgatttgggacagatttgagattagggtttggattcgatgatggattggggatttgagatctgaaatggcgcggacactggacaacaaataaagaaacaattttcgtatttaggatttttaaaagatagttttcccactaggcgccacgacggaacgggcactacaacaaccaacacacacggacaatatagacgccacaaagccacaagccgatacaagccaacatacgccaagacaagacgccagatatcgacatcaaagataggcacggctagtcccctacggtgtctccggatactgtcaggagagacgaatgcgctatctctgatctcgccgggcacggattcgaggaggaaggctaccctgttgtcgactacgagtcagaccttcagaccaccatgtcgacaacagttagataggttacctcacatattgtactggtgtgattatggtgaataaaaagcaactccggcttcggccaacaggatgtagggttattacctgacaattcaggggcccgaacctgtataaaaatccctgtctccatctcttttacctcagtctcgcgtatatcctagtaccaacgatccccatgccatgcaaataccgtagtcgagatatcaaacgtcgacacacatcatttgattcattgttaaatatactttcatgtacacatatagttttacatatttcacaattttttttaataagacgaacggtcaaacatgtgctaaaaagtcaacggtgtcaaatattttgaaacggagggagtaattagctgaaagaaataatggtgtttgtaacgacagctagctagctactaggaacagtcgaacagatagccaaatactccctctggtaaaaaaaacatgttggcccttcatctttgttgaaaaaggaaaaaatttctcttataactaaccttaaccccgcaaatcgagaaattttatacagtccatattcttaataataaacaatttaatcttttatcctgacctaggttgtcaattttggtaacttcgtcctccgtcggcaagcaaatatgtcggccaaaattttttggtttttctttgtattttttaaatttgatcaaattttattaaaatttaatcagtttttattgcattttcaaataattttggacaaaaagtatgaaaattctaaaaattttcagtgcaccgaaattttagtccaaaacaaaattgacaaccctacgtccctaccctcaccattaacctgttaacttttatttataaaatggagtttgtggggggcaaaggaagtacttgccacgacattattcttgtttaaatttgatgatctttggtctttttgtgggaaaaaaattatacaactcttaaaaaagatgcttatgttatcaaaatatttcgcatcatttagaaagacattaaaattctgttcacgtagtccatgttggtgctaaatatttcctaagcaggggatcagagaagaggagcagagaagcttgtgctagttttaactggtttctttacttgcttgcttgagggctgaacagtacacttgcttgtacgttgggcagcacaccatcatcagtctatacacatgcactggctttctatttataggcttgataaaccgatatgtaggaagcttcaggacctagctagagacttgtagtactactacattgtcaaacttcactggtactagtactactgtcaaatcacatcatgcatgtctacacactacactgttctagaaaatttatagagcaaggacttcaaccttgactttagtttcacgagtagtagagagggttagagagtaggctggtatgttctagaaataaattaactccaacagaaaaaaattatacaactcttaaaaaagatgcttatgttatcaaaatatttcgcatcatttagaaagacattaaaattctgttcacgtagtccaaacatttgaaaatcggttaaaatttaaaaatagtactcctgttgatcaacaggtacaagtatataatttgctttgttttgcttttattttgttttgcttttattttttatatagcccttttttatttaatatatataccgtgaaagcctcctccactgtgctttccttataaaaaaaacagctacaagtatctaaacacatgaaacaacgtacatactctgtggtgcagcagtggcgcagatggagggcagcaagtcgcggaaccaccggagctggacgttcatggagccgtagttccagaacgggaagccgacgccgatggactcgaagaagtcgaagtccagcgccgtgccgccgacgatggccatgttggctccccggcggaagtcgccgccgatcaccttcgacggcggcagcagcggcagccccaacccctccgctgcatcaaattatacatcgatatcatttcatgatcatatattatatatatcgatgaaataataagcagcttcgatcgatcagcaatggcgatcgaattgaaccgaggaagtcgacgacgaggcggccgtcggagcagcggcaggtggggtggccgaagaggtgatgccgtgggaggctgcgccatggtgagctggtacgattcaccgccgacatgttcacgcagatgttgcccgtgtccgtcagcgagtcaccgaagctgaacatggccttgtactgcctcttaatatcgccgccgccgccgccatgctcgccggcgacgacgccgacgaacaagcagaggcagcagtagagcagtacgccgacgacgacggcagcagcgtgtgcttgctgcgccatatggctttcgttttcctgcactctctgcacttcacttctgctggctgcacgaagccggccggacaatactagcacacactccacagtccacaaagtagatatatatacacacgaccaggccacaaattaatttaagttatatatacgagcaaagttgagggaaatttaactatttgttgctccactctttatttgccacatatacaataattggcactatatatttgtcactagagagttatggtttcttaaaaaaaaaaaaaccatttttgccactctggctgtatggtatgtcaatgtactaatgatgagaaaagtctattttgcccctagctattcccttgtgttcatcctctctcccccctcccccaaaacaataaacaacatggtgcaattgtttggactgatgcaggcaaaatgtctcaccagcgccaagatgtactccgactacaatgacgaccacagtgacaatatagcttctaccactacccgcagggagaacaccattgctgctatggtcgagatgcactcatgcacagctaaatactggggtgtccatcacacctcggttccatcaaaaaaggtttctcggagctggatcttgactccgatgaccacgactacgaggatgcggacaggaggagatggcggtggtggcggaggatgacgtgtgcgttctagaaggatgagcgtcggcgccacaccatgcttcccatggaagtggtgtttcctagtgccacaaccatgggatagaagcgtcctaaggactaggagcaaaggcatatccagcccaaatgtaaggcttggtccaacctactgatttttcatgaggttggacaacatagtgaaaactcttaatactgggcccaggttcctgtggcttaagtcagcccataactatgggctcaaccatgtttgcctcctccatgccaatgccggggccacctccttcctagccgcacatccacccttccactaccaacgttcaccgcccagagctccagcgagaagcttggtgactctggtgtggtacctacatattaatattaagaaccctaaggaaaataaatattatgtgtttatggattaggaaaataaatattatgtgtttatggcactctctcgtaaaaaaatcattcagaataaatgtgaacaagtatttatttatatttatttttagaatgatttttttttgaaatagatggttaaatagtctgataaattacccgacggaaacctgacaaaatcatgtcccataaatcataatataagataccccttagtataagagatcctcaggtaaaatagtttgggatagtaaaatggattttttttctaatttgaaacaaaatttatatccctggatccattgtattacattatagaactgatgaagtagtaactaaggttgatcactcatgtgtaggagtactgtgatcagtgattactcctgaggagtactgaccatcttcaatggcgattaagacttgatactactaccaactacccagagagagagacagagagcatactgcataccagggttcactctatcggttcaggggtttctatcgggggtcaccgaaatcccgaaatttcggtccaaaattttcgaaattttgaacaaaatttttagttgaatttgaacaaatattatccaaattcatgaaaaaattcaaaaatttcggtcgaattaatatcgtatcgggggtcaccgaaatgaccgaaattccaaaatttccaaccctgctgcatactactagtgcctttgctgagtggtaccgatactgactagtgcgaccgtcttcaatggcgattgagagtttagactagacaacctgagagtgccaattggcccaaggtcgtagagagagagagagagagagagagagagagagagagagagagagagagagagagcactttaccaacatgatcttgaatccgctttactaggggaagttacatactttaacaaaattcctatgttaacttaaaaaattaaccattgattagatgaattatatgatcgttgccatgtaagctaatcgatgtttaatatcatggaccattttgcaaagcccatgcaacatggcatgcatatggccgttgttatgttttggcccacttttaaagcccatataataatctagtatgtgataaataaaatacatatgtcattggaaatccgcgggctctaagctatataagttcaattagcaactcactatttgcatattgttaaattaaggaaaatactaaactaagactcggacacgagaacaaataagtagtgattacttcataattttaaaatttaaataatgaaaatgaattgagattaattccaaacaagcacgagctgtgacaacagaccatgcaataaacctgttgacaactacttctatttgatgttttggatggaattaagtgaagtatttgatactttgtccatcaataactttataaggcttaaggcttactatcaaaaaataaatgttgtatatgtacatattgatttttcatgaaaggtacttttcataatatctcttaagcttaatgtatcttagtataaatttattctaatataaaatttgaaaggtcatgcatcaaagaccatgaaaaaaaagttaaacatcatataaattaatgggatcacgataaccagataggtagatgtggttgttgaataattaattagatgtatcgtagtaatggtcaatcttatatcgtaaccacagacttttaaaaaatatctaatcttgcatccttggcactttgaaggaaaaaaatatgtgtacaaaatacatatgtagtgaaaaccggaaaactcccgttaaatcaaaatagacgttcaaacattatttttatatctaacagtaattcttaggttttcactatttttctcttttgaagtccaacaaattcaagttatgggccaaactctcaaattccaatgaagctctgcacaaattgatattcgcagattgtgcactccggtcatgactcagaatgcgagtactctagtctctagcactcgagacagcagccacgctgcacgtagacctcagttgccgccggtgatctaggacaaaatgggtggcagtataaaaagagtactataaattttatatttgggatgaaagaagtactaaatttatagtaaaaattattagaagtagttgccgcccagacttcgtttacttttctcggtaacatatgtaaaaattattaattgctacagtatgctctttatcactcaggcttggaactccacaactgaagtagccagtcataggcgataatctgcttctagtagagacaagagagttagtagtacaccttgtgctttaataacatatctccgatatatatcttacaagaaggagcatatttttttttccattctgacaaaatcaaacgtaccttggacttggagatcaatatgaaccggcaggggctaaactcctaaacaaaacactatctaaattacttcgagttaaagacagtcgcagggcaactctcctttggcaggccgttttggtgaattcaatcgctacatggcgatcgatcaaagctagtagcagctggtatatacatacatgcacataaccaaccgatatatgatggtctatcaaaggccaccatgtatatatatacacaatgcaatcacatatggatgattgcaatgtagcaccatggccggactgtatataccttggatgcatatacaattacaaaatcacctagaatgcacctgccagaggagagctgcctactactgtcttcaactagttcttgcacctctctcacatccacgctcacactcacacacctacgaatgcatcacaaagacttagaagacttgcctcttgtcttcctacaaacacatggatgcatcagaaaacttaaaatttttatctgtttggttgttggtgacctgagtagtgtgcctcttgtgcctttctgttggcagaattctagctcctcttatagctagggcgacaggaagaagatgaagcagcagcgaaacggcatatgccattgtggtggtgagatgagacagtgagatatatgcattctgactttttagggagggtttgtaccatggatatcctccccagctattccttcgaccctgcaactttatcctattctctctcgatatggagaataatcgatcgaaatcgccccaatggtccacgctgatccatagatgatggtatatagcatctctccttgatattgtcttgcattgtgtgtgtcccgtctttccatggtcgctgtctcgccaaattgccttcatttcccttgtgaattcgccgctgtgtttgtgtcaaatagaactactcaaatgtcctggagaaccgttcagaagaaaaagaagtcctggagaggaaaggtccattccattttcaacctaccaaactttgaaagttcactttatggcaatgtttaggttctttaacaagacaacacaaatccacaagactgacatggcaacaagtttctcaatcagcagctttgccggccttcaaaatctgaacttcagatagaaagcacgttttgatcttaaccaaaatcttcgtcttctcgttgcatacaacacgagagaacagagatgcatccatctaacgaagtgtccaatgtgaccagcacatcatagagaagatgcatgacagaatggagaggcatcgatcatagatcaaaactgatcaaaattttacagagcatgccatgcacgcttcagctgcgatattacagccaaatcgaatcgattgagataactacatactgttgtcccttcgggcaacgacagttctaaaatcatcatggaacaggttgatgccatcagaagagggagttgtacgtcaggaaggttgacgcgatcgaagcagcgcagatcaccagagacggcagcaaggtcacattgaggagctttccgattcccaggtaccctgctgcagtgattgtgcagtcggcgaccacccgggccaaggtcccagcctccgtcgagggaagccccccattgtaggtgccacgggagagacgggacgacatcacgcttgataggagggagaggttcactcctgcatttgcagatacaaaatttagacggtttattcagtgctggctgaagaaatgagccgtagatgaacattccaagaaaaaaaaatgcttctcagatgtctcaccttcaagaacttcagcagacacaaatgtgaccagtgctgagacgacatactggacaaccgagtatgtgctcgtgattttgaagctgaaaataatgccgaccagcagtgtgatttgagacaccatcaggagttgcctgtcaaaaacatcacgcaatttggtaaagaggtcaacagagtctgaaatattgttttcagatgcagatcaagattctaaggttatcccttggttatggacttgctgcaaaacaaaaggaaagtgaatcatgtgatgccagcgataaagcatggaggcacaaacctgtcctcgaacatgttgctgatatatgtcccaacaacagcattaacaggaagaactgttaggccaagaattgctagaaatatcgccactgcacttgtattccaattgaaatagtgattggtaataacacttgactcagaaagtaaaatctccatcgcgtatttgagcatgaaatatatcagcaattggacctacacaggagaagcagagtaagtaataaagaaattgtggtcacagacttcgttttcagcagtacaattggcctaccatcaatgcaatgcaatgtaggggttggaacctaaggctctttaatgatttattctatcccgagatttattttttcagtgaaaaattcagttgtaacaacagatcgtctttatataaaagaatgaacgagtcaactaaaaatcaaaacccaaattgcatattggggaccatgaggctaactgtgctacttaaagatgcatgatatcaagttaatgctagatttcctctattgacttgaataaattagtaaagaaacaactttatgtgggtaaaagaaaaagaaagtcaggcaaataatgcaagcagtgatcaatttagctgaaataatattatacctttactgaaggtgtaagcaatctgtatgctgaaccaatcgaagtcgcgggtttgcgagaatcatgtgtgccttcttcgctatcatcgacttcttcgtcatcatcttcatcttttttgcttgaatctcttagtaatggttgtgcaagtccattttctagttgctcgatatctgccctttgtactgccatcataatgaacataaaataaaatcatgaggatggattagataattctttatagtgcaatatccaaccagttatgaagtaataaaaagcattagaggcagtacataccagaagcaggattttgctgggtaccattcacctcagtggcacgatttggttccttgaacgagatccatagccaaactaagtacagaagccatgcaacagccatcacccaaccaggtagagttgattggttgaaagtaaccatgtaaatcttaaatttccactgaagtaagccagctaatgcaggcccacaagccatgccaagtgcgcttgcactgacaaatcctgctgaagcctgcatgcgtatccttgcagggacacaatcactgatgtatcggcgattgacagctcttgcagaacccattctgcatgacaacaattacattaactaaacatgagacaatgctgaaaagatatttaactagcatgtccaatatcactaaaattttcttgtggccacaaaaacttattgacaggaaattgtgctcagatagaaacaatatgacctttgtagttgtatgtgaattttctaatcaataaaaacttgctttcctactatggttgcaaccaacgatgtcacaggaaaataacaaatggggtgtgttatatatattcaacagaaacacgttctatcccacactagaatatagggatgataactgaaaaatgcaaacataagactaattttgaagcaataaacacacgtgcagacacacacacaccccaaaaaaaacatacaaaaaagctaaaacagaagatgcttactagtatttaggacgcttacccacagagtagacggccaataatgaggactgttagggacttcatatcatatgccattgcgtagcagacattacccaagaaaagaacaatactgctgaaaataagtggtctgaaatatgacttgttggaccatgcgctgaagtaaactgaggaaaatatttgcgcaacagccatcgaaccaataacaacaccacaaacagtggaagcagccccaaggctcactgagtagtcatctgcagtcgggacaatgatatatgtgttgaccatgtaaaggaatgtgttcaccaagttcagcataagggacatgaaatggtatttttgatcttctatttcttcttcctctgcagtactaggagactcctcaccaacaattagggcatgttgccccaaaaatctaagaaaatttgttgagcgtgttagcttatccactgatgaatttatcatatcaatgattgggtcctgcgacgaatcaagaacaactcagtaaaaatgaagtccctataacaagctattctatcatttttcgtacaggatagcagcaaaaaagatgaacgaaccttaagagcagtagatggctgatcgtaaattgacaagtaacttccctgccgctcttgaaggtcagcaaggttacgtgacaacgctccaacaacagctccaacaccctggttgcataaaacgtgtaagttatactggtttgtgtttcatggaattcaaaaggcaagatcacagatccatagatgcaaatagtacaatacaatgcaaatgaaaagcagtataaaaatttgatgatactttaatctggagtcagtacattaccacatgcttgaagacctgctgtagctgagaatatgggtgattcgatctacttgtcacatagtaatcagtaaatctgtagccgaaacgcttgtcaaacttcttcaaaattttccgaatgccagtcgcattgagatcaacaaatttgagaagtttgataagatccaggccaacttccctgtaagcttctcgcaactcagcaatggcagatatatctggctgttctgctaatattgccctttgctttcctaatttctctatcctgcttgccaacgctccttgttgctccaacagaaataggacaatcttctcaatctgatgccacaggaaaacagaacatcagtaatgtaaaacacaaattttagtatggtcaattagataaatttgttgcatcaaaatctcgcacaagggatggaaccaggtgaaaacagggctcacatgtgagcaccagaaagaaaaaaaataaagaacagtaagtcgtcaactagaactgttggcttgtaacattttgatagtattactcagtttctacaagaaaattggtgacaaaactccgctacagtttatttaaaataaaactattgaaattcctttgcttagaaaggccatgcatggataatttgatatatgagcatatgtgggtaaacactgacatacagattacacatgctcaccatgttgatgctacactcagcaagctaaatatccacagagaagctaaagtctgcaattaaagcagatcagggagaatgaagtaatggcttttcatagcatctatctcttggcattacctgatcatcaagcatcttcgagaaatccttaagaacccggcgacgatctttctcaccctgttgaacctgctgcccgtactgttttactttcttcttcatcaacttgtagtttatgtagtacctggaaacatcggtataaaaaagaggcaaagctaaatttcggtaactaagtatcaactatttcaatgtatcattagactatcaggtttgttaagaaaaaaataataagtttccatagaaaaaattatctggtgaggggtggaagactgatgatatttacagaactggtaagcgtagaatggtccataaaaattaaagtaataaaagccctgaatcataccctttccattccggaatttgatcagccatcaatttcttcccaaagttaaccatcttgacttggagatattaaactgcaaaggaacttatgtatgtcaatacttgtcagcagcacagctggaattatgaacatatttaatacaattgatgagatgcgtgccatcaaaatggaacaggactggcaatttacaaagttaggaaagtaatctgcttctgaacaaatgagcactgctcaatgtatctcagtgcctttgtgcagacaaactgtgcaagctgttttaagcggaacaaaacgacaaacttagtagcggagatcaaaataagtgcaccagaaatacacttcatatgactggtttgcaataaggtcgctttgttgtgatgtcattcaagtgcaaggtttactatgcataaaaccaaaatcatgttgtagttttgtgcgcgtaaccgacgccctttcaatactcttaattttatttaggcagtcacacactactctgttctcagtaaccaatgagacatgcatgaacttatattgacaacgattccccggtccttttcagttgacctaacatattggaccaatgattaagaaaaaaaaacatggatgaacttggacaacacaaaaatgattcatggaaaatgaaggcacaaaaagcaaactatgcaactaactgtaacagtttagcaccagaatcccatgcaggcaactagaactgaacctataattcgtaaatacatccgagggaatggctacagacagcttttcgaagactggcgaaattcagtgtaaaggtaacttgtttttttttccaactgggccgtgcatgtagatcgcaaagtgaaggtatgaatctaatagcataaattctacaattccagccttacaaattccaagcataataaaccaacaaatacgaaaatcatacaaccctagacagacatgtagtagaagctaagtaaatcctaacttgtcaacctattcccaaaacctgtaacagatcacaaatcggagcggagcgactctgctcccaaccccaaccccaaccccaaccccaagttagcagttaccacaggtgcaacacctacgccaaaatcgagcgaaccggcggggatgagccggaaggaggtggcggcggcggctggagggggcgcgggtgcggaatcgggagcggagggatcttcctcggcgggagacggcggcggcggctataccgggaggtgacgctggcgctgcgcgacgccaaggccgacttctccttcctccgcgcgcgggggctccgcaccgcagcctcctcggctccctcctccgctccaccgcctccgccaccgacgactcgcagctgctcctcttccggcattcccagcctatccccgaaccaccccgcgctaaccctcctcgcgtaaacaagtaaaatcgaagcgcgaattcgcttgcagccggaggcgatctcgccattacctctctcttcagcccaacagcgcagcagaagatcggagatccgccgcgagggagcgcggattggggggaaggcggaggaggaggaggagcgcgggaggcggcggcggggcggggggtatttataggcgcgagaagctaccgcggcggcgagctcgcctctcttctcttctcttctcgggcgagccaatttcggaaagggaacaccagctttccgcttaaatcgcggtgatatattttttatttttttaaaaaaaaatatattccggagtgtccacatcacacgccacgtggcgctcgcttgttccgatcattgcagcagcggcggcggtgggtagatcgaggggtacggttgtgaatattacgaaaggttgagggggttttgacgaaatgtttgctctcggcttagctggcagccgaccgatgcgcgcgtgggtggtggggattttgcggcggccgcacgttctcttgctccagcagtactaggttggggcccacccgtaagagcaagttcaatagtatagcccattaatgactccaattcacctatagtcaattcatacaacagctatttactatgctatttatatgtggtcccatctatcatacgcacaatgtgtcttaaagtccatactgcaattggctacagatctgtagcccgctgcttttttctctcatattttattttattaaaatatgtttataactggctaatagtccgctattgtttttactctaagtatgcagtgaacaagtggatcatgttgcatcgtgaggggaaaaaataaataaataatccgatcaaatgttggcgccggcggctcaacaagtccacatcattgctggttggtggacaaacattccatcttaaactaattgtttgagccatgattgataagtaaaacgaatattttattataagtcgaaatttctatgtattttttgtttgcggtttataaaatcaacattgaaaaataaaccatgataaaaaaatttagaattaaattacaaaactcaatttttagcagtgaataattaataataagttgacaagcatacgacgatggccacacacgcaacagaactgttgaacaccattccgaaaagaaaatctctggtgcggtaatagctgcacttgtattttaggtctggtaagaaacgatattattcctgagtaatttatttccctttccccgaaaaaaaaagaaaagaaaaaaaaataaagttgaacaccacaccataaacatgcggcaaaacgcaagatgaaaagaaaagcaattattaaaacccgtcaaaaatggcagtcaggcgagtcattaaccctgaccacaagatcgacagccagattacaaaagccaagttggtttggctcttctcgccttcaaaccggctgaagattagctcgcgtccgatcgggacaaaaaaacttgatttggcagcaagctgaagccgacatcaaaataaataccatgataataataatgcaacacatggccatccttatcctaattatggagtattaatcaactgaaatatttactcctagtcacactactgggccggattagtgcatcatcacgatctgtctgtctatctatcgaatcaatatagaatccaaaccgattgagatggccggaatgaatggagctttcagtttcaggccagaccatgacttatgatcgccaaccaacgaattttttttaaactaaggcaattcgatatgtgcctgcgagcactgtagcatcactgtagcgcactgttcacgcaaccctatcgaactttggctgttcgatatgtccctgcctagcattgtagtgatactgttcatgtaattttttatttatttttggaccacctaccctgtcgaactcacgcagttcgacatgtacctgtcgaactgtggttgttcgataggtatccctgtcgaaccgcggttgttcgacagggtgctaaacttgcgatttcgcctaactgacctatagttttgcgattttccattaaaatcatattgcttttaaaaaaaattcgccaaccaacctcacattgttttccatgtgacttgtcgtagctaaaatttaaattttaaaagttactattctttaactaaatttgatagattatattttagaaaatacaacacagatgtagatgttcataaaacacacactcatttgtataaacgcacgcaatcacattttatttttataagcatcggcgaaagactgaactgacgtatttgagattgacgaagaacaaatatataaatatataaaagttctaccatataagttttctatgacttatcaacggtcgatagagcaaacgagatgaggctagaagggaaaaagaaaacaaaaggcaatgtaatcaatggttcaaatcgtggtaggctctgctgatgtgggctatactcactacgacgctatcttcggacagtgtagatcaatcatgctatgagatgagatgagatatgatcgacggcgacgagacgctgcatgtggatttgtgctggaacgacattatcttttcgattatacttatatttataagctaaaatttaaattttcaattttaaatttgaagttgattgtaaggttttttcatcgaagttttatttttcagtctttgcttttaaatcgctaaaaacacttatgcaaaagttttatttataaattattttttgtttgcgaatatgccgtttcggggacggaatcaataaactgccggatgattatatatgaagatgataattaaagaaacctttttggtagcatgttgccgtcacctgaatatagggaaatgatcaggcctgtttggaagagtgtagggttcatatattatttcgtccatataggaatatatatatatatatatatatatatatatatat

SEQ ID NO: 48387 - DNA, 703 bp, Oryza sativa
gagggatcttcatctgcgggaagcagcggcggcggttgggagctcgcggaggcgctggcgcggcggcggttgtaccgggaggtgacgctggcgctgcgcacggggctgcgcgacgccaaggccgacttctccttcctccgcgcgcgggggctccgcagcctcctcggcttcctccgctccaccgcctccgccaccgacgactcgcagctgctcctcttccggcattcccagtctatccccgatctccaaggtacaaaccgattttcccatccattccggcgatccaacgatagggcaccgggttgttctcgtgattctcatccggcgccgtaattggagcgacatttggttggcctgatctctaatgcaatgcaatatccagtggtggttagaatgaaatcgatgaacatagttactgtcttgccacaatcggcacaaatttaagatgagagcatcgagtaaacctatttgttattagatgtaacatgtcagtcagaacacaagattcagtattaggtgataagcgctgattgagctggtttagtttggtgctgcacaaaacttggttcattataaatgaaacaagtgctcttggtggtatgtgtttattatatcgatgctaatgctttctacttctcttcgtgatgcatttatggggagagctaacctcataacggtaccttgataatctctttccgagtta

SEQ ID NO: 48388 - DNA, 5000 bp, Oryza sativa
  unsure (1)..(5000): unsure at all n locations
nnnnnnnnnnnnnnnnnnnnnnnnnnnnnnnntttaaggctaaaatggaaagagggaattacagaatggaaggttccttcaagaatacacgagcaattgatactcgttgtttctccccaccgcttaactgcaaaggaagtaaaatcacagattttgagacattattgctaggaccaacaggttctgactattctggatttggcatgtcataagacactgcatctcacctttaatcctcgctctcccacaactgtgttgtacttgtcaggaaagttcataattgtatcatgaatagcagcccggcgggcaacgtcataaacctgtacgcaaataaactttagcttgaacaaggtcaaatgaccctactccctccgtcccaaaatataagggatttatggggggagtactataacttcataatgtaaatgtattggtagaacacagtacctcctcatctgttgctgataaccgcccatattgtatattatgcttaattgtgtcattaaaaagtacctgcattggataatgcattaacagtgtgagctactgagctcttggagtgaactgtggtaactcctaactgatatgtgaaaagcatgttgatagagctacttctatttactcaacaactttacatatgctaactaaagttgcacaagggcaccagaatgttccaattgtgtatagtctacatgctttatccatttagcatagtaaattcaataagacaagaaaagtaatgcagcattgacagatttagagcagtagatagctaaccgtatcttgcggtacaacaccaatacacttccggagactatccagtgtcacctctcggatatcttgcccatctattcgaatctgcaaagatcaaacaaaaggcatcacaagaatggcaagcttgatacacatctgaagatatacatgctataaaacggatatcaatttcatcatcagggaatcaaaatggaaatagatcgttctttgttcttacagatcctgaagaggagtcaaaaaatctgaagagaagcctaagtatggttgactttcctgtagaggaatacagttaatgaattgttcgttgatcacataaatttgaattttgctaatattgataaaacaagatatctcattccatacaaccccaaaaaaatcactatagtcagccttgaatcagacataaatagacaaaacgtacaaccatgccagatggttatttgaaatgaccttatcagaccataagcatgtttgtccaaattatagaccaaagagaacacctaacccctaattttttttagttaacccaaaattcagattaaagccttaagagacagcccctgttggatattaaaaaggcaaacatttttctaggaaaataacaattacaatatacacccaaagcttattgttgttcagtataggtaggccaagcaggctttaattagtatttgaaaacatccattgctagaaaacttgatatccttcattaataacttttctctctttgccatggcatggaaaaaaatatggaagtattggcttgtgctactctttaatagaaggggggagcccgggaaacaccaaaaagcccatcctctttttaacaaaacaatttgctgatacgaccatgggagaactcatacacgccttcaacttttgagtcaagttaaacaattggtagatgcaatttgacaaaaaaaaagttttaccgctgccactagttccaacgattgcaacactctttcctgcaggtacagtgaacgtggcacccttaagaatcttcctttctggtacgtacctggaagaaatcagttccttcaggtaaactacaacattaactcagataagtctactttacaagttagactacataatagatagtcataaaatttgcttaattgtacttagtgctttgatagattccataatgatatattgccagtcatttacatcccaatatgcacataaattgttgacccacatatgaggtaattaaaggttgttcaaattcaaatcgtgacagcaacgtagatccctaaggcagcagtatctgatactgttttactcagatgccagatggtaaaaaataacaacatgagaatattttacctatttgaacttgattgagaattgaggcgatggtcaagataaaatttaaatattacaggagagccccaaccaaagggaccccttttaccaaattacctggaccaaacaagggaaagaaattccatcgtctacggagataaatgttaggagggctccaatatttcacttgggtgttcaaatgctctgagagacgtgactttttaaggaagtggtacaagcatgtaataagtaaacagaacgcaaaatttacccaaaatgcacgttctcaaattcaatgcgtcctcccttgaactgcaaaggctgtgcatgtggttcatcctttattccaggtttttcctgaacaaagtgaaataacagcaatgaagtttctggggttgtgaaaggatgaaactgaaactgcaagccatttaggcccccaacagatagtcacgaagtttttacctcaagcaattgaaacatagacttatgtcaatcaggctttgcctagattctcgatagacacttccaaggaagttcagaggcaaagaaagttggaatagaagaccattaaccataacctagatatcaaaatttaatcaaattaataaaaatcagtcaaaaataaagaagaaaagcagaaaactggcaacatctggaactgatggttcatggttcaaaattaactattgttccaaatccacataattagttcataatcaatgatcatttgacacccctcgaagtggcatttgatgatttgccaccgctctgcctttgatacatggaccctggggctacatgtcatagaaacatgagtggcaaataatcaatttgacactctaaaggagtagcatatgatcaaaactttccagttagcccttttcacttaaacaaccttcctgactataaaataaacataatattgcaacaacatgctttgccactgtatgaaatggatatggtgctaaccgaacatgtcaaaacgggataagaaatacttgcatcaaataatatataagcggatgtcataaaaaattaccaaatcaccgacagtcagagcaccactcattacaccgtatgaactcaaaaccatagccgtggataaagccgagctaaatatgatattttgtccaaagttcaggtaggcaaggctactttgggttttcagtgcagcatcctcatactctgaccaaattgtgaaaaagaaatagtaattaatagatcaaattttataaaccaatttacgatatatgccaaagcaacatgtcagctaggattcatcagatttacatagcatataactaagcacttgataaatcaatgtgtacaagctcctaattgtttgtgaagattgaaaaaaaaaatccaagatgcaatatcaaccctactgtttctcatggaaaacattttccacatgtatttcatgcctcaatataagtttttttggtagtttttatagaagatgaaaataacattaaaaccagtgaattaaatgcatagagtatatctttcaaaaaaaagtgtatcgagtaacatatgcatgtctacacgttaacaaggtttcttcccagaatgaacattatatatgtactcactctttaaatatttgtcatacttctcaacttcaaattgttcattgttgaagtacttgacagtctggcccaataaaggaagttagaaaaaaaaaggttaatacaattagaatatgaaagcttaagaacatagactagatgccaggccaattgaaaatcatggtattacctcatagttcagaagggagtcaactgccactgtgctagaagcgttatcagctttattcatggctgtcctgaatttggtccgccactgtcataataatgcattacgagtcaaggcattagtgacaaaaaaacagcaaaaaatcttgttagactatgcatggatgacagacacggtctgatagagcacatcattcacacctgcgtcacagccaaggtgaaagcaatataagtagcaacagaaactgaagtaatccaagcaaaggtggaaccaaatttgtatgcaagtatacttgacaccataccaatctgtaaatggaaagaaaaaaaacagaaggcacacatcagacaaaaatgtaaaatgtgactggcatacattacggaaagttagaaacaccaacattgcgcgtatatgcatagttgatgggatataacagtcaatgacaataatctgagtacctccaatattgtgggaacaacattgaacaccatcactgtaaggatgtaatttatcgcacgactacctcgatcaattatgcgatttagggcaccagtttgccggctgaaaatatagaagccaggtaaaggcatataagagctcagataattttcaactttccagttctaaaactcatgaaatatctgattatttgcttgtttcttataacttgtttccacaccaattttcagaagaatcaaagtgggatataggctataaccaccaaaatagtgcagccctagactaggtttctcatcatctcccatgcgtaaatgctgaaatatatacatgcagtcaagctactaatttggcaattccttgcaattatttgctacaacttgtaagccacctacattaactgtgatgcttttctatatattgtattgtgcatgtgtgcattaacggaaatatatcatttgataaatttaagataaacaaacatataagatgaataggaggcattttctagaagtaccttagatgataacgaagatcaagctcatgcaagtgcgaaaatacctgcaacagcaagagctcagaaggtaagataacccataatttaaccagtaaggtagtgtttggttgcaaggatgggatgggatgggatgggacgaacccacttttaggggtgtttggtttaggggtgggtgggatgggtt

SEQ ID NO: 48389 - DNA, 8826 bp, Oryza sativa
cgtcccacctgggacgagcgacggcgtcaccgcgccatcaccaccttcgcgagctccgccgggcgcccacgagcgtcgccgcctcgtccacacccgccgccacctccacacgtctttctcggccgccgccgcctccttgagcgccgccgcctctgcctcgtccgcgaccgccgccgcctccatgagcgccgccgcttgcccgcgaccaccacctccgcgcgtccacgagcgccgcctcgcctccacggccgccgccgccgcctccacgagtgccgccgctcatccgtgaccgccacctccgctagcaccgccgccactccactcagatccagccgccgcctcgcctccgcgcccggcgcctcctccgcttggtccatgactgccgccacctccacgagcaccgtgaccgccatctccacaaactccgccacctctgcctcgtctacgaccgccgccgccaccttcgcaagcgccgccgccggtcctctcagatccgggcgccgccgagtgcctctgcccctagacggcactaacggtgagtacaaatccgtccatcccatcccacctcaatcccttctaccaaacaaaaaactataaccatcccataccataaaccaaacagacaactggaaccatcccatcccacaaaactaggataggtctgacccatcccacttcgtccccaaaccaaacactacctaaaggagcatgtagctttattagcataaacagttccatatgattaaaaatgacagaaaatgataaagaattatcatagtcattacagatgggagtgcacatcgggccagtagcatgatcaacagtcaatgaccagctagatgaggatgcagatgtcaagatagtaatagctattttttaatgattttttctcaagcttttttttccatgaatttaatttttttaatatataaatgttgtggaaagtactgtttacaatactagcaacactacataaataagacaagtacatcaatgcgtagaaagaaataaaacttgagataaacaaaagattcataaatcataatgtgctggaacatctagataatagaggaatttagtagatggttggaaaaacatgacaaatgagtggtaacattggaataaaaaaggaaatttcaatagttaccgtactggagactgaacggatggctctcaatgtcactttagaaaagacagcatttcgcagttctggcaacagaaatcgacgaataaatcagtagaatcagtatatatttcaaagaggggcctggcaatgcatgttgctccaagctcacgaaaggaactcattttttcagggaaagaaacaaccatgcttttttttctaaccaaaaagagtttacctgtacaggctgatactcccgatcgtgcaattccatatccaatcagaacagctgctgggcttgcaaagagagccaatagggtagcattagcctctgtgaatgatgcaagtgaagtttcagcaccagcaagggctgcaagccaatcgacagcaagcttaaacaagaaaggcacttgaacatttataacctggtgttcattataaatgaaaacggtcagataaataagttgaaagttccatgtaaactgtaataacagccaacttctgtggttatcatttcttatatgccctaaatgaaggtgcataattattcctttgatttgacaacagtacttgaaaatagttgtgtatctaacaagcggaacttggcaaaaatattttgaggatatacatccaacagataggccatatctagctactagattgcatcatattatgccaaaatgattccttctataagtaaaaaatgtcactgcagaataagaagtgaatatgtatagaactccagccaggaagattagtattgatctcaatccagcataatggtcaatggtactctatcatgagataagtggcagcttataaggaattgccataatgtgcaccttgttattattcattaatgactaattaataacaaaagaaatatcttaacaacagaattaggctgcaggtttatcttagccacaaaatactctgctcatatgggttaccactttcaggtgtagcattacctttgccccaactaagaggcccaatgacaatataagcctgaagcggaaatccgggctatcattcaacaataagtatttcccaaggtttttcagtatctgtgtatctgctatctgatcatcaacatcctttttggagatatctttcttcactttgtcatcagatgatttcccaactgccacagcattggcagatgtggaaaatgcatgtcctctctgcaaacatggcaagaatcacaaaaaaacaaactcaacaaatgagtcctttcatagtacaaaggaaaacaacagagccaagtaaccaaactcagactcaattttctgtattggatattgattactagagttgaaatcaaccgtgagatacttgaagaacatttaataaagatgaaaacaatgcattttaaataccaaaaaattgcttgacagaatcatcacaagcgtagcaaatattattgcttgtaatcatatatatgaaaaaatgtgagtaagcgtgtttgtactttattttgtgatctgatggattaagtctgaaaaaatcatcagaagcataacaaatatcaacttgaacgcacgaatgtcagcaatgacaaaggaaacaagggtatagtaaatttctgataaatttatccttttgcaaggactgagaataacactgaaacaaaaccaaatgcgcccagcaatgccatccacaatgcttaataatccttttttaagttcctgtatcggtcaaactagtaactaatcacatctactacagtctacagccgactgttttgctaggaaactcgcttgtttgactgaagtattgatacaatacaaaatacataatcaaccactactgcctctaaccatccccaaatcgaaactaaaccaaatgcaataagcacaatgcagtaagccagtaaccacaagttaccacatcgcggggaggcggcgggtaggtggagtccgacatgaagcagctgaggcgaccaaagggggcatacttcccgtcgccgggataaacccaacaattcggcccgaagcctccgagcagagggctcgggagaggcctcggcacggtcggcggccgccggaatatgggggcggcagcggcgaccggcgaggggtcgtagcgtgagcgtgagccgcggaggaggtggcccgcggccagtatgcgggaggtcggcctcatggcgctcgccggcgacgacgatgcagatgattggatggaagccgaagcgtggaagaggcggagttggacttggacactgccccgttaaaaaaacggggctgataacgggtcgggctcggctcgcccgcggttccttggaaaccgcagctcggctgttcggagtgggatcggagcggtggagctcggcggcgccggcgatgtcgccggcggcggccagtggagatggggaaaaggcggctactggtgctacgttttttgttttttgtttttttgtgaagcagcaatttgttcagggatcccggatactccatccacctcacgaaaaacgatttttcctgttatttcaaaaaaaaacagataaaagaaaaacaacctttttttttcaaacaaactcttttcaagtttttcccggtgggaaaacaagttgtttctaaagttaagcaataaggacttgtcttagtttcgtctttagaaatttagagtctagagtaaatgtaatttagggttaaattttaaaaactacatgtataatccttacttcattctatgtcgaataaaaaatcaagggaacatgaattgggcatacttcttttttttttatgtgcgtgggcatgaggcatgcgacgcactaacaagatgaatcatcaaagcacatacctgacacatgataccgatcatcgaatttttgtcaacttacttttgcacataaatagctaaaaaaaatgttataataaagttgtgctaatgggtttttctctctccggtttggggccatgtgccgccgctaagttggcacatcttcatagaaaagcatttgacactgactatacttctacattagaaaaaaaaattagagttggttctaatgttatattagcattggagagggtgtaatgttatattaggattatatggttttatactatgttgttgtgatatattagtatgatataattacaagattataatacacacataaatgttataaatatcggtaaaaaaaggctaatccaactattaaataaccagtacacacaggctagagaacccactaaaacacaacccaataacctaattttcaagaataagtagccaaatgtgtagggtgaccctttcaataaagatgtgtagggtgactggatgagattgcttttggttgtattttcttgtaacaagacctgtatgtgtaggatgagggtgggtttttttcccttctcatgtttccttctttcttgataattttgcaaaatttattttgagtaaatttcacaaaactacaaatattatgatcaaactatcacaaaactacagatttaactcggtgtatcacaaaactacatatttaacattaaattatcacaaactatatatttaaaataaagtgttataaaactacatatttagtaataactaaattatcccagtcaaaaaaaatatagctccaacataacaactatgctaaggatttaaactctaaagctatagtttgtgataactttaatattaattgtttagttttgtgatatttagccttaaatctatagttttgggataaatttagtgctaaatctgtagttatgcgatacaacaccttaaatatatagttttgtgatagtttgatcaaaatatatatagttttgtgaatttttattcacttattattttctacaagaatctgaaaagaagatagaagtcatacttaacgggcccagatattcacgaaaggcccagcgcgggaaaccaatgggctgataagcccatggcaacgtggcccaccgagttgatcagactagatccaacggtgaagaacccagaggcttaatccaacggcagctgctttctaggcggccctccggttatagccggcgagcgctccaccccacccgccgaattttccctccaacctgctaaaaccctagcacccgccgcccccgacggcgccgctcgacgacgagtcgccggcgtcggtcgccgacgagagctagggcaagtgcggcggtacagggtttcagaggaggaggggagcatggcgtcgaacaacggcgcggggaccctcaggtcaacctccatcaacggcgtcaagctctactccatcaccggcaaccgctacgtcgccccatgggtcctctcgaagaagaagcgcgccctccgcaaggacgcaggcatcctaactcgcctcacgctcatctgctctctctattttgggttcttttttcttgtgcaaatgacatgtattttctcatttattgtcgtgttgctgtcctttttttttgggggtctttttagagtatcagcggaggctggatttgatccatgacctgaggttcgagaccgccaccaccaagatcaaggtgacaccggatgagcagtatgtgatcgcctcaggtatgcgagctcgctgaatccaccattttctgcaccggcgttgctttgatcaggttaaactccacagtgcatactcagaaaggcatataactaacatataccctggaataaaaggcagtgcgtcaatataacgtaatggtggttcaggagtcagttcgcataagttgctgaaggaataggtgtccaacaatatctttagtctgtagtgtctttctgcgtccatgtccacacctataattgagctttcatccttgcctcactcagatgagttcgcatagtctagcgaagttaagatgaaagctcatgttctgggtgcgagttggcattggagcatcacacaattatcgtggaatgctgccgtccccctactatgtcattggcttgcgcttcatcgtccccctactatgtccttggcttgtgcttcatttgaagtcagagtcaaaacatttaaaccactaaggcgtttcttggagaagcttgcgtttatgtttgcttattgtgagtccaactttgaataatcccatgccttcagaaacaatccatgtaattcatgctctacaccttttttctttagtttgtaatatcacttgttagtttaatcttcacctttaatgtgtttcagtattgtcactttcatcagattgtttacacctctgtatgtaagtggaattctctgtctatgatgtcaggtatttaccccccacaagttaagtctatgaattgaaggagttatcaatgaagtttgagaggcacatgatttcagaaattgtagatttccaggtgggactaggctctagtgaagctcattcctcttttactatggagaagacatttgaattttccacaaatcagaaacttgcattttcattagctgtgtaacaaattagattgttaacttagactgtagtacatctctgttgaatttattttgcttatgagagttttatactttccgctatgagttcatgctttgtcgtgggatgtaatttaaagtatttccacattgatacaaaccattggagattaactgctcaaaattgtctactatgcttgtaggtgccaacctctgtatctttccttttgtatattttctatctaataacacatattgcatctttctgtaggtccttggtgatgattactcaaaacttgcatttttgtgtgctgaccgttctgtatgcctgcatgcaaagtacggtagacactatagcttgagaattccaaggttagtctgtccttatcacctacatcctatttcttatatacttttcatgcactaactacttggccctttggtaaagtgaagcgacatcttcaagaacacataaactgtcagaattaatatttgaaccattaacattctaacttccctcctgcctctcatgctgattaaacccagctcattttaaacgctactcttctgtgctcctactgctgattaggtgcatgttaagtcatcgacttggttgcattgctttagcccacctcctgctgctcatgctgaaaaggccaactatttgggcatttttggccttggcactggctgcataatttccatttcgtcgctgccaaggatgagatatatctcaggtttttttttgagtctttggagtctgatcaggatgaagctttagcaaaactaaaacaacatgatcacatcattttctcttcttttccgtgatttccaaacaaagtagtctagagaagataacagtgagcatggtaataaaatcaataattttcatctggcattgacagtattctgtttaattttctccatcttgcacctccatgtctgcctcttgatttctacatgcaaattcctgcagcaatacatggagtatcacatgtagtatagtagtactaaacagccacctgttgccagatgcagacttagttatatgggctggtctggattagtaccaaattttgccctaccaaagttttggcaacttaaattgtgtcatcttgatgtttggtttggtgccaaattttgccacactagttctaagttctaattagcagtactataccctatcaaatttggtagtgcccaaacctgcctaggttttcgtactaccaattatttggtatggtacatttttggctccaccaatcttactgaaggatatttctcgcatttcattgttctgtcttaattcaatacattttgactgccctattatcaacattcttttagtgtcttatggccagtcagagctatgtaattattgttggttacatgtttagtatgctagaaagtagtaagagctccctgttgcctgtgcaaacatagttgtctatctgctgcataatgattttttcttttagtttctacattttgtatctcttcttatatcatgggtctaaactaagcttctttgagatgatgataactgataacactatagtaatggaatgtttcaatacataacttgccttaattttgcatgttgctgatttccattttgacagaatgggaagagatatggcatatgattgctggtcttgtgatttgctttgcgctgcttcatcaccagatgtgtatagaatcaatttagagcaggtctgttttctttcttcatcattgatatgtattttaaatatctggttaccttagtcttaggaaaaatcatactatactttgtttggcacctgttagtacagaaccaagatagagatgatacttaattaggttgtttgaatgtaagcctaactatagctttatcgcatatcctctgattaatttttctcatcatctatcctgaatctaactaaatattcttcatataccttgtattaagttgctaatagttgcaacattacaatggtgttttcttctcatcatttgctttcagtcttttcagagaatgaatttgatcatttcttaatgtacttaatgcagggacgattccttgcatctctttcatctcaatctccagcaataaatgtggtttctcggaggtagttctttgttattgacttgtatatttttgaaaatgccaagcttatcaagtagttcaattctctctttttatttgttgtactcccagtaacatacatgggctcattgcttgtggtggtgaggatggtgtggttgagtgctttgatatgaggagaaaatcttctgttggcagaattaacacagctgtctctcctgaagattttaatca

SEQ ID NO: 48390 - DNA, 705 bp, Oryza sativa
agacagaagcttcacacgagtttcagaagcagaaaaggttttcttttcttttttccagggagtagtggatgggtgcggaattgcagatgcagcctgaaatttgtccgttcaaaatggatgcaggaacggcggtggtatttggagtgtcgtctgctttagttttgtcctgtttcagttgagtgtgatgccatgtagtgtagctgctatggtcacgactcacaacttacaaaaacaatgctgaaaaataaattataacaaaaaagaacatcagcatcaattctaaacgagttttatagtttaatgacatattttgaatcgcaataatggaaaagcatataaaaaaacacaggattctaacagtaattcaagtgtaaaataaatgattgtagaacacataaaaaaacataagaatgtttgtctgatttaaccacatgaaaaacatataaatttgagtagacataaagactcgacggaaagctttctagagattatacctcatgttaaatttactttaaaacttgtatggaatgagatattctgtaggattccataatattcattcttctgattttaaaatccatataagaaaattcctatagaaacgaaattcttataatttttcagtgaatcgaagagggcctaaatttccgctagctgaaaaacaattagtgttgtcccgtgttgaattgagtgtgatgccatgta

SEQ ID NO: 48391 - DNA, 13968 bp, Oryza sativa
  unsure (1)..(13968): unsure at all n locations
nnnnnnnnnnnnnnnnnnnnnnnnnnnnnnnnnnnnnnnnnnnnnnnnnnnnggaagtaacatgggtaaaataaatttctttagtagtattagatattgcacgcataaaatccatgtcacacaaaacaacatacgacataaccctagtgcatcaagcacaataatggagtaatgtctattgtatacatgtgacttctttaaataacactgcacccaatttcttttaaattctgcaggttatgaactgcccttcacattttggggaacttactccgcatacccttttctttggcattcttctgccaattttcaggaaccttaatatttctagtgatgatgaatggggagcaaaacaagacggaaccaataaggagattatatctggactaaattgcaaagtgtgggtgcaatttgagaactacgacgatttcaacagtgcaatgcaggcattatgtggacgttcattagaaaaagtaagattttcatattctgttaccagttatctctcaatccttaactttttattagttcacataacacatataaatgatattgtgagcataccctctagattttttttttgaagtcaatatcctctagattttcctttctggtttccttctatataggttttttgtttcaactgtgcagctctgttttagcattacctactggcaattatcatgcactgacgttgcatagcacacatccttcagaccttcacatgcccttctgatgtgtgaacttgtatgctagaggtatttgtggtagtgtaggattgtgtttcttgtatcctatatattttgtcctgttggccttttcaaatacatccaagcgttctgagtcttccaataaagttagcaggatatcacatcactatcttccactgaagttaaccatcaccctctatcagcgtgtgtttgtttcaagggatgggatgggttgggttgggttgaacccacttttagagtgccaggcagtaccttcatgcgttagcttatggttatctggttgcttccttgtttggtgaaccctgccgataaacattccatggtcagataaatggctatgtttattgaaagcaaagtgaccacattagtgtttactaactagagagatcattactaaattagctagacaagaggactacaaaattactaaggtattagatacttcaggtattagaaattattagaatgcatcagcttctatgaggattgaggaccacaattgttggtaggatttgttgctttccttccacatacagctctgatgagtgatgactgatatatactatctcatattcactaccttggcaccacaacttaagtttaagctgcataaatttgttacacatggataaatccacatatgtatactatatatgccagaacagcctcaattaatgtcttgttatcatttatgttttatgttttagaaaacataatggaagctgactcatctattctgtttgaaggaaggatcacggttgaaggtagactatgaagtaacttgggatcatgaaggtttcttccgcaatgcacaatacgagcctgttcgcagcaatttagaagagagaaattcatcggctcatggaaggaagaaacattacacatcgcgaattgagtcagatcatagaaagagatttagggtaggacaacatatcaaatctttctaatataagtatttgtgatgtgatgtgcattcatcttcattgggtgcatcctgatgcatattttcatcttgccgggggtttaatagtgctgaacggctgggagcatagaatgcaatatcaaccgcatcccatttagttatcatggatgatttgcctgtggctgtattgataattgtatatatttgttcctcttggcccgaatgctgtattgcttacttcatttttaccattctctttgtaacattttctaacatctattatttcccttatgattcaggattgatggatatagggcatggcatgatggtgggattacttggttccaaggacagggaaaatgattgtactgtatcattctgttgtttcatcattagtctaacagtaaagtctttctgaattaggtattgcgtagttattactattagcctatgtcctggttgattcccagagatcatcacaacacagtcttgcttgtgatttgtaaaagaatttgcactgttggcatctcaatgtatgctcattcattgttcaatcacaaactcacaattttgctgaatgagaaattgcaatggctaagatcagcctaagcctgcaaattctaagcataactgtttgtattggttaaaagtcagataatgtgaattgacattgacgaggcaggtacaattgcattttcttctggattgtcaaacaagtaagttctctaacttctagaagtaaacatgcttgactttctattcattgtgatatgcgtggctacacaatcacatgcctgaatctagaagttctttactgatgattgtacctaaaaacaaggtcaacggatagagccaaaaaaaaaaaacatgtttccacaacgtataaacgaatggcgctctctcaaatcaaccagagatccagaagtcgaaggcatagttaacatacatagagatgaaaataaactgccagtacaccagggacgagttaatggacaaaattctgtaaaatttatgaacaattttgggtagccacacaagaagggggctgatgctacatgaacactggatgcaattgcaaccaaactgaatcgaaacggtaggaaagataacaaaaaaaatctgatcttcctggccaccctactgtacaaacatttacaaacacggcgttgattttttcacagcgtgtggtgaatgaatccacgcgaattactaccctttcttcccatgtggatgacttctcggcgagatcaactcatggacaccggagctacccctcttgccgtgcgaaggacccagcaatggcgtcacggccatcttcttgtcgctcgccttcttgccgagaaccttgacggcggccttcgatctcctcacgccgtgcgccccgccggcgccgccggcgccattagagctggccgtcaggatcggcacgaggtaccaccagacggaggtgcagcagatggcgaacaccttgccgaacaccacgaggctcgccagcagcagcaccgccacgaacggcatgtagtggcgcggccgcacgtccgaccacgaccacctcacgccggccttccgcttcgcactccccggctccgccgccgccgcggcggcggcggggcgcgcgggcttgatcacgtcctccctggggctggcgggctccgacgtcggtggcgtggacgactgcgaaaggtcgccgacgtcgcggccgcttgctgcttcggcttgttcttccttcccttccgctgctgctgttcctcctcctcaggcgggagcttgacgacgatgggcacccaccctttcccctccgactgcacgaccggacgagcacatgctcaccaccaccaccgccgccgccctcccccggtgcgccgccgccgccggcgccgccgacttggcgaaggatcttctcccgccgcgactcgagctcggacagcacggtggagaacttgtcgagccccctcgacgcgtacgggttctccttcttcccaccaccaccaccgccgccctgcttcttcttcttcgcctccggcgccgccgccttgccgtcgacgtccttgaaactgcccgtgccgcagaacaacatctcttgcatattaccgtgtgcggatcaacgatttctggcgccacgggcacgagccttttaaagaggatttgccaacgcaacgcaacgcaacgcgatcgcctctgtttctgtcccgactcgtttatttcttgggtctccgcgacgacctgctcttcttctagtacgtgttattattattttttttgtgtgtttttctttctggagcaaagacttgatcttcagatgttggcgcgtgattgctgcctgcctatgcgtgtgcttggtcaagtatggatgtctgaaagaaatatgtattcaatttcgttcagaaagatactactgttcagttttgtaaaagaaaattaatttcgtgccttgcttgccacgattgacccggtggagttgtgcgagtaacaaaatgcagaggaatctgccgagagcaatttggccggtactagctttttagtatgtgatgataactaaaatcttactattaatttactcttgtgattctgcatcaagctagctaccgacaatgacagttacccgtcgatcgagctcggttcgagctcacgatctgcgccggattgtatatcgagctcagctcgagcacagaatcgatctgattatgtgcagctcggatcagattagctctaagatgctggttaattggttgaccatatcaaatgggatcggatcattacagttcctgcatctattattccttttcttgaaaaaaaaaagagaaaacaacgtttctgcagcacgatttttttgctgcaggtttcgggtaatcacgttggtttcacgagctaacggcgctgagattggtttttcgacgtcatcggtttctctcgtttcgtggttttggagatgatgattgcctgcatttttctgccagatcatgatgtcatcgcgttttgcagcgttgatttctcgcgagcgtgagagcttctggcccgcggtaatatttgattgctgggcaaggcgtggactctgaattctgaaagcccttatcgctcgcgccgcgcagataaccttgaacagttgaatggatcaaaactcaaaaggctgcgtgattaattcatctgaaaacgagtcaaagtttcgagtgcaggtataagtcaaacttaaattataaatgtctattatttcttttttgaaaaactaactatgtaaattttaacctgaagaagaacagccataatatttgaaatcaatccggtagcctactgtaattagtttaaccagttttagttaatggcaggggagctgatcttgtttttgggtgcagttaattactacgttagttcgtaatcatttaatttgcttgactcaacgggctaaagacctgtggcattctagtatctctatctgctttatctgaagaagaatgttcgacggaagtggtcaagaacacggcagatagatatgacgacgtgcatcacgtacctcacgtacagtacaatcaagttaattcatcgccaattcctactagttagttagttactcctgctaattcttatcaagttcatcactgacatcagcgagacagttattatatagtatagtacttcactagcaatgtcacaattgatcatcgttacctggctgaaaacaattgattatcattcaacatcaccacaattcacacagtttacggagtatgataaatctcttcaaaatttattgtaaaaaaaatcagccaaagatcagctaagtactatattattttattaaccaattcactgacgaatcaacagacagttgcgtcagctatatacggcttgaactctgttttttttttaaaaaagaaatttatgtacgacttgaaaattgattaatcatcagtattactgagttagccgccggccggcgcctgacaaggataagctgccacgccagttaaattaacatgtgaatctaattaagctctcgattaatttcaaaccttctggatggattgtgtctaaccatgcgtgcagaaaattaacgcaggatgttgctgtcacttgctcatccatgactatcattacgaccatgctttcatagcagaatgtcataatgcaccgcaactatccaataaaaaaaagtcgttatcgtaatgtttttctaatagaacgcaaacaaagaagacttttatgtatttttctacgtgagcacgtacattaaaatccacattttgtactttctggaaaaaatcttactggatatgaatgaggacagggattgagattttagggttgtgcatgatttcctcgatgatcgtggaaaaataaatagtggattaacgtgaccttagaagagtgttacacgtcagctgttgcttgttaaataaaatgcactgttctagaactaggaaaaagatccaagataggaataccgtttgtatttattactgtattcaggtggacttatttgtggatttcgttggcatcaatgttgaaagtgatttagagatgtcatattgcattttcatgtgatcatagtcatacgtatttgtcctacacaatgttaatcacctttcatttttaggcgaaatactagagatttactccctcgttttgtagatatttaacgtttaaaacaagtttcgatcaactagtataagtttataaaatttaattagtctatattataagcagaatacacttatacttctaattcttttgtttttaaactaagcatgcgaaactattgatagttaaagtttcaaaataagatccaaatattttcctaaacatcaaatattcaataccaaatggtgtattaaattatctgaatacacttattatgggtggttatgctcttgatgaacttcatcacagggtagttgatataacggaactgaaaaatgaagtctataatttatcgaaggaataagtttatctgaggtctcttaattttacaccgattccgtttttcgttcttgaaccctaaaaccagatacaaccagtccttaaactgtcaaaaccggtgcaaatgaggtctctcagtggtttggaaggcggttttggctgacgtgggcctaacgtggctggtttgactaggtctccatcccacatgacattgacgtagcgcttacctggcaattatatctcggaaaataataaaaatcgtttcccacatgtgagctacacacaaaaatatttttaaaatagtggggcccacgtgggcctcacatgtcattctctctcctctctcggttctccctcttcttccctccgccgaccccgacctcttcttcgccgtccttgatcggcggcctcggccagttcggcatcatcacccgtgcccgcatccctctctcccctgcattttgtactctctggaaaaaaaaatcttactgtatatgaatgaggacagggattgagagttttagggttgtgcatgatttcctctatgatcgtgggaaaaaatagtggattaacgtgaccttataagagtgttacacgtcagctattgcttgttaaataaaatgtactgttctagaactaggaaaaagatccaagataggaatatcgtttgtatttatactatattcaggtggacttatttgtggatttctttggcatcgatattgaaaatgatttagagatgtaatcttgcattttcatgtgatcttttttttttcagaacttcatgtgatcatagtcatacgtatttgtcctcctacacaatgttaatcacttttcattcttaggcgaaatacaaaagacttactccctcgttttctagatagttaacgtttaaaacaagtttcggccaattagtattaagtttataaaatttaattagtctatattatgggcataaaacattgatactaccaagtcttttgtttttaaactaagcatttcaaagactattgatagttaaagtttcaaaagtaagatccaaataggtaaagttaactataggacactcaaaatttgtgtttgttgatagaaatcataaaaacgtgtcacggctgaaagacactcttaaaaaactgataatttgctaaatgacactttcggctcaattgaaaagaaaagttcttaaaaaagacaaggatgcccccacggtcaaaagattttgaactgagactagggtgaagataaaatatcacgtatactagtgatgtacttggggtgatgctaaatttggagttgcataatttctaaattcgtactttaacgttatgtttgaagcatgtgattctaggggcattcttgtctttctcaagaatttatctttttaattgagtcgatattgttctctaacaaattactagtatttttagatgtctttcatttgtgaatgttttttcgatgtctatcagcaaattacacgaaatttagatgttttgtagtaaaatttgccatccaaatattgtccggcctaaccatcaaatattcacgaccaaatggtgtattaaattatctgaatacacttattatgggtgattatgctcttgatgaacttcatcacggtgtagttgaaataacggaactgaaaaatgaattctataaattatcaaaagggccatcaagaattattccagaggcagcccaatataacattgccggcccagataagtcagtggttcatctggaccaaaacccaacgagctagtctaacctcggtatgggccttcaactccaaggctgcagatcacccactggaccataactgggcccagcacacagaaacaaatcgaattcgcaccagtctgggccgcaaggcccggcccataaaccaatcggatcccacaacactgggccgagaagattggcccaacatgagctgcttccaacatatcctcggtccagccgtctcttctcccaagttctgaagtgctctctctctctctctctcggtgtttccccttcggccttctcgtccgccccttctctcctccaccatccgcctcaccggcgtacggctccgacgagatggccgccccgctccggcggagcctcccctccctggggcgcacgctcctctcgccgtcccccgcgcccgcgcggatgctctccgcggcggcgtccgacgccctcgtcgagatcaagccaggcgagatcggcatggtctccggcatccccgaggagcacctccgccgcaaggtgcggtgcttcgctgaccttacctctgatttatgtagtggcgatagattggctagccctcgcggatccgtgtgggaatcgctcgagatgtccaggtttggtgggttgttttggtcgttactcgtgtttagggatagaggcatagagcctggaggcgtcgggtcgtgaactcgtcgtacggactacagtgctatcgctagtagacgttcgaatcgtggagtggatagaaatgcgaatttggtgatgatgttttacgcttgtgtggtttgaactgcgtttagaacttgggaggaatgtgctgctctccaggttgggttctcccactttagattatgttagtggagggctggaggcaacagagtttgatcaaattatcctgatttggtttatgtactgtgaatgactgaatgtatataggtgtatgttcttacctttcaaattgtttgtgattagagttgacagtattggtgttagagaactgtacataccagagtttagatgatgctaggatgcttattatttatccattttcttggtgtacatcaaacttaaaaatacatttgatagaactaactgcatacaaagaaagatgaaattgctagcaatgcttagctattgaatttagataacttgttggactatgaactaatgtctgtttcataccatttcatagttcttgtaattacctcaaaatccatgtagaggcctacttgtagagtggtagtttcttgttctgacttctgaggaacagagcttccatgaaatagttttctctacaacataatctcgttaatacgaatattgtttgatgatcaattcttctgttgtttcaaagatccgtcttaacttcaaagagcttagaagcatcttatgatatggcccaatgctgatagcaccacttcagtcacatttttcatggtattatcaaccttatgtttgtctgcagagagaggatgcctacacatcaatagatcttatgtttttgcagatttattatacagagtgagccctagaaaatattttgattgtgatctatgttcttgtagatcattagactgttaacaagtggtctcccccaccttttagtgtttatacagtaaacggccttctaaatggcctacgacaggattgtgttattcagataggtttaaatatttatactgtaaagaaaatatgatttttgttgctgccacttttgttcttttaagactcactgtatgcttttcaactacctagctgggaagacatgatcaacttatccttgtgtatttgcaggttgtaatatattcacccgctaggactgcatctcagcagggttcaggcaaagtcgggaggtggaaaatcaactttgtgtcaacccaaaagtatgtttccagttttgttttattggttattgttgattcattttcatgaattatttacctcaaaccctgtgttgctgtttggtgaactgcctcaataatatatcaaatgaaaacaaatagtctcatattaaaacttgatttacattcataacagaagaattcattgacgattgaagtctgtttctttttttcctttaacgtgagattacccccccttttttttgtacaatgaaagccttgcaactgatgcatttgacctctcattgaggtggtcaccttggtttggtcaaacagtgtgtacttagtctatttcatttcttttatgtctcatgcatttacttcatttagctttatgtatcacctccttattatatagcattctagcatacaattagatattactatttcagttgctgccgctttttccccttctaacatttgtgtgaataataggtgggagaacccattaatgggatggacatctactggagatccatatgctaatgttggtgaagcagggcttacgtttgacagtgcagattcagcaaaggcatttgctgaaaagcatggatgggattatgtggtgagttcttactatctgtctatccattcctgatacttaacatcaggtttaaaaaataaggctatacttatttctgaaatattaggatatattggagcaggatttaattgcatattctctcttgaatgtataggatcatttgattcttaattctttacaatttagaggttaaagtaaggaatgttcttttatagtgttctgaattctgatggtcaggtttctgaaggaaatttggtccatttatgggtgcatggtcttttattttcagattgccttgcatccaatgtgccatatgatttaatgttatttgccttaaatctttgtcttcagaatcacttgtcgatgtttcaattttgaaaaataaaatctctaaaaatccttcgtataactcaaggagtaaatctgttgttcccgatttttgttgtacttgtaattttagttaggacacatggaactttgattttatttctgtggcaaactagagctttttcaaacaatttgtaactcgtatattatttgcgtataaaatatgttctcgacagtaggaatgcttttggggggctatggtgcagtattcattggcataccacgagcctttatatttgttggaatccacctcctaaatttcttaagaaattagaactctttactcacataatgtctatttcctgcaggttaggaaacgccatacacctcttttgaaggtctgtacacctccctacgtatcttccattttactgtgttgatgcattttttttatatctacccagttggttgctttgattcttgcatccttataattttgtcaattcatgcattacaagttactactaagtgccccttttttaactttgttcaacaacataccgtgttctggatggtggaatatgtgatgttgaacgtggtctgcatcattttggtggatataacgtagtcacagcctcacagtcccacaggaaatagttgatattgtggttcaagtgccaaagtgaagaaaaagccaccagtgaatagaaaaaaaaaacttagacaatttcatctatactaatcatattagctcattttgtataaaatgaggctatgtagcttattgcaaataagtatacttattatttatgtgcttgcatgtagcacatacctgatacatgaaacatggtagacggggcagatcatgtcaaatgcattacaatgtgcccttggtgagaagattgtagggacgaaactgtggcatacttttaagactgagggagtgggcggaggcctacgtaggagggaagttgagagtgccatcttggaagtgtaagacaagaagaggagacgtggaatcatgtgatgggatgctttaacattgggtgtgaggaaggattaatcagattagtttgaaggaccaacttgagcaggggttgaaatgaatgccaatgacccaaatgggagagacgacgggaggtcctgatcgaacgggtgttctgctacatgatggtggcactcgactgatttgttgaccttcgaattttctgtctccgtgactttgaattgaacgaaaggcactcctttcattctagaaagtagatagcaatagagcattcacattaatcacaacttagcaagtcagaagattgatagggaaaaatccaaaatttgcatcaactgtaggagtacatcgaatgtgatctagtcagagagtccctcatcctcatcaactcctatcttttgttagtaccaagccgatgaggacaagctagtcaccactggctaccatagtagttgaatttacgtgcctaaagcttacggatgcaacgcgaccactgttttggcagccttttcagggtgcatgcattctttcatacatcctgccaagggtgtaattaaccatctctgctaccctttttgctaaggatttgaaggacaaatactgcgggacgaaggggatatcactcttctcccagattttttgaccaatttaatacataccgtccaggttgttgtgcattaagttagtagcttccctgtaattaaccaattgtttttctgtcatgcaggccaaatcttatgcagagaacttcaagtggaggggtcccccgaaggcagagcaagcctgagcactaatcttgcatgctacattgctagcaggacatgcacaagatggtgtttacccccatatgtgttgtttttggtttctccaatctgttgtgcgagtgtggcttagaccgttcctcaaccaactctcaattataataagcgtgcactgtgatcaaatagaatgatttcctgtgtactaaaattgtttaccattatccttccacatcatttcataaagatcctttacctgtttgcttaggttgttaaagcaaaacttaagtgttgttctgccctggtttgctctcaactcttggaacacgacagtgaagacgtttttctttattttgtttgataacgcgacacggataatgtgattgcgaccacgcatttgtctaacctgggttgtccatgcatgcatctatcctgggatgtccatgcatgcagacgcaatcacttgtcgctgtcaaatggatcattagtgctaaactacatgagaacaaacaaatctcactaaagcaaaagttacaattttcccttgcattctccggtcaacatcatatatactttagaacctggccttgcatcctataagcttcgcaaaagaggaagcagccgatctagtttgctactactagtaacattgcaccttaacacgattacatctatgcactactaaagtttgctccggcttgatgcatcacgtcgtcacgcgtcgccggcggcgcggcggtgggtgttgcattcgtcgccggcggcgcggaacctccaggcgaagacgtagtccctcgactcgcactgcagccgggtgacgtcgcacggtgcatggacggatgaccacttgccgtcgcgctcccacgcgatcttggccgagcacgagaaccccttgcatgtctccggcagcgccgccgccgccgccgccggctcggacactaccagcgccacctcgccgctgatcctcctggacgcggcggtggccacggcgtcgagccacgggcactcgggctgccccaccattcgcttgtacgcgtcgttcaccagccggacgcggttgctggagtccgagaccaccgccgggagggagtccgactccagctccgcctccacctcctccgccgtcttcggggc

SEQ ID NO: 48392 - DNA, 16466 bp, Oryza sativa
ccatggcgagacgtacaccggacgaacgaacgaacggtacgctcgctctcgcaggtggtgaacggatgcgttggggcccgagtggtggggtggtggggttaagaaggcgtgggcggccaatcggatgcgcgcaggggggaggggcacgtgggagggcggggcggggtacgtgggcgaccgcgcggggacgcggccgacacgtaggcggagcggagtcgcgggccgcgcgctccggtggattccagccagcagcgcgaggcgtatggtggggtgaggtgaggcgaggtcgcgtactcgcgttgcgctgcatgcggcgtccgcccccctcgggcgcatcgtcccccgtggcgcgttccgccgcggtcactggctggctggcgtgccccgcgtgacggcgtgaggcctcattggcagaaggccgtgtggcgcttttgcgctcgcctccaccaaccggctcgcttgtactctagcaccacggtaagtttagcgtataggcggacaccgggacacaccactttacctttttttttttttgtttttcactaccagatcgaatgatcaatctgcgtcaaaactgctttttggtcataccttgccgtgcatgcatgcatgtacactccgactccggtggtgtactcatgctttcgagattacttctcagctgaggtacatattgtttcagccagcacaaaaccgcctaaaagttgatatatccgcacgtggttttgctggtcatgtatggtctacgagactatacatgcatgtacatacaaaatctcggagggaaaccagacgatgcaatgtaaaccacgacgacaaacgctttgctatctttccgatgaattaaaagctggtgacgacggtctccagcacgtggcacacatcaagaccgggcgaacgcttgcttacgtcgctcgtcgggactagatgcatgcaccatccgtttcctatagccaaagccggagtttcttcgcctggacgaggagcaaaatttatcaaagttcatatcgaaaaaaatttacagaagacggtgcccgatgaagtgagaagctttttacaccggtgaaatttcccaaacccaaacataaatcgactggatatgtaaaacactgtggatctaactcttctgttccaaaaagtacgcggctcgacggtaaatgctctactgtgacgacctgtccgcccaataaaaaataaactagtagtagaaaaactttacgcatacatgcagctgcggtacacgaaacagcaggcaaagcgtcacacgtggagcatgcatgtcgcgtgtcctactggagcccaaccacgggccggctagctacccggccgaatgcagcagcacgaatttaaaccggccagccggagcagcagcagggcaaatgcttctctcttcgatctccctgctcgagaaacaaacttttggaccgacgctacagctccgtttcttactctctctttttttttataagaacccacccttttgcatgcacggcatgtgctgcgtgccgtggcgagcgggtagcaacgccgcgcgacgagtggccgccctgccattggcgggcgcgcgggtgcaggcgccgctccgtctcgctcccgcttggcgagtgggtgggcgcgggtcagggtctcagggaacggacgaaaaggaaggctttcaattcgcaagcgcgtacgtcgcgaggcgaggcgcggccgcgcgagcgcgacgctacgccgtacgctagttgcttgcaccttgcagagttcagttggtgcggtgcgcgctgcggtacagcgcgcgacgcccggccgcgcgctgccgtcgtccgtcgatcgttcagtgcggcagtgcaacgcgcgaggtcgcgagctttgctcctcgtgtgcgcatatgcaatgcaccggtggccgtggcagacacgggagagaaattccgccctgattttgcacgtacgcactctcacggtctcgcgtaatccttagacatcttttttggaaaatgccccgcgtcgggcgctacccgcgcctccgtgccgtccttaccacgcgccccaccacatgtgccgttgcaataataactcacgttttagaataggtgtcgaatataccagtcttatttggttatagttagacttggagttgtaaataggtgttaggggtagagttacagtcagactctataacccgacatctctcttaaatagagaggggagcaccacaatgtaaccatggcgactacaatgtagcgtagacacgcagggagatgatggcagtgtggccatggactcgtagcggctatgagctatattgattggggaggagcgcccataaccagagccccggggatgtagcttcggctgaacctcgttaacaaatatcgtgtgttcctgtgtcgtcatctggcgtgtcttgggtgatcaacgacgggggagattgttgggtttagtcccacatcggtaattgatgatgggggagcacaacttaaaaggtggggtggttctcacccatcagactaatcttttgggttgtataggcctaggacctaaagttgtgactccggttgggcctgtgttggagtaggcccaatgtgaccctgggtggcccatgattggtggcccgggctgcgcactctaacaatatgaaaatgttctattaagagaatccgtttcattttgtgtttgaatgaaaatgttctattaagagaatccgtttcattttgtgttccatcaaacactgtttcaggaagtacactcgtgttgtttcactatgtatagattaaatgttgcagtgaattgaaacatcattccattattttgctgaaacattgtttttttatatggtgaaacagtttcaaaaaccgttgtgtcatacgttgtcgcaaaatgtttcatgaggtgatttggttgtgtttcagctttttaaacgattgaaacatttttgatctacttagtgaaacaattttgatctactcggtggaatagcgtcggacacccgatttgtaggtggtcccctctttttcatgcacaacttttgtatacaatggtcattttcaagacacattagtgagtcagcatttttacggggaatataataactttcatctctttataaagcttattataaaatttatgtaaaataaatggcttagtaaggaaacacacagatgttagggtggtgagcgtgtgagtgggtgtaatggtgcgtctgctctctactattataaaaattaaaattaaagatgtttttatcggtattttggtacgtcatccgtgtatgagtcggtttttaagttcgttcacttttgaaaatcatattcgtatttgagatggtttgtaagtttgttcacttttggaaaatacaaaagagtcatataaaaaatctctttaaaaataccacatgctaacttgagacgatcagattcctaactgtagctcatgattttcttatatatatatatatatgtatatatatacacacatgtacatatatacacacatatacatatatacatatatatatatatacatatatacacatatacatatatacatatatacatatatatatatatatacatatatacacatatacatatatacatatatacatatataaatatatatatatacatatatatatatatatatccaagtgaattctcacggtgaatttcaccttaactaaattatataacaataataagattaaaataatcttcacacgttgtaacgtatgggtattttttgtagtcaaaataaaaggtcgtagtactccgtataattattctgcttttcagcgtgtgtagtggtgtgctatgtctttgccatgtaatcaaaagtttattttgaagtgagcgtagcaactggttaaataacttgtgggggaatcaatatattcggttcaagttatagacttgaggtgctcgcatttacggctaattattctttcagtaatagacggcacactcatcaacaccgaaacatcattgatgactttgccgatcttgagatgtgacaattcagtctttttgaggtgttcatagtgatagggtgtacgcgtatatttatagggaggtgtgtgtatgttagagtttgtatcgaatatgtgtacgtagtcgattacaatgtaggactaggagtttgtaataggtgtaggtaaagttagagttggactctatcctaagctctcttttaaatagagagatacatctgttataaaccgcattacaacttagtatatgtgagagggagcggctgccgatgacatcaaatcaagggtccttataactctaatatgttataattatgtttgatctgggaggagcattcgtaatcaacgcccttaggttgtaggcttcgattaaatctcgttaacaaatatcgtacctcagtgtcattatcgtgtttggatctcctatgatgttttttacatgttcggttatcgatgtgatttctaggccggttctataacagtgtgcgcaagttgttagcatttgcatttaccatacttgtaaagaaaaaaagaacttttgtagtccaaaaaaactatttttatattttagaaaaggtctgagtaggaactgggaacgggtaagcctaatggacgggtgatcgccttgggcgattagcacgcccgtccctcccctaacacgcacacatctccccctttctccacttcctaccacactataaatttcaaaccatttaaaaatataaaagaaatctaatacacttgaaaacatattcatgtgaataaactttatagttataagtatatataaagaaatttcgtaaagactttatgtatagaaatattatatataaaaatatatttgaatctagattcgaattcgaattcgaaccgggtatataaacttttaacttataaactttgggtatacaaactttagatgtataaactatgtataaacctgatgtgtaccaactttaggtatataaacttactaaaacataaaagtaatgcggtgcgcgattacagtggggagggggctgcgcgttagcttttccgactgggaaccgcatgttttgccctgcaactttttgaagagaaatagttgggccgatccggcccggccagtttttccgtgggccactttttccgtccgcggggtgacccaatatgagcatcaggtccatcatgttattttagtcaacttttaagaccttttcagagctcagctcgagctgagaagttgagagatttggaggtggagcccaatccgcagcgccgccgcacgcaggtctgcagcagctgcaactacgtgcgcgccaatccgcttcccaaaaccaaccacctactactcgccgcaagggccgcagcggcggtcccctctcctctccaatccctagggttcgattccgatggcctcgccgtcgtcggtcgcctccgctcgcgccgccgccgaaggagcggcgacggtggctgctcggggtggcgccgagcccgcccgggccctgcggctgcctccggcgaacggggcgcggcgcggtgtccggtgctgctgcggggccgcgaatcccggcggcggtagcggtggcggtggcggcgcggtcgcgcgggaggagttcgtcgggttcttcagggaggcgtggccgtacatccggggccacagggggagcaccttcgtggtcgtcatctccagcgaggtcgtgtcagggccgcacttcgacggcattctgcaggtattgggatggtttgcttctgttatttgatttcgagtactagtattttggatgcacacggtgatttttcccggatgaacagtgcttgcaacttaggtacaggaagatgcaggcggtgattttcttctcctttttttgtgtgtttcatatacggcataaatttaatttattatgtagagagagagagagagagagagagagagagagagagagagagagagagagagattgtaggtttttctagtggtcagcctatatttgttcatgtccttgattaatagggattggaactgagttgtcagaatgaaaattaaccaattttgtgtgaggtaggactaataggagactggtctccttgattcccatggaatgtgagtctgattcattgaccctaaatgaagttagcactattatggaaaacagagatcaaatcttcagcggcctcttaaaatgattgcgatcctttgagtcttaactcgtcgcagtaactccacagaatttttcttatcttgttatcattatggagttagaactgaattataatttatcatatgcaggatatttcacttcttcatggtttggggattcaatttgttcttgtgtcctggaacacatgtccaaattgataagctcttgtcagaaagaggtcagtgcaaaccatccttgctaggttctcttcgccatccattcttgtgctcactcctgaaacatagagttttttagggtttaaaaatcctgtaaaaattcctaagcattttattagaaacaaatggctgagctaatacttcaaaaaatggctttagctttacctcctgactctaggaaatagcccctgtatttattggacatatttatgctaaggctatgccattgaaaaagttttgaatttgattcttaagccttatgtgtggacatcttatcaaaagtatacaaagcaacatataggaaaactattcagtgcatacacaaaacatttttttttaaaaaaaactcaagagaattatttagtttctatagcttatggctgtcctggatgtcatgaaacctggtcgaactcttctgctcagttgtgatgagattgtgttagtgaattgcatactgtgtgatttttgaatggggactagcttgactgcagttgtgatttatattagtaatttgatgaagcacattcactgaaaaatgaaacttcatcagtccttttagctgtgatgataatatgtggaatggctattatgtttatcttgccttttgctaacttgagtatgtttgattcttcttgcaagttacaactatttttttagtatttcctactgcatatgttcatcttataaattttcatctagggaggatggctaagtatgttggccagtaccgagttactgattctgattcattagaggctgcaatggaggcagctggaagaatacgattaactattgaggccaagctttctcctggtcctccaatgttgaatcttcgtagacatggtgttattggacgttggcatggtcttgtggataatgttgcaagtggcaacttccttggtgctaaggtaatatttgttactaactaagccccttcggcttccaagtatctggccttaatctggttcttttgcttatcttgtgaagactatgctcagggcaacttttatacttgtaactctccatgaataaaaaccacttttctcctttaaaaggcacataattatacatttttgttttcatcagcctgcctttaattgacttgttcacctcttacagacttgtttaccctgttatgtaaaacactcctcctaagataatgtatgcagaatgatgcaaattaggcaataagcattggagggttttagttgagatgaccattgacatctggacaacgtagtagttactaaagttgttactgactaacagtaatacaacctttgagctactgagtcgcttttgaggcattcccttcaagtggttcgatttattcccagtcgccctatcatgtaacttcctaacctctttgttaagaactggtttttaatgttttacgaaaagtacccttcaactgccatataaacagaagaaaacactattggctggaaagttgtccatttgggtgaagttcaaattatcatttttgtacactgaagtaagagttaagaacaccatggacaactctaggatcaatagtcatggccttgttggttgaatacaattttagtactataggaacattgtatgtgtgtgctcagtgcctttttccattcgaatgtgcatgtggattatttttgtttatttttccaagtcttttttgtgattatgtccatcacttatgctgaacttcagttcgtgaaggtcctgcagaactaaatttatgtaactctcttcctttggcagagaaaagaagtagttagtggtattgattatgggttcaccggcgaggttaagaaaattgatgtttcacgaataaaagaaaggcttgatagtgatagcatagttgttgtgagcaatatgggatactcgagctcaggagaagtgctaaactgcaagtatgtttttttctctatccatgacctttgtagtgactatatgcacacacatttttactcttttacttttatgagaatatatgtaaatgtcctgtctatattcaaagattctgaagtactattgccccatctactctttctatatactgcagctagcctactaaactaaatttgttctatcttctttggctgcattcagcacttatgaagtagctactgcgtgtgctttagccattgaggcggataagctgatctgcattgtagatggccagatatttgatgagcatggacgtgtcattcctttcatgtctcttgaggaagcagatatgttgatcagaaagcgtgctaagcaaagtgatatcgcagcaaattatgtcaaggttgtggacgaggagggtatcagtcatttgcatgaggatgtcaaaccatttttgaacggaagcggtcctcttggtgcatatgctgcttctttccataatggcttgggtttcaacaatggaaatggtattttatctggtgagcaaggatttgctattggtggtgaagagcggttaagtagatcaaatgcctatctttctgagttggcagcagcagcatttgtatgccatgtaagtgcttctcttctttcaagtcatgttggaccaaaaaggagccccttatctcatttttcattatttactgtgttactttaggcttgctgaggagagaggatagtacaatagtgtaacctttcaagtttgaggacagtttctatttttattcttgaatatgaaatttgtttcttgtatgctagggtggtgttcaaagagttcatatcatagatggaacagttgatggatcactgctattagaattgtttacaagagatggtacaggaacaatgatagctaggtatgttgaacttctgttatcagtttttgatcaaatattacagtttccatgcacaagcaaaatctccgacgcctgttttatccttatgtgcacttagatgcatctcctgaacagttaattgcttgtaacatcatccctaattcctacagaagtcatttgtgcacaaaatcaaaggcctttcctaacttttcgtcatagtatatgcgagttctgaagttgtacccttggctgcgatggcctgcatcttttcatcatagtaatgctacaaatatcctcagcatgatatatatatttttataaggaactaaatacatttaagaatttagcttctacaagttaacgttgagatgtctatttatacagtaatacttggttttcagggatgtgtatgaaggaacaaggatagctagagaggaggatcttcttgggataagaaaaattcttcgaccactagaagaatctggtgttttggtgaagagaactgataaggaggtgtgctaaaatcctatctaatgatctttacagcgtatgctttcgttgaatccggttgtgtgcttcaatttagctctaatttatgctttatattcaatttagcttcttgaagcactggagtcgttctatgttgttgaaagggatggttcaatcattggatgtgctgctctgttcccatttcccgaagataaatctggagaagttgctgcgattgctgtatctgaagaatgccgaggaagaggtcaaggggacaagttgcttggtacgctcattgctttatgtcatccctgtttggtttccttaagttagccatcaaattgtagttggttcaaacttcaaaaaccaatacttcacaaagaaattttacagtccttgagaggtactaggaggtaccaaaaatttttagtacaaatttggtacctcctagtactggaggttccgagaggtatcaaattttacactagaaaatgtggtacctcttagtgcttcatcaaggactgcaaaatcactctcacgaaaaacaatcaaacagtatttatcttcatttgaaatagacggatttatcttcaacaaaatccaatgtcttgtcataagatgcaaaactgaaaaagcttgatgcgtttaacattatttccctgagatgcatttaacattatttcggtagcttaatgcaaccacactcccaccatcctttccctgaacatgcacacatcatgtgccagtgcatatcccttcgtccacctacttattttgtcacatgcacatgtaagcctaaaaactataagagggaagaaactacctgcaaagagggaattcatgctgtagtcttgtaactactagtctactaccaaactatctgattgttactaagccaggaaacatgaatgtggattttctgcgcatcattgttccagttaacaactcctcatttgtatttgaagagcttttatgcacctgtattgatttattatggaaagtctattgtgcatcttgttttactcaagattatgatgatgcttcagactatattgagaaggcagcaatgtcccttggtctggagaaattattcttgctcacgacacggacagctgattggtatgcaactttatccttctcttggtccattatatgggttgtttcatatgcatgatttaatgactaaatagcctatcattgtgctctgtttcgaataacaaggagtattaatacttagctaataaaatattcatagaggacgatgtaacagtctgtgttgtgcaatatgtatgtcactctgtgctgggagtataatttctttcttgaatctagctgatgatctaatatgttttcatatggcttagttaggacctgtacatactaaaaatatcaaggtacttcaagtacagtaaacacatggagaaaaatgacaaattactggagctatgttcagatattacaagattattttattttgtgaggattttaggctagattataatatctaagccttctatatatctctagcgcttaatttgaaactgatgcaggtttgtgcggcgtggcttcttggagtgttcgattgaatccattcctgagcaaaggagaaaacgcatcaatttatcacgaggatcaaagtattatataaagcagcttcagccaaagcacgccagtgttactcccaacaatattactgccagatgatataacgcatatggaattggtgcagttcaacactatatcagctctgagcctctgacgccaccaaattttgaaggtatgttgtactaaattaggatttcagggagagaaacataggaactgttagtgatgtcgatttttgaaatgttgtgttaatttatttacatggttgcaaaggaaatttgttgcacaatagaatcagagtagatcatacctggagaaattctatataagtaggctgaaagcttgaaaaggaacttctgataagtgggagtaaccggcaaaaagagaatattttacgtcaggttccctatttatgtgatgctgataacgacctcacacgcacgccaatagcgtgcacctggaggcattctactaccatagttttagaccaggcaagaccgtttgatggcaatacatttcgggtttggtcttccatgaaagtttggtaatcacatggcaggggccccagggctggcagcatacacggatcaaaatccacttaccagtcagttagactagcgactggttcatcacaaaaccggtaacctgattttgtacactctttgcacgcgccaagatgattttggcttctagacacggtttgtatgtggatatattaaatgtaaagcagcaaccgtcagagcttttatcataagctgattccagaagatgcacccaaaagaagcacaaggttggcgttgcatctcgatgatgaatgtttatgtggatgtttgattgcttacaaccaacttgggctggctcacgcggattcccttataagaaaagctgaaattgatggattatctggtttttagtcagcctattcaagaatataaacaaatgaattaattaactaatgtaaagaagctttagaaaactatttcaagaaaaatatcatattgaaaattttcgtacgaaatgttccgttaataaaaatctgaaatctagaatcatatcagggtcgaactaacgcaaaatgtaggactggcagaatcataacagggtcaatgcaggactgggatttgggttatctgggcgaggttcatttaaccagctaacagccgaacaacactaatggcgatgcctagtaacgtgtaaaacgtgacgtcgcaatctgattttgggttatctgtcttgtgccttttactgtataaaaagacgacgtgtgcctggcgcaatgatacagcctcaagacctggaaaagtatccagacaacgcaatctggaaaagaatttatcagaaaatatctaaaagcatgtcgccacacgaatttcacttcagctagtcgcgaggccttgatgttatatatgatcgtaattacaataattaaggaaaaaaattactgggcaagctgttcgttcgaacaagaaacgtaagattccttcaaaaagaaacgcaccagtcaaagtcagtgcccagtgagacccggcggcttatgaggtgatcagggtattttcaaagcaacgcaagtgttaccccgcagcaatggtaaagaaatcaaatggcagacataacaagaacgaattcaacttgcactccgcaacccgggttgaattccaccagcaagattggaatcaacagtagtacacaactatatagttttagccatccatcaaacactgatcaaataaatcaggttcagagaggttcataaacaaggcgaataacaggtaataatgccgaacacgaaatctagcagcattttctcatagcagttcggtttgatcagctccatgaaacaaatctcttcagctctcttgcacccgtcgcctctatcctcagaagcaggcgtccaggagacagcagcagcagagggcagccaagctgttacaacacatcattagaatcatgacaccaaaattgaaactgataaaggcagcaggtaagtatagtattgccatttgaacaaaggcatatgctcaatctaaaataagtccctaaatatgtccagccgtccattgacaaactgcattattcaaattgcaactaggttagcaacacaattagtgatggaacacccgccaagactaatcataatcatctcggggggaagaagagaaccgttctttggtattagcgcgtcaacgaaaatataatatctctctataaaaaaccaagaaagatatacttactacggagtatagtagtattatcctaggtgacctctccccaaaggaatctgtgaaaagcacatttttattctcctacaggcttttgaacttatctttcctctagccaaaactccagcaaccaaccaaaattcacaaggaaacaacaaatggtaagcaccaagggaatgtgactgcatcacagccgtccatccaagatcagacggccatcactggtgcaaggagaagacagccagaccccctcgtggcatgcaagtgcaacctcgtcgtcgccttgcttggaaggaccgacacgtcaacgaaacccacgtttcaaggggtggtagttcacgcgtctattcagggccccaccacagcgaacgtgcgccgccgccgccgccgccgccgcggcggacgcgccggccaccgcacccgtcggcgtggacagatctgagaccagcgtccggtaattactactactactccctaaccgcctaaatagcactaaaattttgatctaatcaaacaatctagtactacttcaaattcaaaatctactagtagtgcacaagagcaacgaagaagatgctgaattgttgattaaaaaaaaagaggcgagacgagacgaagtgctcaccatccctccatgaaggaagggccgctgctgtgctgctgctgctggggcggcggctgcgcgtacggcggagggtagccctgctgcggggggtacccagccggtgggtagccctgcgccggcgggtagccggccggtgggtaccccggcggcgggtagccgtccttccccgggtaacctgaacaaacacaagatccagacacggccaagattcagtcaaaccatccacaagaaaccacacaagcacacacataattttttttaaaaaaaagccgaggaggaagaagaagaagaacacggggagccggagatttcgaaccttgctgcggcgggacgccgacgggaggttgctggccgtagtagctcatcttttcttcttcttcttcttcctcgggtatccggcgatcgaataaactgattgaatacgatcaccttgcggagacgggggcggctttatagataggccgtgtgggcgaatcgtgacgggttattattgctttgttccgggaatatattttcgctttttaggcaaccgcgtcccgaacgtggcccggggtggtgggcgatatggtaatttcctcgagccttcggcctggaccccaactctgattatattacggtggatggctttccaacaccaacggtgcttttggttgtagggagtttttaggagatattgggagtttagagggataagcctattaagtgttttgtttggttgggagacatgggaatttttgtgggatgaggatgaggaattgaggaaggaactccctccttttcaatatctggataggggtaggtaattgggagggaattcctcctttaatttgtctaagcaaatctcagccatccgtttttattaatgacctaatctccaactaaactccctatcaatttccattacctctaccaaacaagatattgggattaaaaatcaaattcccatattaatctcatcatcaattccctcatgtaaactcccaatccccttccctcgagttaacaaacaagccgcaacaggttaagttagaagatattgtttcaaaatactaaacggtttcataaaaaactttctatagagaagttgttttaaaatatcaaatatatatatttattatgtgttaattaggttttacttagaaaaatatatgtgcgttgcaacaggcaaatgctatcttaatattatacggtttaaataagatgaaattcactgtgggaatttacttggattttttttagaaaatcatgagcttcaattagaagtccgactttcatctcagttagcatgtaaggtttttttaaagaaacttcttatacgacttcttttgtattttcaaaagcaaacaaacttaaaatccgactcatacatggatttctatttccaaaagcgaatgaacttaaaaacagactcaaatacggatgatgtacaaaaataccggtaaaaacatcttcaatttttataatagtatagatttattacaaagttgacaaatatattcatccatatttgatattttaaaacaacttctacatagaaagtttccgtatgaaatgcaccgtttaatagtttgaaaaacgtactatgaaaatcgagttaaaaactaagtctttttgactgggaatactgtcaaggctttgcctagcagtttaaattttatagaaaaataaaatatttacaaagttacagataatacacaaaagagaagaaaaggcaacaaagctataaagtgtgcaaccaattagaaacatattgtttcagggaatccttcattctgtgcacagatgcagaagagtttatttcacaaaaagggatttccaggattgaaatgaaggttaatattttgaaagataagtccattgctatgcttctaaatgtgccatgacgccataaagaaaatctcaagaaaacctctttgactaaacccgagccttgccaggacaaccatctgaaaaaaatttcaggttttggttccaatgaattcccaaatactgtcaacatctagcactaaaagcgcaagtgaaaaaatgataaagtcttgtttccctctaatcaacattaataagaaaagaacatgaaacggagtgtttttgagaaaaataatgtaactagtgttggaaatttggtcataattcggcatattttattccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatg

SEQ ID NO: 48393 - DNA, 22156 bp, Oryza sativa
aagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaagagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactatcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatcagtttgagtcactatacccttctaggtacttttggaatacccggaatagtgaattccatagctcatagtaccctttagatagcgcattactctttccagagcctgccaatgatcatctcccggatttgaaaccaacccggctcagcttgcttacagcaaatgagatgtcaggcctcgttgcgttagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgttcacacaaagcctgcagatgtaagcgtggtgtcaaacttctcatgccattgcttaggtgcttgcttgaggccatacaaggatttcaatagtttacacaccattccctcctgaccttctagtacatacccgtctggttgatccatatagatctcctcctccagctctccgtttatgaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacaacttcccaagtaccattagacataatcgagtccatttcactgcgtactgcttccttccagtagtcagcgtcaggagatgaatatgcctcttctatggttcttggggtgtcatccactaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatgtagcatctctggactcaagaattgtaccaacatgcatgtcgggtactccagagtttaatattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgtaaaaggatgcaaactcattggaaaaatactccccacctctatcagacctcaaccgtttgattttcctttcaagttggttttctacctcagctttatagattttaaagaaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttcttacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttaccgtaccccgatgttcctccgccctcgctaatgatcatgttggcagacttcttgtctttgcgctcaggacagtccttgggccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatattgtagtcatagaactgctccataacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaggcatgtggtttcagtgtagcagcaaagccaactaccgaaaatgacctatcaggtttttggattggtggaaattggtcataattcggcatattttattccaaaataacaagataataaacatgatatttacaataggatttgatccagtgatagtggtgaatgtaatcaacatgagcatgcttaacgttgaataagcatcaccaatcacataatgacacaatgttgacattgcgatgaacattaccagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactggtcgggatgggattaccgtagcagcaacagcttttgaaaatggatgaaagtgtgtcttcttcttctcgcgggagatcaaatccattcccattttataagaggaatggaagatgaagagtaagagtcatggaataggaagaggaatggagcaactaattgtcatcaactagccatgaaccatcctctactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaactagaaatttttaagaaaacttcttttagaaaaacacaaccatgtccctattaacatattcgaaatactggtccggtatattttaagattgatcacatgtgtcttgctatcgaggagtatgtcgcttatcactaaaagaataattatctgtaaatgtgggtgggtacccatatcaagtttgagttggtttcatgtaaaaaaaaaggtctggacttggtttcatcccaagtaataacctaaccaattgacatatgctcatttcgcttttaagaaaatattttaaatcttatttttggaattgtaatggtaacggatgctttattggtcatgtgctattatctggttaatattgccgatgagtcattggctgatcggccgaaccgcccagtccaacggggcaggctgcgacgacagaaataaataaaaagaaaaagaaaagattaggactgtagcagccaaagaaacgtgaggacaggggcaatttatgcgggtttgtttgcaggctgattaatgatagttatttatgtcaaacaaattgacgaagttaggctggtcaccaattgatatatagtagtacttgtgattgcgccctgacacgacacgacgaatagtatgggagacagggtagctgtttaattagctgtccgcctatgcaaaattcatttttagataatatctacaaaattcatgaatttgccaggacagttgacgtggcctgggggcttgattgtgaatttgtgatgagtagggccgtaggggaactaatcgtgacccatgaggacaaccaaagccagaacaagggttggtcggggattaagccaggtttaaaaatttgaccggaaacgcaggtctttcagtttaaaaaaggagaggtctcgaagaaatgtttaaaatgctcagcaagagcttgggtcttggtcagaggttgagagccagagagagcctgcctcagttcaaccataccgggttggcctaccccgcgcttattatggccatgttgccgaagcgcgtattttctgctctgttccttagccgcgtcgcctttcgatcttcgtctgctaataacgtctcaactaccagccgcagcggcacagcacaactgcaggtcagttggacgtccgtcatcgacccgtgcagcgcacgtacctgcgactaaaatttctggtgtgctgaaggctaacctacgcgaagggaagcaggaaagaacggaaaaaaaatttggtggagaccggatgtaaccggcctcttctacagccccgcttcggatggatgccacgtggatgacatagggatcaaacggttagctcggtccggctcccggcgttgcgtgatgaggacacacgcggcttggctccacgagcagccgtgtctttcaagctctccgtcggctcaattcgacgaacatcatatcgcatctccttttgcctggtgagcagcgacccgcgtcttcctccggcactgcaggggtcgtccttttcctcctccggcgccgcagacgtccctgagactgacatatatgggactgggagcaccatggccgatgtgccgtgctccaccaccgacatcgcttctgatgtgctcttcgtgcttgtgttttttttggagatcttgtttggttggagggagtttttaggagggattgggagtttagaggatgatgctattaactgttttgtttggttgggagatgagaattttggtgagatggggatggggaattgaggaatgaactccctccttttcaatacctgggtaggggcaggtaattgggagggaattcctcctttacttcgcctaaacaaatcgccatccgttttcattaatgacctaatctccaactaaactccctctcaattttcaccacctctaccaaacaagagtctggcatgaaaaatcaaattcgcatcttaatctcactatcaattctctcgtgtaaactcccaatccccttgccaaacaagccaggctagagcttgaaccgtttagagtcgagggtcaggtgctgtcgccggccgcttctccatggcatgagaagaaaattaacatgcaaaattgaagtgccgtaggattaggaaccagaaaacaatatacaatattcatatcagggagaagaactggaggcagggtcatcgtcgatcgaagcggtaatcgatgaagtattgcgtttcgtccgtggcggccgccagaaattggaagacgggtacagtcgcagccagcatccaaacgcgccgcgggatcaattgcctggcgctgcggctcgccggcggcggccgcctggaacaggaacagaaagacggtcgtcgatgtagccgatatccaggcgaggagacacgatctgcgttgaatcgagccgtcggcgaggctgaaagccgcgtctgcgcctggagccaagccatttgcatcctcgtcacgcagcgccgggagccgggccgagctaaccgttcaatccctaggtcatccacgtggcatccatccggagcgggctgcaggtgaggccgattacacccggtctccaccaaattttttttcgaaagaactcgatcgtcagcttgtctactcccatgtgaatctctatccctattggtccacctactaatccactcagctcttcatctctcagcggtgtgtgacgcaataatcaattaagtaaattacgtttagcgtcaccttttattaccaaactttattttggatcacatgttaacccatcttaattttcactttggactagcttattttgtctttgttttactccattttggactatctaaaatcttttctcaagcatataacgactttgcatattggctcctgtaaaccaacaatcttcccgacatacacgtagtatatttttacaagattagagggtagatgtacttagagatgtgacttctataagattagagggtagatgcacttagaaatgtgacttctatgtaggatgttttttgcaagattagaggatagactattctagtattctttgcatatttagagggtagatacagctacacatacattactctttacaagattagagatagatgtagctagagaaatgatttgaggtgatccaatgtacaacgaagtaatcttacctagttcgaagtgaaaatattaactggaggatagtaaaaaaaacaaaattttggtaaaaaggtgggccaaagtttaactaactttaatcagtttccaccaaatgttgtcccctttggacattgacaacacaacataactttatctagtgctctcgaccaccatatagactcaagcactaagggcaaaccccctatgttccgagccacctaaaccatggctcgaggcctagtggttaaaactcgttttattttacctggaacatatgtaaattcaccatgtattttatagatggccaaaaacattgtgtgatcagtctaaatgtttttatagctaaatgttggattcgtccttgcaagcactattgatacattggttctacaacactaaggtgttttagataataacatgaaattttacaattaagcccatgcttttatttttttactcaaaacttcaaacaattaataagcattatccgaccatcaaatatcagtcacccatccacaatttcttctctttctcttattcttttttgtaccctatctccccatgcgagtaatgacaaggcgtgaccctcaagagcggtgcagatcagggcagcatggagaaaatctgatcgactaggcgctccgctcttcagcggcagcgggccaatgaacttttcaacgatggcacaaatcagggtgacggagcatccatgatggtaggcccctcctctccctcccctagttatcacagccttcctctcacccttttctcccttgtcgccccacacgtttaccctgatgagccatcacgtgcctaaggatcctacttggtgagccgaaaccacttgccacgcatgagaattgtgcatgcccttatgattttgaaaatgaatctcttttctttctatttttccaaatatcttctttgcgatttttggtgttggtatgatcgacttatgaacccatcacatcaatacatcaacatggtgttcatccccatggtgtcttggcttttcccttaacataatttcattcgtcaccattcatcaaggttgactttaagcttactacatattaatagaccaaataaccatattgggggtgggaatagatttgatgtgacctaacttgtattaaggctgagtttgaggagaaggggattgggaagatacgcaaaacgagatgagctattagcatataattaattgagtattaactattttaaattttaaaaatggattaatatgattttttcaagcaacttttctatagaattttttttacaaaaaacacaccgtttagtagtttgggaagcgtgcgcgaaaaaaaagaaacaaacaaactcctattgtcatgctgccgaatgcagcctagtcgacacaagcacatatgtatgtgactacactttgtaacttcaaaactattttttttgaacgactcgcacgagatggtgcgaagttctattgatagagcagaaaaaaattacaagattacaaccctggaaggtcgtaatcaggaaaaaggaaaaaaaatactaccacccacaccgacagcgccaacacataggtccggaagaaggctagcaccggaccggccgccactaagcgtgactgaccgccgctaggccgacaaaggaacacatacgagaatgcccaaaagacgcccttacaaccaacacaaagcccaactctatctagagtgtgcttgcaccagtcgttcgagtggtttcgacaagggatgcctaaacgacgtctccaaggagagaagcgacagaaaaccgccgccgccgtccgtcagggactcaaaagagccaagactgggttttcgcccggcaaacacccttgagggatgagacgacacgacaacgccctttggagggggaacattgttgtcggtccggccaggccgggctgggttttcacccgccgctcatcacctgcaagttcatggctgacgcaccgatgctctaccactgctcaacctctgctgacatgtggaaccactgcaccggcgcccccgtcggccagcattcgtgcgccgaagaccacgccacaccccccggccactcctactcacaccgtggtcgcctcatttaccgccggccgcgcctcatcgcgccgtgccggcctcctccaccaccagacgcgcctctcgcgctagtccagtctcccgccatcgaccgcgcctctcgctcacatataagaacgacgtcaattttctcatcacaattcaaccatacaaatatgttctcgaaattcaacgggtgatggaccggtagctatagcagtttatgacaacgaccaatatttatatatatgcttcgcttttctccttgtagtagtaccttcaacgcaattctatgcataccttgggtgtgtttagttcacgccaaaattggaagtttggttgaaattggaacgatgtgacggaaaagttggaagtttgtgtgtgtaggaaagttttgatgtgatggaaaagttggaagtttgaagaaaaagtttaaaactaaactcggctcttctcttttgttttaggataagatttgataaagttctgatcattgataacttttattttgtttttaaactaaacatttgagaagttatcaataatcagaattttaaaattctgataagtcttatcctaaatatgactggatggagcaatttttttagtccttttgtaactgctacatttattgcaatacatgagcattttgctagtaaaaatgcgtaaattacaaatgacgaaaaaaaaagtgacctgccggaagtgacaacagaaagggatgttggctacacggtcgcgatcccatagtacagtttacttggctggcagtatcgcagtccgttcgtcaaccggtgaatggcagcgacacgctaggcaagtcactgctctgcttgatcaggctcgctccctcttttgggttggccacggtagcgcgtacgcggcgcccaagctgtcggggtctctcaggtgagccaagccgccggcgattctacggatgccgctgtcacggtgcggtgtgtgtgtgtgacgcgacccgcgccggcgggcgccccccaaaactgaaaggccggaaacgaggtgagggaagagcctcatgctacgttccctctgacgatcgctaacatgtgaccgagccacgtctttttaccttcacgttaattcgttaaagaatctcaatccacggggtgttggtgggcttcacggcatcggggtactgggttgatttctgtgagatggttatacagcgcagtaagtctacttctagtccctcaatatatgtccaatcttattcatatccttgaatcgtggtaccggatatctagacacttaaaatattaaaacaggtataacttgcctccctcggcatttttggaaggtggtcaccgatacaacgctttgaattgtccagcccgttgagtcatcctgtaggatccacccgccagtgacccactgaccatgctcttccttcctttacccctcctaggtctggacgatagggcatccatccatggcatgctgcaagtgaggtggcggcgagttctttcagtccacctactttgcttgctcttgctcggtttcccctttcctttgaagatttgtgctcttctagtcttccctgatggagggcgtcgtcctcatcggagcggcgaagtgaaggctgcagcggccagcgctgtacctgcttgctatcaccggccatcatctggctactgtcaccacacatgtaaggagcatcgccgggcggcctagccaaggccccggaagcaataccaactgacaatggaggtcggcgacaggacgacagcgatgcccgcaattctttgcaattttgtgccatcgtccatgtcacgccacacaattcgtgcaagtcccacaaaaattgagaagaacaaaaaaagtatcccaattcgagccatcgatcatctcgtatgcacacgtgcgtcaaccgcgtcaggagatggaaaggcgtcggcgacgctggaagagcaccttggcatcggcgatggccttggtgcacgagctactggacgcccggctcgactgcgagatgcgtccggaacagtgagttgagggtgcgggggaagctccggaggaggcggttcaccgggctgacgcgcaccagctcacgcttcatgctcacgtggttcttcaccaagtcggtgagccgtatccgcatccgcaccacctccaacttcacctccgagttctcccaccacaccaacgtttagttgtcctgcggcaacatcgcgtcgcttcctatcccgttccacgaccacatcccaccgcctccggaggcgaaattgcttgaagtagagcacatgtgcggccatctgcatgggcagccgctcgttccgtgccgcgtgcaaatcccgtgccgttgccctgatgacgggtcggccccacaagattacttggcgggttggaccatgtcaaagtgccacgccagcgaaactgcgttctaaaacagttaaggaagacaaattacaccggttttaatagattaggagccaaggtatccggtattacggtttagtgataggaatcaaattagagtcaaagtgaacttgcatagcaatgtgtgggctgctaggcagatcgggcacagacagaacactgcccaagaaatgttctaacgaatttcaggcaacacgtgcgaaacaaaccatgattctaagtagcttatgaaagtatggcttgtcttctaaaagtacagtttctctaaaaacttcctacatcagcatccattagataaaactttttccaaattacttgtcagggaatgtatcctatgcacacaagttcttatctataatctatccaaccatccagttagaacacaccctaataatccatagtactcgagagtttgagactatgaggtactactgagtttgtcggttcagagattctggtaccccaaggcttaatcttctggcgtaacaatgtgaaggataaacaagtgggtgattttgtgatgcattctgtattcagaagagaccatgccaagtgccaagaacgtgaagctaccaactaagtcccaggaatgttccgtcacaacaagtgagtataaaagtcacttcggttaagatcaagcatggcgaccaagagcatgatcccgaagccaagagagtagaacgggattaaattcaccttttacggtctcgcacaatgcagagaagatcatggcgcggcacacgtgggtcatctccttgctcctcacctccgccgtggctggtgcgtcgcggcagccgcccgcgaccgcaagccaaggaccgacatggaccggccttgccggagagcaagaaatggaaggagcagccaccgcttcatccgcagcgccggtggcttcgctgttccccggcctcccgccattgccgccgctgccagcgctccccgctctgccgccgcttccaccgctgcccgccttaccgccgctgccaccgttgccgccattgccgccgctcccttcacccgggacgacgacgacgcggccgcggccaccatcgccaccgccgacggagtgcctgacgtcgctcgtggagctgctgccgtgcgtcgactacctcaccaacgacgccaccgcgccgccgggcgcctgctgcgacggattcaggtcgctcgttggcagcgcgctcatctgcctctgccacggcatcaatggcgacatgagcaggatgatctccaggcccatcgatccggtccgcatggtgctccttcccgccatgtgcagcaccatgctgccgccgcagtcgcttttcatatgctacagtaagccaacgcttttaattatatgtttttttttattttgccaaaaatgattttgaagtcacaagtgatttgatgttataaaagacataaatcacaagtcataaaattataacttttatggatttataatgttataaaagacattgacttgtgatttgattttcgcagcggaaacagtgccaccattggtgccatagttctacggtgcatatgctactgtcttcagtaacgcgttcggcgttcggccataccgtgcaaattactttacaattcttgtcttctgaacattcgatttcgaaattttgtttttcagactgagaccgatcgatgtaaaagcagatgggatataaagtttcatcaagattaactgctgattttcttaaaaaaaagaaagaattaattgttgattacttccttcgtctcaaatgtaagcatttttaaggtagtcacagatattaaaaaaactagttgataccccgcacgttgctgcgggatatatagatatataactttgaagaattatggctccagcaaaggttttaatattttgcaattcaagatatgagctttcttaacgaaacaggcatagctgcaggccttagcaagcatgcagatgaagttaattactttgacaaaaacgaactgcaccagaaaagtctgaacagaaacttgcaaatgtaagctaccaggggccaggcaaagtaccgattgtagctaacatattgcatttaacccaaaagattagtacagtttgttgacaaaaggaaatgaaattctataagagcatttgaattgtcgtgtctcattaattacctggcatataaatcatcacgtttactcataatcactagccaattaagtcgtacattcgtacgactatgacttgcacttttatatgtaacggtaacggtaagtatcattcatgggagtaccaaaaaatatcgtaaattttttgagtcaaaaactttgatatgtaactataatataattgaagtactataattacattgtaagtacactgtaattatattagtaactacgatataacttatataaaacttgtattcaactatgatttggttagacgtgacatatgtgaaaatttagttgtaacaattttttttcttcatacaaaagtttcgaggcgatccgatggtgacaaatctgaaaatttcaggggcaaaaaatttgtggaagttttctagcaaatccgatcatttatatatgttaaaatttaattaggtaattagatttataataattgggactatgacttgcatttttaaatgcgtatcgtttgtaataattatatatgttagaatttaattaggtaattacagctattggaactactatatttaagttttgccaaagagtgagatttacaggtattatatactaaactacacatagaacatataggctgtgataatattaggagttagagtaccatgttgttagcggaagatatttaaatgttgttaggtgggcaaagaatacgatgatttattttgagttattatagtgctctttttactattactccctccatttcataatataagttataaccacttttcttagatgtttcataatataagacatacatgcaagcatgcaattaactatgacattttcttcattaaattattattttttaaatcctccactctcatgttgtctaatcatattggatgcatgcattagtatttattatgatgatccaaactacaagatgataataattatttcttgttctttgggttaagggtggttgtgtcttatattttggaatgaagggagtatttagtagtagtagcttttattttaattaagtttaactgtgttgtttctttatttctcttacgtgacggtaccccatgaatggatttttattacttttgtcttttctgtttcatctctccgatggaagtctcctgactcttcctacgatcttcattattaatccaaccgttcacaccaaatccaaaggtttatgctatataagtatacctggctcaatgatggaagaaataaacattcttcgttcattaaaagagatatacatgaaattcgacttattcttttattttgggctatatccgtgatgccctatatattgtactagacacgtgggcttttaatattggcgggcccttcggagtattgccatggtggattcacgagtcttccagttaacttccgaagtcccttgaccatgctttttactttggttattttgagaaccaacggctgttgtttaatatctggctatatccaacagttctaattttgcccatgacgtggcacatctaggtgatgaacaactttagttttttcattactttagattagctaaaaggaaatattcccggtaaagaaaatcaagcttatgagattcgtgaaagtctaattaatagctaacataaggtatctgaaaatgtataagaatcgtatactatttattgctctatgctgctagctggtaaggatctttcaattgcagtgttattttgaaaaaaaaaagaagatactgttacattgtcctaatgatgaaagaaattataatgcggtaagaaataagtaaaagaaaagtgcaccttcaaaatctccatatcattcgcatgggagaagaaaactgaattctctcttaatttataggaatcataagttcgtgatcaaaactgaatatatatgaaggcagaaatttgtgatcaaaatttacctcatcaattagggtaagatcatgtatgtggcataaggaaaaacatagtgatatcatcaggttatattttttttgagtgggaaaagcaggagctctgcctatttcataatagaaggagagaaacataccttaccctatttgaagaatgtctataaagtttcgctatttgatgtaaagggagaaaaaaaagagtacagtatagacatcagctttaccaaaagctgataaatttgggatcgagccaatgaactcaacataggagaatgaggggagagaaaatgtacctcatccaaagactgatgggagtaggaaaggtaaacaccaggaagacaccaatcgactgatgtcaggagctgcaaatgaaatcatgttgacggggacaaattagctatgaaccctgcataaatgccccgtatagatcccattcccagccaagatcaaccaatgttttccaaatctaaagaccaaatcaatgccctgataatccatatgagccaccagatgaattggacgggaacttgatgaaaatcgtcagccctaataatccacatgagtactgataatatatcgtggtgagcgccgcgccgggattgaaagcctgtatgctcgcagagcatcgggaggggctcgtgctgaaagaggaagcatcaatatttagcatgaagaagaggaatggaatgggtgcaagaatgatgaaacgcatctggagaataaatggaattaactatacctaattgccctagccgacggctcggtggcagttgattagtcaatttgaggcttgccgttatgtgagtgagggttggtggagaatttgatggaggtctgcctcctcaagtcgctggatgctggagcgtggaggtcgcacgtagtgcactgctccctgcgagcgttcagattagatcgaacggctgagaattaaatggtgacgtggcttaaccacagatcagttttgggtcttacctatatagaaagaagggatagggaaagatgattggatgatggttgtaattggtagagaagataaagtaggtgaagatgatggttatgattgattgagaagaaagcataagtgggaaaatagctttattttgggatatcatggtgacgtggcttaaccacatatcagttttgggtcttacctatatagaaagaagggatagggaaagatgattggaagatggttgtaattggtagagaagataaagtaggtgaagatgatggttatgattgattgagaagaaagcataagtgggaaaatagctttattttgggatatcaccgagtactccatccgtcccagaatataataacttaaaaccggatgtgacgatttctagtactacgaatctgtatctgtagtactatgacacatctcatccggttctaagttgctatattctgagacggagagagtagtgactagcctccggcattcactttccaaagcaccattaacttgcaagttactatgctaaaaatagctgcatttaaaaccagatgtgatgatttctagtactatgaatctgtatctgtagtactagtgactagcctccggcattcactttcgaaagcaccattaacttgcaagttactatgctaaaaatggctgcattttatgatggatgcagtagtaaattatctttcgctgttgagtaccgagttgtttgtatatgtaaattgtaaagggtcttttatacaagtcacgtatagttctgtagtgctgctaatttcgcggcgtggaagacaaggcctggacatcagacacaacgatattgcacttgttggttgaagcatacgctgtgttctttgattctgcacatgagtatttctcaagttctcgtgaataaatcattcaaggaactgaccaggcagtatagaaacgccggtaagttcccaaaagacaaggggcagataaaatatgtaaacatatcacatcttcatagcaccatcaatatgatttgcctgaatccaagtaacatatagcaatatgtagaagtatattattacacaagaaccttctaacaaatcacccagcaacaccatccagccaccggccaccgcgttaatatactcgcggtgaatccatccatgcgaaagcctctcggggtgggataaatacagtagtccacgagagaccactaggcagacgcattgaccaaaagcctccgcgaggtatacagaaggacactaaagtgcagatatctcctttatgacctgctctttgtctgcctcgaactgttcatcctctgataaaccataacactgctattagctcatgtgcaaatgatatagaggcatatcaaatcccattgatgaacagctacagtgggaaagcttaatagatatgatttgtaccagctcaagagctgaaaaatgaaaaatgaattgaacatgcagtcttgagaacagaagaaaagcaagcaagtgtaaaaattgaggtaacaggtgttaaaataggtagtaaagcacctttgtcaatcttgaatccggcaaaaaatcggagaagcttgcttcggtttgtgactagtatgtttacaacctcagttggcttgtttttatttgccgcaaataactgcagtatgtagcaaatgtaataatcatacctgagttcaaataaacatcacctgctttactgggaataaatctgcagagtattaatactaaccttgaacacatgaaatgcttcaatttgaatatttttgcttgaatcctgaaaattcaagagatgaatccatgataatatgaatttctcagaaagaaaaatgctgatagtctgaaatgccttgatttgaataatcttggggccattatttcaagaggataagtattggtttttttctgtaaaatgtaatggcgattctacataggtcacacagcttagaaggttgactggctttgaggctcaagattgagttcaatgcaaattttggtttgaaacctatgaatcatcagaactggatcatgtgttgacagctccagaaacagagaaataaacatggttgcaatacatttgttgtgattaatgtattgctaggaatatcaataaatccgtgtggctgtgacagcattcttcaacatccctttagcgcacagttttttaatgtgtgacactgacaaatgtagactatcagctgggttttcatcttaacagctatctttaccgaaaactatggtccaaagaaattttaatgtataatcataatcatcatcataagctgcagaatacaaggatttgatgggacatgggaatggtgatttggtgatattttctaatgtttgcaggtacgtcaaatcatgaaagcctaaagttgcccgttgcattccttaaaattaataaaggtcaaagtggaagtgaaacttactctcaagagattcatgagaatcataagattatcttttgaactaacataacgcatcatgactgtagagttggatctatcaagcagcatgtctcccaagaactgaagggggaaaagtaaatattaacttcagaaaattagaaaacatagtgtacagtgtactcacagcatcaaaataaaacagtacttttacaaggaaaagatctttggacaccaaaagtgtatatgcatgtgtgagttgtcaaacagcaattaatagtagtgaatcaagcatgataagctatgcaaatcacttttcatgttccaagagaaggcagatccaaatcacttttcatgttccaagagaaggcagatccgtacatgcagacatatcacagataaacccacatgtaacagaatagcaataccttgatagcctgcctttttgttatgtagttggttgatgatagcaacctagtgttgaattctgaaaagaactgcagaagaaagaaagatgataaagacatgagactacaatagcagaaaagatgttacaatttaaaccatacactaactgaattataagtggcatacaaagcaggatacaacagtgtttgtacatcgacatggattaacaatgatgatgccaagtaaaaatactcacccagtcataattctttgacagaaattctgccacggtagctttatgccttgtcagaagttcctgttttgagtaaatcaatatgatcacacaagaagacacgtatgaaaaaggaacaaggggatgaaaaatattagccaagaaagcaagtgtgctcctgcacttcactaaaaatccaaggcatcaaataatttcctcgcagcaacaagttgtgaatattgcagcctgaatcaagttttaatggaaaaaaaattgccacatttttatcaacgtgacttttggaaaagaaaagtaaaatatagtgataccagcggccagtggacatagagatgttatatgtaacctatgtaacattcttagtataattcaggcatataagttaggaaaagaggaagaaaacccaacaaactttttgcagggcgggcttcagcaaatcaccttaaaggtcgcagaagcatctgatgcaatgtcaaaatttggaagttgtatatagtcaaagaacttcttcatgtggtcagactctaaaacgtacctgtgagtgaacatttaccaagataaataagcaccattccgacaggaatttctaatttctacagtattttatggtttatgtaaaacagaatccttagttgggataatatatgtaatctattatcttacgctttactacttcctccgtttcaagttataagatgttttgactttggtcaaagtcaaactgcttcaagtttaatcgagtttatagaaaaaatagtaatattttttacccaagataaatttattacaaaaatatatttaattattaatttaataaaactaatttgataatgtaaatattactatatttgtctataaatt

SEQ ID NO: 48394 - DNA, 33431 bp, Oryza sativa
ctatgggcctacagcacgtaaactacaataaccattcacatgaatcgggcctctctgttaattatgcattccttcacttaaatgggtacacaatatatcaactgaagaaaagaatcttgaatcaatatttggatacagcgcatgaaattccagtgtaaaaaataataattcgagatatgaagggttatgtgcaggtttccacaaaataaatttcaaatttaaggccctctttgtttaggcttaggcttttaagccaattttttggcttgtatgttttataagcctgtggctttgaagcctgtttaatgatggagtcatacctccaattcacataagcaacaaaaactactccaacctagcatttgtcttaacagtgtaaagagtggcttatggcaacgaaaaagctgcttgtttgtttaggctagacctttcggctcataagctggcttataagactaaacaaagagggcctaaatgtgcttgcatatccacttgataggttcataggcacaaaataaataacaattttaatgtgacacaccactccaatacaaacttagtgcttgcatatccacttgataggctcacagggatgatggattttgctgacatgatgttttctgatgtttgattcataatggttatcaatttcagttcagtaatgtcaccttgcaatactttggtggcgaatacattccctcagcatagagccgtaatgcaaagcaatgtccatattctcatacctggtaagtagtgaaaataacaggcaaaataagcaaagctagtctgaagcaataacggtacataagaaatatttggaatgcaataatcatgtggctactgcaagctaaaaaaggtaaacattaaccatatttgctgtattcccatggcataccgtcaagtcaattgttttacacagttattgtcaaatctaaatatgaacgtgcataattagtgctagctcaaaccattgtgcaaaaggcaggccccacaatcagatggcctgattggtgtactgtatttgttcagttggtgggacctatgggctgaatttgacagggatcagacgatcagccacaggtatacatggtaatgtggggttgaatacatgaatcatttcccttgtgtgcagatcaaagaagctggtcccattaccatgtcctgaatttgggtttgttcaaacgaacacttagtttcgccttttcttccactaccatggtccgagtcccccagtgggcatggtgcgaatgctaaccattcccttcacggtttgattttttttatccccactagaaatggcataaagcaagaactggacataatagttattgcagtagtgttactggaatattggaataacgtcacttgttatatactgactcatattatgtacaatatcaaccataaagaaacccaggggaaatggtttgtaagtactttctgatataccttaactaactaatgaaatactgtaacatacgtgcatccagtttcgtaatttaaagatggaatatccatctagatgtcttcatatggacaactagttttactttaactattattgagcattaaatccagcgcgctaaatatggaacacatggccaatcaagtatacagaggccaaagaaagcgcctgagaggcaatgtggcaccaagccactaagaagcaaaaagagcaagaacagctaaacaaacatgatacggccaaatattttataaaaggaaatgaaataatgttctgtaattgtttacttgcatattagactcacccagaaattaaggtgtccaaaagatctttatttgcttctagatactcagatgcaactatttttgaggagacttgctgcctttgcaagtttgcaacaacttgagttgcatctttcctggtctgcaagatatatccattaaaataagttagccatctaaacagtagcaataagaacagtacatgtatcaccagtaccatcgcaatccaccaaaaacaaaataaagttgcatacctctaagttcaatttcggaagacaaataattagaagccgtaaagtgttctctctgaagaattcttgggtcaattgcacgcaagcctcagtcacaggttcagattcaccattgccataaagaattgacttcaactccctgatatttttgcttaattctgccatctgcataaacatggtcttagctgcccataacatataggaatatatttttcaagttcatatgtattgtttacagaataaattgacccaaaaattcataatagttaataatattgaagtaatcatttgaacatcattatgccagtgcacgtttcatcaataagctttatccataaaggcattattaaatgctaagagaacattccatcaactagcttttacaggcaaacacatagcggtaagtagtgccaaggattaaacagtctacatagtcgaggaggttatgaattttctcagcattatttaatttgagatggcatcttagtaccacggataagagccatagcttaatccttgtagatgaccaccgacacactgagaatcttacactgagttacaactgcaggccaattgattatctatccaattatcataattgcataaacagtcataattaagcagcctatgggtctccgtggaacagagaaatttcctgttcatgctgaaaaagatctgattcatatgaaattaatatcaacttcctatgaactgaaatgcatgttttcgaaaaatgccgtaattgtgtcatatgccaaaaatgtatatcatggagttacatagactaccccttagttttgtacattccggatcacatcgatataattataccatcttaatagtcacaacctcacggggaaaacaaatctgctgccaaaagcaagtagactaaactcatataccagcatatcgcaggctcgcatctattgcatttatgataagttacatcaaattgaaggaacagagcacgaatcatggctaattaggtaaaaaggttccactctcatgagcgatcggggacgaatgtgcgcagcaagggggatggggcagcaaaaaaaacagtaacaactgcgtgttcgatctcaccttctcctcgcgcttggcgtcgccgccgcgtgatccggagtgtaggtcgaggaagatgaggagctcccgcgtctgccgcacgacgtctgccggcgtccgcggcttggacttgaagaggcccttcatcttggcgccgtcgtccgctgccgctagcgccgcggcggcggcggaggcggaggaggctagcggcggcgcccgcggcggcgagggcaggggcgaggcggcgggcctcctccgcccccccgacccgaaggagaagcagccccggaacagcgccactggtcccgccgcggcaaaaccctcccccactgggagaacgagtacccacccctcctcctcctcccccaccgcgacggcccgcggcgacgcggcgagggttcgtggggttcggggtctcgcgagatcgtgacgcgatgcgcgcgcgcgcgcggcggcggcgcggcggtggcggtgggcggtggccgagatccccctctcctactcccctatccacccacccaccggcgcggaaggaggcaagcctagggctagggggcggtgcgtttctcgacgcttctcccctgtctccttccctgctccgcttttctcccaactttttttttctccttcgtttttaactgttatctttctgtgcgtgccaattctgtgatccgctttggattcagcggcctttgcctgaacacgaatcaacgcaatcatcgaccagagaaatatttccacctgtcattgggatcagcaatcaacggcctcgattatccgctgcggtagacatgtcctcctaggccatggccattcacagtgggcttaagtggcattcagcctccacacccaaaaacgaatattccatgccacatcgtcaaaccgtgcagcttgctcaggtccgagtagccaactttggctacgagttcttcacgtctcaagcgggacccacactatgctagaggatagaggggaaaggggcgaggtagtcgacgggctggaggaggaggaggcgagagcggggaaggagaagaggaggctggcgtcgccgtcgttgtcgctgcccggcgccgtcgccgctcgggccgtctcgccaccgagctcctccgccatcaagccctccgccaccaagctactccatcgctggcgcttgccgttcttcggggggaggaggagggtggtgcgcgggcgagcgccaagcctcgccgcccctccggttggcaccgccgccgcttggctgcttggccggtgatgcactcagcgctcgctagtcactacggtggggaaagaagccaggagagagaggggggagagaaaaaggtggtaaaagctggtaatggtgggacccacacgaagcaacttgcactgtaatacatgtagctaacattgttcctggtctaggtggcgcgcgaggctgagcaaataattgtggcgtattgtgaatgcccttagagcaggattaatagtaccacccgcttctggctccaacctcttccacgtcatctccatacgaattaagagacatatgatacaatagctaggctctaatactacacacattacatatctatactttctatatagttggtacccactaaagctaaagcttaacaggcaagcatgccacatcatcacccactagcaattattattctagctcatttaaaatcccatgcaagtatgccacattttcactcactagcaattactattctagcatattttcaaatcatcttccttatattattttctcaacatttcaactatcatcatttcaacaatatttaacatatattcatccgtgaatcccgcagcaaagcgcgcggtatcacctagttattttaatataaatgggcctatctatcatcagtttagggtagcatggatgtagcaaacaggtctccttgcgctgcacctgtggcccagcgtctcggagttcgcgtgcagcctggcgcttatttagtcacccgctagcgttctctcactatccttctctcctccagcacagcatgcgagccaacgtagatacactatcgccgacggatgaatctttattgtacctgctcatccaaaccgtttgaatgctgttcaatctaacgaagcaacaagcatattttggttgcgagattggaactaacgaagactaagtttaacttgacgcacgtcaaacgagaaaattattagtacatgattaattaagttttaattattacaaacttgataaattgatatatttgatattttaaagcaacttgtgttagaaagtttttgcggaacgtatcgtttagtagtttggaaaacatgctaacgaaaatcaaggtaaaatctaaatcttaacgagaaaagcacttttacaggcagctattatgaactctgtctttcagacgaactcaacagatagcaaatgctcaattatacacaacagggcagtaaacacaagttaaattgatgaattgagatttcaaagtacatagaagtagtgaaagggtaaacttgcagtattccactgaaagtatatactccctccgtcccataaaaaacgaatctagaactgaatatgacatattataatataatagatctggacagaggtatgatcagatttgtagtactagaatgtgtcacattcagtactagtttggtttttatggcacgaaggaagtataccccttcggttgtccagcattttcctcttatttttccttttttttagaactagtagcattcgcctccttgcacgggtaatctgagcactgctcccacagtccaacggaatgggaccaatcccatcgtcggtgttctactacagtctaaaaaagcgtgtccagttgctacaccgtactatatgcaagacgagatgaaaaaggaatactattctcgtggctctctcaactggtgcatggtactatgctttcgaggtggctcgtcgtacgggtgagtgttgctcctgtttacaactgcatccccgtgtaccatgaatcgtaaaaatggcttcccttcaaataccataattttaaattatatctgttaaaatgtcaccttcattggtcttcttaccatcggatttggtggtccaacacatcctaacagcccaatctaacaatttaaagggtagtggcaatggtaccaaactttgtcggctctcaaaaacgatcccgatgttgaggaagaagagcgatctcaatgaccttgctagccctcgagcttagttttaacactaatgatggagagatcatctgatctgctaaggcgaatgcgatcgcgaaaggcccatcggagataaggacgagcgatgttagttgaggaagaagtgtcgagctcaagatttggcgagctcctttgctaccattgccgcaatccatttatagtcatgttgatcccatgctaccccaagctctaccacctaccatgctaccccccaccattgttacaagacccttttttatgatggcatgatctcaaattttttcactgccgacaccatcactcctccaaccgatgccggacctcctccgccatcaccaccacaccatgtggacatcccttccctgcctctcctcaagttgatggtggcaagccgagcaaggtgtccctgccctcgctgtctttcccatctctaatagtccacgtcgacagagatgcccccaccttaaccattcgctttgctttgccctcatcatcaacactggctcactgctcggtaccgaccctgcaactttggcggcggctccactttccacgactatacctttaagcccatggcccatggaacttacccctttgcaccatcttactctgtccccaccccccgatacctaactggtctgttttgccactaccatcacctgagatgagctcatcggagcaggaggagaaaatcaggctgcacaaatctccaagtggatgggtgaattcaaaaaaaaaaagcaagatatgtgcttcgattttatgtcaaacggaagttagcaatttcatatttatatttatatagggttgggtttaggcacggtcgcatggcagctccgctcggatggtacgttttgttggtaaaatttgtcggttccttttcgatatttcaatgaccgagaaaattacttcatttattctaagatccaataacttctcgtattcaaaaattgtcataaaatagaacttctccacctactctcttctttcaaccaaatataatcctctacttttaatttctttaactactatctcatcttgacctagcacaaccattcactgtgtagttccacccactttcctgatagatctataatcttataaaacttcttataatttaagacatagagaataataagattaaaataggaaaaatatgcagcggaaaatgtgggataacatatgctaatatgtgtatgcaatggaaaatctatgaatatacaaatataacaatcaaaattatgaataagcatggatgaagggagagagagaaaaaaaaagctgaaacacaagtgttcaagctctaaaaaaaatacaagtgttcattatttttttcttgttctctgtttgtcctctctgccactagtgacaggatcgacggggatgtggaacaacatagagcagccatggttgtgatggatgcggtgaaaaagaagactttgttaaatttgattgtaattttcctttttgatatggtattttctgttttctttaatataagttagaaataagatgtcccaggatatctttgttaaaaaaagttctcaaaaaagtgcaagtgttcattattttatagaaaatgagcatttgcatttcttagatactccctccgtcctaaaaaaagacaaaccctgggtttccgtgtccaactttgactatccgtcttatatgaaatttttttataattcgtattttccttgttgttatatgataaaacatgattaatattttatgcgtgacttatctttttaatattttcaaataagacggacattcaaacgttgggcacggaaaccagggtttatctttttttggaacggagagagtagatgtttgatagaatttacgttggaaagaatgacaaactttccaatctttattctttctgggaaaaaaaacttgctcttcaatttgtagcattgggaatcttttgtaggaatggtgattaaattttcttctttccttttaaaaaaccgtgtaaaattcgtacatttcaagatgaacccaacaatctacagacctacacaaacaggagtgtggattgagaaagaaaggtaggagtattccatgatcacagcatataggttattgatgtgctactttcgacatccacatccatcagtatacctgtatacgcagacatgcatccgacaagatcaatatcgcttattgattgtattcaggactcctattaaaaagccttgaaaccatgagcaagatcgatcgacaaatggcatacgaacaacttcagaattggcaccggtgcactttccacgctgtcccacaccgcccttctaggtagtacaatcagatggtgtgggcagctgcctcttccaatcagatggtgatgacaagcatcaaatgcgagtgtttctatgatcccccaagacagatgaacgtactttttagcgtttaatcgacagataaatacgcctcgatgcttttggatggtagtacaaagacgggtgattttaccgtgttccttcttggcgaatttaaccgtttttgatcgaaatatagctgaaaaggaacgaagaaaccaaaccatttttttcattaagagtactgatatattaaaacagagcagctagtttgctcgtcttgcgagatctgatgacaagcctagaacaagaacagcagcagcaggagcaggaggaggagaacgtgttattcctctgaactagtagtaagtttcagctgagatccgacggctgcaaatgccccatctctttgcttcagaagaaagcacggcttccgtagaatactttgggagatttctccggcccaccggccatcggcttcttcgccgccgccgcggccgccgcgcccgagtcggcgccgctggagtccgcgtcggaagcggcggcgccggcgccggagacggccgcgctcttgtcgctgccgttgtccaggtccagcgggagcttcatcttggcgagggactccgtgaactgctgcatgctcttcatgtacatgtccatgatctccttctggtcgaccttgacctcctgctcgaggttgacgcggatgaccggcggcttatccaccgcgctctcggacatggcgccgggggagttcgccgccgggctggcgctgctctgcacggtgcgggaggactccacctccgcgtcggcggcgtcggaggcggccttctccttctgctccgccgacgagacggcattgccggaggagttggactgcggggtggccgggaccgcggcggcggcgggggactccgtggtggacacgctgctgaccggggtgtcgctccggaaggtgccggccgagtcggcggtgctgttgtccgtcgagaagctctgcacgacgcgcacgccggcgacgtgggtctcggcggtggcgccgtcgccgtcctcctccgaggtcaggaggctctcggagctctgcggctccacggcggagcacggcagcccgatgtactccgacagcatgatctggttctcctccacgagattcagatcggggaactcgatcttctcgtactccttaccgttcgccgcgccgccggcgcggtgctcctccgcgtcggccagggccggcttgggcgtcggcgagatgggcacgacctcaggcacgaccccgatgtaggacagctcgagctgcaggaacccggcgtgggagtggaagatgtcgttggtggagagcgggaactcgcgggcgagcgtgccgccctcggcggcgacgacgtccgggagcggcacgagcgcgaaccccagcagctggtcctgcaggtagttcttgacccggctcagcatccacacctcgcaccggagcgcgccgtcgacgtccccggcgcgcacgcccaggcgcagcgactggtcgaacaccgggttgcgccccccgccgttgatgacctgcgtcgacgccgccggcgccccctcccccggcagcgacagccgcgcgtacacgtcctgcttgtggtagatgcagatgttctggatgtcccgcgcgctctgcacgtgcacgtcgacgtacccgatcagctcgccgccgccggcgccgccgctcccgttcgccgccggcgcagaaaccgccttctcctgctgcgactccatggcaacaaacaccaccaccactcgcctgcaaacaacatccaaaagagataacaacgaatcaaaccaaatccacacaaaattgagccgaatttccccccgactaaagaaatcgaaaccggtgggagagcagctgcatagtcaaaatccgacggtaggtggaagaacagcacaacgctgaactgtcggcagatgcttacaaaaaagaaaaataaaacccagaaactgcagcacacagagtctcctcctcgtcaacgtttctcgaacagatggaatcactaccagttcacagccccaagaactcgattcaaccacacaaccactcaagaactgaagataaataaactcccggaaaagagagggcgatcgatgccgcgtaggtttccatcccaataaagggaaagcgcaagaaagagcacaaatcccagggaatccaagagagcacagaagctacagagcggggaagcaaagcaaatctgaaagcagaaagcacgagaggattcggcggtttcgcctcttaccttgtctgtactggagtactactcgagaactgaagcagcagcagcagcaagcacacaccactggttggaggaatgaggaatcaggcggaggagagagcaggagcaggcagcgtctactggggggctcgaggatataacaccaaagggggattagggtagtagcagcagattttttttttttagtctcaccttgcttttttttttctactcccgtacctaactaagcttgcttttattgccttgtttggctttagcagccacacagccctagcctcaagaaaattaccccgagtataccttcactcattcgttcaaaccactgtatctgtagaagtgtagattatagaattagtacgtgtacaggtagcttaaaaaggggtagaaagggaactggaaaaagggaggatggcctgtagaaaggtcgggaaaaaggggtcgcagaaagtccggggcaatgcagtgagctcagatcaggcgggtgcgctgtttctaggctatattttactcccgttttttttccacggttttgagcgatatggcccgaaaaagtcaagcaaaggcatccatcgactcgcctctgggctctggctgcttgtggcggcagcgcgtgacgggccgcaccaatggggcgcgtccacctgcagcctttggatgagcaggcgggcgtatttttttggttttcctaatcggaaccgtctcgtctcgagtccgcttcgtggccgcggctgcccgcgcctgcccgcgcggtgccggcggggggtgggtgtggcgtgaggggccccgccgcgtccgcacgctcgcgcggagttttcaacggggggatactggccctttccgcggccgccatcatgctccgcttcagtttggtggatcggtgggaagaggatcatctgacttattttttttacgtgattaaattgatacagagtatatgggttttctgaataacgggtttattgacaaggaccccagatagattatccatatcctaactaaattatatcatattaattagtatatcgattaataattagataattactatatattgtatcctaggaaattttgttctaggttcatcactggtcgttgtgtgagagacgtttgtaacccgacttttaaaattggataaaaactcgtggtttgctagctcattcggctcatgtctttcgattcatttgaatttgtcaacaagtttatctgagattttaaattgttaggtatactagcttttatgagccaaacaagctaaggcaagtatcaaactaacaattcaacaaaacattctgacacgaaaaaagttcacatagaactcaaaccttagtgtacgcgtcatcctcgttggtcacatgtagccttctcgagtctcaactcaacacaccccttcattcattttgtcatatcacagcattccgctcggtcatagctctgttagatggatctccctccccttgagcccaacggctcaagggggccttgacccgcgtcctgatcgggggcgcccagcccaatggctggtgggcccccgttacactgcgccatataaaagggggtggaggccgaggcagcacacgatacgaggttcgtcgccgccgccactccaccccacaaacactaaccgatcgagagggagcgcagccagtgacgggaagacgccatcgccgcgccacgcttcatcgtcgggatcgcctacgaccaccgctgccacgacaaccgccgccgtcaagcacaccgtcgccgccgtccacgtcaagccgcgacaacaatgacgatgttcagcgcatcttcctccacgagcacctcaattggtcggtatctaaaccctctcttttcatccacaatgttattcatccacccaatagagccaacccgactagatctatacctaggtgatcctatagacgatctaacaagctctagatagatattgctatgtgtttggttgattgtacgaagtatgaaactagtgatggatattctaatttgtatgttggtttgatgattcaattgtattcaaatatttgtaaacttaaattgatgttgattttaatcacaagcttaacgactcagttataactacaactagcaaatacacttttaacttattaggataaccgagtaaaaaaaaaaagagctggctcgctatccacccgtatccgtcctgcaccgtactgcaggacgtggcaagactcaagagggtacccgtcgcgtgagcggagcggagagacttggcgtgttgggcttgttggtacgcgtgcgtacgtgcgaggcggccgtccgtgcacacgcaggaccggacgaaagggattcggattattgatgctcgtgtgtcccatgcttccgagaagaaacgtggttgacatgtccagtactctagtgtggttgcgatcgatctgcttgaaagcaatctcgtcgtgccgatagcatatgaatcttatccgtctcacttgcaaacagttggtatttttgttagcgttttgctctctttcaacgggagaattaattgaaggtacttgcaatctgttacggaagttccaagttgaaaattcaggtcagagattactggaaagagaactgtcaactaagatttgggcaattccaactacaagatttgtggaggatataaatcaactttctactggtagggttttagtaggccttataggctatagctactggtcaatagactcgatactttcaacttatattacggttagtcttcaaccaagaattaggctcagcatggggttttcacaaaatcaaagctcacgtaaaccacgagatagagatcatgtgtgtgccaccatgtgaaattcgtcggcgtcattcctctgctcaaactcatggactatatatgtgcacctctcactacttctagatgtgatattattgatcactgctttacaccaatcaaacaaaaccagttatttcaaacaaatagatgcttaatagtcgttgcatgcatgcttccagacttccagtcaccaaactgatattgtagtgcagctctagagttaagaaaaaataactttctgagaactttcatggtgtttgtattccaaaaaagggtatatatccaacggttttcaatcacaggtatcatataaaaggtatttaagtattagtataggtacttaagtactaagagtaaaaatataattttactagtagagcaaaaatggtagaattgtctcccaaatcagaatcggtaccgcgtaggtactactatacgagttaacatttccccgaaccaactttacaggttcttatttgcgtattttcccttttgcgtggttttctcttgatttacgttgtgtttaagttaaatcatttagctagcactagcgttacaggttcttgtatgttgcatcattttatctagagctactctgtttttttatgttctctattacatggttttttctagagttacgttatgtttttataacccgtacatgtcaaccagatcttgcctcttgttcaaatgatcaaccatgctagatcttctttcttgaccgtgtctcctcgtaggtgcactgttcaaacactagaagaacatcataggaggagatatcgtttactatcccaaaaaaatccagtcccgtatataaggaatttatgaaatgtataaataactaatcaatataaagcttcggtatatataaaagagcaaattgcactggcggtccttaaacttgtaagcaggttttatttagatccacaaacttacaaagtgtgtatcgaggtccctaaacttagtttattgtatcatccctgtccaaagtctcatttgaccgtggtcttacctacgtggcatgacatgtcgatgacgacatggcacattattattattatttctttttttctcccttcttcctctttcatttctctcttcttcggactctttgacacgggggagctcgaggtggctctagtggaggaagaagataaaataataggaggaaaaagaaaagggggaaggaaaaaaaaatagcatgtcatcgtccacgtggcgtgccacataggtaagaccatggtcaaacgacactttggaccgggatgatacaataaaccaagtttagagatctcgatgtgcgctttgcaagttcgtgtatctaagtgaaaccttatgacaagtttaaagatcgctagtgtattttactctatataaaaaaagatttgagcgcatttattataaaattttactgtatgttttagttttatgtcaaaaagtaggcttgattaaccctagaaggggttttcaggtagattaacctagaaaatatatagaaacattactctagcttttgtcactcgatagagggagtagtaccatgcgaatctctcaagtaatcaaggatcatggcgatggaggaggtgttgatagtattttggagtttttttcagtatccgcataaggacatttccgatttgtgacctccatattgtcttttagctttgtcacaacatatgtttaaggtttggtagaagagggggaattgaataaacaatacacgctgtgttcttacacaagagaccacgatgagtaaacgactgatgagacaagaatatatatagtgtgtgcgagtggatatatatgtcaattagcacattttctttttttttcaggggaaacggtaggagctctaccaattgcaattaaggaggaggagaaaaacatggttttcatcttacaaacagggccacaagcgaaggggtctcaagggactccccgctagacacataagggaggtcacaaaagctttaggaaatgaatagcaacaagcaggagaatgcgttgaagtctcatctaagaattaagggcttcatcaaattctttgcacatgccgatgatggactcgacgacctgaggaaccatgttgtattttgccattgaagatcctctcatttctgccccaagtcatcactggtggagaaagcgtttgtagtcccggttcataaccctcctttagtcctggtttgaaaaccaggactaccaatccaggactaaagatcgctatctttagtcccgggtgaaataactgggactaaagatcgatctttagtctcggttggtaacaccacaccaaccgggactaaagatggctcagccacgtgaccggctgagccatctaccaaccgggactaaagatcgagctgaccttttttttttgcatggccctgttgctgcatggtttatatatataaaccatgcatatatatgtttcaatacatatgtatgcatatattatatatatatacatatatatttatttatttatattatattgtttcaatacatatacatgcataatatatatgtattatacatatatacatatgtatgtatatatacatatacatatatatacatatacatatatatatatatatatatatatatgtgtgtgtgtgtgtgtgtgtgtgtgtatatatatatgtatctatatatatatatgtgtatatgtatatatgtgtatatatgtatatatgtatatatgtatatatatatatatgtatatatatatatgactaaaatatatatttacattaaagaaaatgtgtacatgcatatagaaaaatagacaagtattaattacaatccattatgatgtcctaactagctacgattcgacgtagtagtagtcgttatctcagaagctaaggacctatgaattgtatttccgtcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaacaaatcgatacgtatgaaatgaaattttgaatttatttctacgtacatcgagctctcttgtggtgatgatttggtctgcaaggcagtggcaatactcgcacacgtagtagccgcacaagttagttccctgctttgctttgcgcactataaataaatgacaaacggtgagagatctaattaatatacacttgtatgtatttgaattggagattgaatataaatgtagagcatgtgtactcacaggaaaattgaacttccacctaagtctttctctctatttgccgcggaccaaatgacggaaccgataccaagccctacatggagtttaaagctatgattcgtagtagcaattaattataacaagattcttaattaacataggaacttatgacagtacctgtctataagttcgaaaaccttgtcaaacgtagattcttttttatccattgagtcatatacgttgacggtgcaggcctccaggtcgaagagtaaaaggatccagtggaatctgcaatgtgcgtgggatgcattacatatgaaacacttagcatgttcgtacgggaatgaaatttgttataggaagacagtaaaaactaactctgtgttgtacggtaatagtatgaacgtcttgtaatgctgcgccttcaggagatggacgagattgtcctctgtggcttgcggatactggacgagcattgcgacgtttactttccaagggtcaatgaatccagtatcgaaaaccccccgccgtcgggccctttgaatctccattctacaatgataaaaggaagtatatattatatataatctacttatgtacaaggacctaattaattaaaggaaacgtaataagaaatctaactgaacgatacttacaaaatccagcaactcataatagagacgtcgagggcgtccagctggtacagttcgtagatacccttgaaattgatccagagaatgtcatctccttgcaagaagtccgtgtccctgatcctcgctccgatcatttctctaccggtggcgctcatctccatgtacagttgatggaacttgtacatttgtgtgggtagggactgtagctgctcaggcttgacaagtggtttaccgagttcgtacatgtatttcacttccgccttttcgattggtgcgcctcgtagcaattgatccatagttagcccggtgtcattaataaattcttgtattccaaaatctacaccggtcaccaacgactcgatctcttggtttggttgctctccaagctgagggactggtttggactttccagaagatgctttcttaagtgttcgctcatagtccgatagctttatggcctccttggcaggtgcaaacatacacctgaataagttcctggcactcgagtatataggaatcttattttctagacttcgaggcttcaattgtctcctgacttctgatgccacataagcgtcaagctccttttgcgtgcaatcgtaccccgggtccttattttttgcggcgtcaactttcgccttcttcgttgcccttgtgggggcaggcggtggagcttggggggcccttgacttggaaggtgccggacgaggagcttgcggaggagtcggtgtaggagcctaaggaggagtcggtgcaggagcctgaggtggagacggtgctggagcataaggaggagacggtgcaggagcctaaggaggagatggcggagccggaggagatggtgcatgagacgccgcttgtcgcctagggaggatgatgtatcacttgcgccatagtataatggcgtggcttgtgtctcgtagatgcgtctcaccgtctcctccagggtaatccaactcgaggtcctcgtacgcgccttccaccaactcaacttcgaccttggagtatcctgctggaattggcctacagtggtaagtacctaaagggtctgttggtatggccatgcccgacgccaccttcacgtggtgagaggttatttattagtaatcaacatatataagcagcaacttgcggaatggacaaatctaaaatctataaactacgagtttacctttattgataagttcttgaagggaatatgcagctcacatggtgtccgctgagtgatgtcatcaacagggcatgtggtttcgtcctgggtttgcatggcgtccatgctctatgatcctacctgccccgttgaggcgcagctgctacgattgcctgaagggctcaccattgcaggaagaatggtcggctggggatcatgggaccgatgtgcggccatgcgttcatcaaccttccttgccacctcctcttgcatgctgagctcgtagctcgataccctatactcaagatctgtaatcttcgcatcggtatctctcttgctactcattcgactcctatacgtgtggatgtcctccttgaatccaatcttccaaggaatcacccctttccctcgtgttcgtcctggatgctctagagtctgcagggcgagtgacagctcgtccttctctctgtcgggacggaacgtgccctgagaagaggcttccactgcgtctgttagtcgacgcgcagcctcgcgtatctgatcgctgaagaccagggagccatcaactgggttgagcgttccaccgtgagcatagtaccggaacttcgatcgatccggccatttaacggtggccggttcgatacccctctcaagcaagcttgcctccatctcctcccacttcggcatcgcgacactatagccgcctgacccccagtggtgatggtacttcttcttggcggcattttctttgtttctttccatcatcgcttgcccttgttgacctgtcttatatgcaacgaactcgtcccagtgatcccttagctttgggaatgtgtcgaagttcggtgtctgccccttcaggatatatttctggtacagatctcccttgaagctctgaaactgttctgccattttctttagagtccaccttttcactttgtcctctgtacccgcgggaagggtgaatgtctcgagcattgtggtccacagcatctctttctccgaatctgggacaaagctctcatgatctctgtgtgcccttgttctgcgccagtacactgtactgacaggcacgttatcccgcacacccaaccgctgtgtcgtacgtagttcttggctgcttccgccggggcactaggtcggccgtcttcgtccacttccgttatgatgtgccgaccctctagcttcttcgcggcacctcattgcccgcgtgccctcttttgtccagcggagggttgacttccactagcctcctcctcctagttcccctccacatccctctccacgttcccctcctagttcccctccgcatccctctccacgttcccttcctcgttcaagtactggtttggatcctcgttcccctcttcttcgttccagtactggctgcttccctccgcgattttatcgtacagtatatgttactcatcgcgatcagccatctgttcatacaagaaatagttgctaagtctataggtcatttttgctttaataatcttatatgctaacaatcatatatgctaagtcaaatatgctaagtctaactatcgtatattagagccctacacaatcttatatgctaagtcttattacaaatctaataatcttatattaaaactcaaataatattgtattaaaactctaatagtcaactatgctaagtctaagtgtcgtatattaggaccctagacaataattatatactaagtcttattacacaaatctaataatcttatattaaaactctaataatcttatattaaaactcaaataatattgtattaaaactctaatagtcaactatgctaagtctaagtgtcatatattaggaccctagacaataattatatactaagtctaattacaaatctaataatcttatattaaaactcaaataatcttgtattagaactatgctaactcaaacaatcttatatgcgtcttattacaaatctaataatcttatactatgctaagtctaagtgttgtatattaggaccctaggtaatcatatatgctaagtcgtctaagtgtcgtacattacaaacctagataatcatatatgctaagtctaagtgtcgtatattaaatctaatagtcttacttgcattaaaaatctaacaatcatatatttacatcacttgcctgcgcgaattccttcgagggctagctaccactccggcttgagggacgacgacgacaacgtcttttctgcaacataagatgtattaggataaacgcaaagtaacatatattgtatttcacgttcgcattctcgttaagttcacgtttcgttcacgatcgttcacgttcgcgttctcgataagttcacgtttcgttcacctacgttcattcgttcacgtgcgttcacgttaacgtacgttaagttcatgttcgcgttcttgttaacttcacttttcgttcacgcacgttcgttcgtttacgtacgttcacatacaacgttaagttcacgttcacgttaggttcacgttcgttcacgttcacgttctcgttcacgtacgtttcgttcgttcatgttcgttcacgttcgtttgttcattcacattcacgtacgtttcgttcgttcacgatcattcttcgttcgttcacgtggcggcagcggagcggcggcatggcggcgcggctgcggcttggcgcggcggcggtgcggcggtggtgtgccgcggcggcgtcggggcgtcccggcgtcgtgccgccgcggcggcgtggcgcggcccgacgtcgtggcgcggcttcgtcggcactgccagcgcgacgtcgtggctagtggcggccgcatcgaggtcagagtcggcatcgtcggcgcggcggagtcgtgttcggccgcgacgacgtcggcggcggcgtcggcaacgaggcggccggcggcggtttggggagagagagagatcgaggtcggagagagagagagagggaggcggcggcggctctcaccccagagatgcggcggcggcggaggcagcgatgacgacgcgcgcgaagcaacggcgagatacgacggcggcgtcggtgcggggatgccctagggagtggcggcgaaggagaagccgagagagatcaatcggggaaaaaacttctaagtgttggtggagaagacgagggtgcgcatctggaatatatatacacccctagatctttagtcccggttgttctcaactaccgggagtaaagatatctttactctcggttgttctcatcaacggggactaaagatattttcccgctatttccaaattctttttaaacccggttagggttaagaaacgggactactgataagcgcaatgaatattaatttccattacatatgtgtttctaaaatagaaaataatgcattaaaattatttaaagtcgaaaaattaatgacaattacttcgaaacattattgttgtctatagtaaattaagtggataaaacgtaataagcaaatatatgatttaaaattaataaaaattctaataaccatatatacttagcatatgaatgatattaaattgttaaaaattgtaattaacatatgtatatacatacgacatgcatgatttaaaattaataaaaattctaataatcatatataattagcatatgaatgatattaaattaattgttaaaaactctaattaacatatgtaaatgccacatgcatgatttaaaacttttaaaaattctaattatcgcatataactagcatatgcatgatttaaaattgttaaaaactctaagtatcatatgtaaatgccacatgcatgatttaaaacttttaaaaattctaattatcgcatataactagcatatgcatgatttaaaattgttaaaaactctaagtaacatatgtaaatgccacatgcatgatttaaaacttttaaaaattctaattatcgcatataactagcaattacatgatttaaaattgttaaaacctctaataatcgtacgtaattaacatatgccatacaacaattgatttatacggataatcaatacatccaaaatagtttacatcgtgtacacaataattacggcaatacatcggcggtgacggttgaccgcacgtactttctcctcactattgttccctccttgtgatcgatatgtgagtaaggggtgtcttcatttggtaggaggatgctagggtcaatcgtcaccgtgaaagggggttgcccatccaactgatcataatcctcgtcggtcttgtcctcaactccgacgatttttcttttgcctgggagaaccacgtgacgctttggctcgtcaggccctctgcccttctttcctttgctagacatatccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtccttgatggcaccgtaatacgtgccagttgttccatcgtgtcccatggcatcgatacgaacaacgctattttggttcgtgctctttatgtcttgggttctcgtgtagaatgtgtacccattgatctcatatccctggaatgtcgcgatcaacccagatggtcccctagtcaggaaggccagttattggttgatcgtctcgttacctatgagatgttgtcgtagccacgcggggaaagtatcaatgtgatgccgtgtaatccatgcatcggacttaccgatgtttctagcgcgaactagagccaagtgctcctcgatgtaaggagctaccaatgaagattgttgcagaaccgtgaaatgggttttacggaataaattgttgtctaccgtcattattgctttccttccgagagttccctttccgtatagtctcccttcatggcgtgattcaggtaccccgattgggcgaaggtcttcaataaattctacgcaaaattcgatgacctcctctgttccataccccttggcgatgcttgcctctggacgagcacggttacaaacgtacttcttcagaacgcccatgtacctctcgaaaggaaacatgttgtgtaggtacacaggcccgagaatactgatctctttgacaaggtgacaaagcagatgcgtcattatattgaaaaatgaaggtggaaatatcaactcaaaaccaacaagacattgcaccacatcattctgaagggcttctaatctatccagatcgatgaccttctgcgaaattgcgttcatgaaagcacatagctttgttattgttgcccggacattgtctggaaggataccccttattacaactggtagcagttgtgtcatcaacacgtgacagtcatgagactttaggtcgttaccatcagcatccctttcctcctcgcccgtttgatttccttcaaatcctgcgtactgaccaaagtccggaatattgtcgtcttctacttcatcttcttccatttcaaccccttgctctccgtgggatgtccaacagttatagcttggcatgaaccccgactcaaacaagtggaaatgaatagtcctggatgcagaatactccttctaattcttacacttattgcatggacaacaaataaaaccattatgcctgttagcttcggccactctcaaaaaataatgcacgccgtcaataaactctttggaccgccggtcagcgtacatccattgccgatccatctacatgagatgaaaaaaaatcatacacaaataattattcttacaataatgacagtcatacaataattataaaataattacaaactctttcaacagtcatacaataatgacatatcattattcatacaaaaattataaaatattacaccaaataattcttatttactatttctaaagttttaaactaatattaatgtgttgtacttcttttaattttcattttagttttttttctattatttcatattaactttcactatattttccttctcaactattttataaaaccttatttagcaaataaactaaatttctatatattctttcttccccacacaaattttctctctcatcaacttacaactaaattttggagacaaaatagtgtgcaaaacatagctccaaatgtaatatgacaaaaaaacattggaggatgaagttgctaaccttttagacacctccgatttgtacataatcaccaaaataaatttactagaaattttggcatgacctcccctcttttttgaagaaattttgaagcttgctcaggtagctggaggaggaagaagacatatatatatataggggtgggactttagtcccggttggtgttatgaaccggggctaaagatccccataatctttagtcccggttggtgttaccaaccgggactaaagatcccgggggggcctgacaggccctgacagcatttgaactgatctttagtccggactaaaaatcaaatatgcccgttaccctttttaacagggactaaagatcatctttagccccggtttttattgcaaccgggactattgtggaattcggccgaccgacgaaagatggtttcttcaccagtgcatgtagatgaagagaccatcgaaatcacgcctttgttcttttaccatttctcttctgcaaacctcccaccatcctatcatgtcaattggcacattttcctctttggcgttggagaggttgttaacttgctataacactgttggagatgatacatggtgtggtacatgtaatcgttgttagccatacaagctcgagcttacgtatagagatcataatttttatttggcattgccttgttgaccgtccaacataagcataacacttgcctatagctccatcgtttacttatttgcttatcaactgttgcaaaattttgaattttagaatctagttttaattaaagttgattttaagtttttttttcaatcgtagtttcttttccaatattaactttttaaatagctaaggaattagggaaattttataattcttgagaaaatacctagaggtatcaaattttacactaaaattttggtacctcagggtacctagtacctggatgtatcaaattttacactacaaaatattgcacctcccgtgccttctcaagaatgataaaattaccccaaaggaattatattatgtaaattcttctaatctaatcctctaacaggggctgaatctgactaacagaatctcaaaagtgaaaacctctgattcttgaagctagcccatgtaacctttagcatgttgctcaaggcatgcgtgcgtgtatgtaatggatgaccagaaagaaagtaagggatggcataaagttgtacttgattgctacccacttgaatgtagtagtatcttgcattcttgcttgtagatccaatgatagaagttgcacacttgcactttgacccagatgtgctctgccaatgcagcccatggttttaacttgctctcacactacctgagccagcaatgtttactaaggctgtccttagctccacgctaaaattagaagtttgactaaaattgaaagtttgaagaaaaaaagttaaagtttatgtgtgtagaaaagttttgatgtgatgaaaaagttgaaagtttgaagaaaaagctgggaactaaaccggacctaagcaagaagccaaagcctcaccaaatacccgaaggctacattcctatagtcataagagcaaatacaatagcagactattagctagttataaacatattttaaagagataaaatatgagagagaagtgtagcgggctacagatctgtagccaactgtagcacggactctaagacgtaatgtgtgtatgacaggtgggaccatgtattaatagtatagtaaacaattactgtatgaattggctattaaattgtcaatagatgatttggagctagtagttagctatactattaaatttgctctaagttgcagaaggagagcatgatgcggcaaaacaccgcaaaaacccattgcactttttaagatcatgctaagaatttaatgttaggttcaccataagcttgtcctagtggcatttgttttattgttgttatctccatgagaggatgaaaaacactcaccatcttctaaacactcactatcttcaatgtcaagaatatatatcattatcagatagagctccattcagctggttcctctaggtccttttgcgataagtctgtcattaactcattatcatcttcaccatagttagtcagtcctattatagtttccagaatatttgtcattaccggagatctatttgtattccatctcgatcgtatatttgacctaactagttctctattgatactgtggatgcatattgtatactcccttcattttaaattaatctacatatagtttttttaggttattcctaaatgatctatatttttgtgttaatttattaagtctattcattatttgtgcattggagtaaatggatattgatgcatgtatccatgcacacaagtatttataacccacatgcaatatcttaatttgctatgatgcatgcatccatgcacacaagtatttataacccacatgcaatatcttaatttgctattggctagcaaatagtggagatgatgcatgcattgagtttgttgctagagtaaatatagtatgagagaattattagcttttttttagtcttagtgtacctataaaatatgtaaatcaacttggaatggagggagtatttcacaatatccaatgaatcttcaagtaaaaaaaaatatatttgagtctatagctagtatgcatataagaagatcaaccatgtggagtcacatgtggggcagcgtttgggcctgagccccacacatggcaacaaatttcattgaaaaacactcaattttacatagtctttgaaaataaaattatatatacttcagcccaacgcttgataagatgctgcctcagtgcctccggcctccaataagagctatcatctatatttgaaatgtggcttactattaactatctatttttacgataacaatctatatacaccaatatttttaaatgatgggtttaagaaccgataagcagctcattaccaatgacgtattggctgtcaatgatagccaacaccatacgattaccgtattttgaactaaaaattagattaagcttgtttgtttgctacaatagtaaatatgggcaagattttggaaatgccaatattttgacaacatattacatatatgtctcatagaaaaaaaatggtagaaattaaaccaaacattaccatccaatattttgattcaaaattaaacaaaccagccctctactctttgcaggtaaccagccctctactctatttcttttcttcatccaattttttttttttgattggggcgtgccttccacatggttcatcaccgaaaattacggtgaaaacagttagtaacggagcttgagcatagaccacgtggcatggtcgactgctcagcatataatatagacatactatagtggtatatatatacctccctcatatatatattaagctttcttatgtgatgattagtctaagagaaaaaaaaatggtcgctttcgagtggattgaatgcgtatgctatcctcgcccaaccgttccggtcgtcgcgattgtcacagctggtcgagtgacaacaaatcctgataatgcaatgcaggacgcagtcagtgagtcagtgacgctttggcttgtagcctcgttagtcttttgcttacatggtttggtctctgcactcaacggaagaaaatgtgtcctgcttctaccttatcagattcacagtactaatacatcacattatctattatgacagtattattacagacaccaacgtataaaacaatatatagaaagatataacctatgtaccagtaattgtaatagtattaatattattgtagagtatcctcacccggttgctacctgctagttggttgtataaggggcacgcagatggtccatgtgtacttgtatggaccgaccttaatttgccgatactacaaaataaacttattaactgcttgatcaattaaacgtacgacaaaaaactgaagttactgttcttaaaagaaaaactgaagttagttgaggaatccagctgcgagggctactacagacaagtagaaactgccatctgaagagtgagaacaacaactaaacgaggaggaagcaagcatgcacagcgaccgtattcattcgagaagtcggcgtttaacgcagcattcaacaaagttcgatatgcatgcacggcccgttttaatgcatgcaagaataggtctgacctggacgttggtagttgaccctcttgaaagattttgatcctagaccggggaccgtccgttaattagaggcggctacaagctactgacttattaactatactatggccgagtttagttccaatttttctatcacattaaaattttcttacacacataaattttcaacttttccgtcacataattccaatttcaaccaaactttcaattttagcgtgaactaaacaaacaaacccaggcatgaaccaaacttccaatatagtactgtacaaggacatgaattgaaacaaaagagattatattttagatttcatttcaaatttcagagttcctccatcgattgtctgtttaacagcaagaactttaaggccccctttgattcaaaggaaattcatataaattttagagaattttattcctataggaatttttcctatatagccctttgaatcaaaggaatttatcttatggaatcctatgaaattcctatggaatgtcaaatgccatgcaagttttggaggaattctaacatgaggtagaacctcatggaaactttcctttgaatccttatctctcctctaattcctgcgtttttactgcggtctaatcaaatggttattcctgtgtttttgcaattctctgttttacatttacattcctatcaaaatcctacgtttttcctatttctacattttcccattcctgcgtttcaacggggccctaagttttaagtttgaaattttgtcgaacggaatttcgtaacaggccggttactactggatttcacccgagggtaatagttctggtctctgcctccaatcagggttgacaataaacaccggttactacgttaatcgggtttattgtcagggtacggtaacggtaaccatgcagtgatcccaccaatccaaacagattttaaaaataatttaaattttcatacattttgtctgactttttacagttaggtacagtaaaccctgctcccaacagcagatgagttgccgccccaccactccacagtagccctgatggtacaacgcagctgcattttctcgcggcgcacatggccatgccgttacggcccagcaatcatgcatgcgcatccacggcatccctcgtctccgtgccggaaaaaagacgcactacgctcgcggtcgcggccgccggcctcgcgcgcatatgctgccaatctagcggtggttcgccacgccagcgagggagtcccatgtcccgacccccacgccgtcgccgtacgcgcacggtcgaggattgttttctctcttcaagttcaggtaggaggcggctcccgtgtgtgtcgtttcgttgctctcgccgagtgctgtacagtctgtgaacggagagagagagagagagagagctccatggattcatcagtcgggaggagggcaaaggtacggggggctgtgtcgtgtactggagtactatgtattttacagatcacggctcaatattttacaggtcaccagataacatcagacgcatattctatgccttgcggtcggctgtacatcttaaattactactactatccttataatataccctctccattccatttttattagatgctccataatataagtcatacatgccagcatacaattaactatgacatcttctccattaaattattattatttttaaatcctccactctcatgctatctaattctattggatgcatacattagtatttattaggatgatccaaactacaaaatgataataattatttcttggtctttaggttaatggtggttgtgccttatattttggaatggagggagtactagtaaagaatcgaattggacatatcccatataatttatagtactaagatacgttcaatttgattctaatttactattttttgaatggtctattcaaatttgtagtacaagcatctaatcagatgttagatagttatattttaatacgaaaggagtacgcaactactaatagtatagaaaacgatcaaatttagcacttatctcaaagtgaagctggttgctgattgttttctttctgtaccaggctaccagcacacaggcaataagcccgtatgatagtactacgcttctattgagatatccatgaatttatgtgccctcgctgttgcaagctgttcgtacacagcagagagagacgagaccttgataaaccacaggcgaatttggcttgcttgttgagtttaatggccaggccgcttaattaagacttcattttgatcggtcaaatctctacaggcttaagtactacacattcgtatcgacagcgaaggatgaagcagatcgaatcgacgtcaccgtcacatcctggcatgcactagaactgaaagccacacacagggatatctcccaagagcgagtcatatgaccaaactggatggcgtccatagactgaaaacgcctcagatttttgctactatctggtttgtttcgtcagaaaggtcatattctggtgcaaatgtgcaggctgatggagaaaacttgaaaacttctctctgaacacggggccaatcatttagcaagggtacaggataccgggggggccatggatacaatagctatcctaaaccaggccagctagccaagacaatgacctgagatcgtgcaaagttgcaaggagatggatgaagtctctctagccacacacggttcacgaactatcttgcagcagaacaacagccgttgctatcatgattcagctagaggtttattcatttttggttcatgtgttgctgctctgattgatagaaaccaacggtacacgtagggcagcctccattataataagtgtcgttgttcatgacaactagtagcaagtaaaatggtcggccagatcgtactcgatgctcccacacaaatacctgacaatttagactgatcatgctttgacccacggtagtttctaaactatgtgattacactgtggagtagtatcaaagtagcattgttagatttctaaccaaaagtatacttcactcttgcattgcatactactcaaaaaataacggttaaaatcacactcgtcaaacgtctcgacacaccgtcatgagttacgtttaaaaacagtagtactggctttaacattgatcacattaaagttgtatgctaccaacatggccaacacactgccaggcactattcatgattgatagacagctgagtaaggtgccatagcgcagtagtgctatcctgagtcctgaccataaccaaatttgcaacattatgtgtagctgtatgtaacccagatgctgggagcagcacttccagaggtaggagtaagactgaatgtgacacatcttaatactataaatctagacataatcatccagtactagatagcaatattttggaacggatgaaatatacggttacagaaaaggtgagtattcatagtttgatgcatgctaaccaggtgaaattcaggatttgccagacctaaagttggcatttcaagctttgcttacctcatgtctcacttacacgcgcgggtcctgatcccacaagtcatggacatgtgagttgttgagttgagtatattcatcacaattgagaatatcttgattcaacaggaaaagaaaggaaaccacatggagcaaagagaataatgaaatatttgcaaaataagtcacactagataaattggaacaggggaattcggactccaaaccagaaggaaaaaagacatggttgatgatccatcattctcctataacctttccaagccaagcaagcataccaccctagcatcctgtacacatctaaaattcaacgtcaccttagcagttaccaacaatccaaaccctctgtccccaccccctggatggctggatcctcctctcagttgatgttagttataccaactaaccatccgtcactcgcaaaccacatttgtattcacattaccaaaccaaagccatcaaccgttatttacagatgatcatctctacccctccttacacagctactccattctccaagaacagagcacacgaggttaaataagagcgaagcatactgcgaccacatgattacagcattacctggccaagctcgaagctgccacgggttcaaccctgcagccaccacctccttgccgttgctcgcggagatacccaagcaaagtttcagcctgcaaatcacacagctaaacataagtgtctccaaaatttggaagcagatttcagattcagtaaatctagatagctaactagtgaagcacacattcgggggtgctctttccaatccgactgtacaactaggcagataaagcacgacaggctagactatggtggcaaaatgataattgtcatataaataattaatatacttattgtttactccctccgtcccataatataagggattttg

SEQ ID NO: 48395 - DNA, 15402 bp, Oryza sativa
  unsure (1)..(15402): unsure at all n locations
ttgagtttttgcttgcaacatttgaccactcatcttattcaaaaatttttgaaattattatttattttatttgtgacttactttattatctacagtactttaagcacaacttttcgttttttatatttgcaaaaaaaaaattgaataagacgagtggtcaaacgttgcaagcaaaaactcaaaatcccttatattgtgggacggaggtagtaagaactaagcaatgtttcttaaatcgaaggaccaagctaacagcaaaggtactgcagttttgacttgcagaagagtgaacgtgcatcctcttgtacctcgaaggtttagcaaatccaagactgtacctaagatatgtataattaataaagtgcatatctgcactatgtgaaaagaatctacaagtcaacaactagtgtactgcaaatctgcattgcgtgttagctagcatgatggttttcttaatagaaaccagggctgaattaaacagctttgataataatcaggtagtagaaatctacctaaactcaggtacgtgcacagtgaaccttttcctccgtctaggtttaatgtacttttcagtacttattataatggtaatcagacttcaatcaaactctaacaggtgaattcgttggatactgttcggtacaattatccaaaagcttcagtcacaccaaaagctcaaacccaaaatctacacttgaaaatcgacatactagaaatcttgcaaatcatacccaaatatccaatcccgatatgacattagcaaacaagaggaatgtaaagttgaaaaggttttaccttgtgcttggcacgggcagagccggactgcgagagcgcgacaagcggtgggatggcgccctcacggacaagaagcgcgcggttgcgggggcactcggagcagagctgcagcagcgccaccacggcgaactccctctccctcgccgggccgtcctcgatggtctcgacaagcgccggtatcccgccagcctccaccacggcgtcgcggccctcgacgatgcccgcgaggctggcgaggaccaccattgccttctccgacgtcccgctgccacgctcgccgacgaggtggatgagcggcacgacggcgccggcgctgaccgcgcgctccttgttccggcgcgccgagcagagccggtagagcgtggtgagcgcgtccttcttgccgcgggtggagcccgcggagagcagcgcgacgaggggagggatggcgccgcacgcgccgatggtggcgcggttctcctcgatgcccgagaggctgagcagcgcgcacgcggcgttctgcttggccgacgcggtgcccgtccgcagcgcgtacacgagcggcttgatggcccccgccgccgtgatggccgaccggttccgctcctcgagcgagaggttgagcagcgccgtcaccgcgctctcctgcgccaccgggtcggtgctccgcagcagcggcaccagcgccgggatggcgccggacacgccgatcagctcgcggatgtccgacctgtgcttcgccagcagccttatcctcgccgccgcggtgcgccgcgcgtctggcgcggcgtcgggccccagcgcccgcacgcacgccagcacgaacggctccacgcgctccagcggcgccgcctcgacggacagatccatcgactcaagctcattcagatccacggcgcccacctgcggcgcgtcggatctgggcgtcaccaccgccgccgccgccgccgcgagccgctcgagctcgccggagatatccgagttgaagctcgagtagtcactgaagtcccgcgagagctcgagcatctccgtggccgccgcgttggccgacgacgacttggccaccgccgcggggtgcgcgggccccgcggtggccgccagctcgctgagatggaaatcaatcacggagtccgtcaagttctccatgtccgagtccgcccccgccgcgtcgtacgcggccgccacatgcggcgagcccgggcaggagtccggctgcagcagcgccgaccggatggtccgcatggagtaccccgcgccgcggcgctgcgaccgcgccgccgcgcacggactctgccccggcgacgggatctgggagccggctagcgacaccatggcaggcaagggctaggagacaccgccagttgccgcaaagcgcgagagcgagcgagcgagtgatgatgaggagaggagggttgtgttgtggtgggtggttggttggttgcccgatgcagtgcagtgtagtactcccacgctgcgctacgctacaacccggcgcggcgtatatacacacgtacacgacgcggcagcggcagcatggctcgcgtggcgtcgcaacgaaacggaacgcgacgagaggcgtgcttgcgtgcgtggtggtggtggtgcggtgtgtatctttgtagtcgcttttgcgctcgcgtctcgtcccggggttgacgatacaggtgtcgaggaggctgggatgggttacccgattggtaccaaacctaggcgcaccagttcagcgccaacgtgcgatgacagttggggccaagcgtttctcgtgcagagctgtcagtggatgtgtgtgtgggagatggatgggggagagttgagccgcggaaaggtcagggagccatggcatgggcggccggccaccaacaccatgcaccgggtggttttacttttggtggctgtggaagcaaggaatcccctttctttccgtttgtttgttcctccccgtgccaggtagcagcagcagcagctctcgcgccactccgtgacggaccacggcctctcgcgttgctaccgccactgctgtagtagtacggagtaatgggcatgggtgttgccgccttggcgcggtgcgaggtggagacgtggaggcagcgggagcgtttcggtggggtttttttttcaccgttgggcaggtggcagcgacgtacatttggcagcgcggcgaggagtggggacgggacggtgttcacggtgaggaggtgggcgctttgcacgcgcgcgcgcgcgtggtcaaaaagtcggtggttgatcatggcgcagcgcatcggaggcgtttctttgattctttcaggtgcgcgtgcggtgaaaaaccgagggagtgggagtggggggaggaatttttttgagaattaatattatttttatggaaaatcgcaaaagtagtggtcaaccggggaaaatcgcgaaaataggtctctgtcgaacgggtgcagttcgatagggcacctatcgaacggccatagcgcgactggcgaggagatcggaaggctgccgttcgacaggactcgaacagcccccgttcgacaggcagggctgtcgaacagcccccgttcgataggctgggctgtcgaactgccgcagttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacagaaataactaaaagcttaatacaaatagataagtcaaggacgatcagtgcccttcgcacgcttgctaggtcctcccttcttcctacgcctaatctgctcagtgggatatgtcaaattatcaggggggtgcctatctctagctgtctgctgtggtgtcacgtctggcccctgaccggcctccgtctcctgcgtcggctgtgtgacctgaggtgctgcgtgccagtaatccatccctacttcctcctggggaggatcagtggaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcatgacttgactcccccgatcgatcaacacatgttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcatcgccaaccctttcctcccggccgacgcctcctcggcctcgtctccggcctgctatcccctcccctcgctccctccggcgctcacggcgacgatgtggcgactctcgacggcggctggcgatgtggtcctcaaacaaatcgaacaagcatcgcgggctggggagacggggttttaaaccggcctgtcgaatgcccattgttcgacagggtcggtggagggacctgtcgaacgcccccggttcgacaggcctggcggcgcggggtggtgggccctgtcgaactccctccgttcgacaggcgagcgtgtcgaacgccagccgttcgacagggctctgtcaactgcccgtcgttcgataggtgccctatcgaattgcacccgttcgacagggacctactttcgcgattttccccggttggccactacttttgcgattttccataaaagtaatattaattctcaaaaaaattcagtgggggagtgcgtccacgaacgatggcgacggcgagtgcgggagggggtgacaggtgaatgcttttgttgttaaccacacaatacaggacggtgatttcttttcaatctctttttttttttggctgcgcacacaaatcacgttatgatgttagtctagaccagaaatattgctaggatataagctaagcgtgcatatgagcaatggacatatcagcaaaccatttaggatattggttgattaccgtgtaaaactaggcttcattggcttcccggttcagcactaatctaatacggagtatggtattgcgtgatggggaacaacattacaggttgttaatatatgtacattgtacttacgaaaccttgctgtgcacaacactacaatagcaaaataagcccctctcgttaagcgaacattttggcccctttctaatactaaaacgctttacttctaaacaagattattcttttaaggaaggaacgagacgtcacgcagatttgggttgaactaactactccaattcctcaagcatatgttgagcaaaagctgcaatactgacctcctaggataccctgatacggctgggagcgtatccgtatcggatacgtaaaggaatacggatacgtattcggatacgctccgatacgcccgtacgtatcctctatttttctgattttcagaaaaatgaaataattagggatacttctctgatacgcatggatacaaggtacgatctaatcctaacttctcacgggataccaatcctcgccgcgtccatcttttcctacccaacggcgtcgtcgttctggagcgaggcaaaggtagagccaccactttgcaatgcgggcctactactgctgccgcacgccgccgaggcgccgcatcgtcgccatgccccgtggagccgccgccgccgccgcatgccgcacccccctagcttagcgcacgcagcacacacctctgctcgcggttagggattgcttcattcaagtgaggtaagtatcgtgtattgacggttcagggcatcctggatctcgatttgttggggccggggaaggagaacatcagtttgtgatattggacaccgtaaagtaagactacaaagccataagtgactttttgaagatccagtactactgcatgaggtctggtcaaagctatacaattctaagctttaatgtatctatgtattgctctattagttatctttcaattattggcaatcaattctcccattttctttgaggagtgcattgtttctttttaatttattatgtatatatagacgtatccacgtatccatgtttttcgaaaatagccgtatcccggtatccccgtatcgcgtatccgtatccgtatccgtatcctcatatcggggtaacatagctgacctctctcgctctaagaaggaataagttcaccggatatctctcaacttaacagcgagattttttgaggttccttacctgtaaaaccagaaatgtttacccctaaacttattcaaatcgttcaaaggaggtcccatggcagtatcgactcaatttttgcccggttttactgacgtggcatcctagttaacaaaaaaataaaaataaataaatatgtgggacccacacgtaagtgaaaaaaatatggggtcgacaatcctaatcagcaatctcctttttctccctttttctcttctgtttcgttttttgggggagcggcagcgggtatactgcctcgggaccttttttaaaggggcaattttgtttctaaccctatttgatgtctaatattgattttacccctactttttaggattttcatttttaccctcacttttttgaactgaatgcttgttttgcccctactttggatggtgaagttaatagtgttaagtaattgacaaaatggcatttataccctctcatgtatgttcattaataatgtttttgtccccattttatacatgtagctttagaacttatttttgggagtatatttaaaattagatgacccgcattgactaatataacaatttggacaaattctgaatttgatggaattttgacaaaatttcagcattttgatagaacttaaacaacattttaacaacattttctaaaatgtaattatctgttcctttagatactagtcaatgtgcttcatttaattttaaatatactcacaaaaataaagttataaagctacatgcataaaatggggacaaaaacataattaatgaacatacatgagagggtataaatgtcattttgtcaattacttaacaccgttaacttcacctctaaagtaggggcaaaacaagcgttcagttcaaaaaagtaaaacgaaaaaagtaggggtaaaatcaatattagacatcaaaataggggcagaaacgaaattgtcccttttttaaatggttttacatagtttagggatacacatttctagttctatggttaagggacctcaaagaatgttggtgttaagttgaggtatctccgttgaacttattccctctaagaaaaaccgaacccatttccagacggaatgagctcatctcaggtcccttaacttgtcaacgaatccaattttcgtccttcaactaaaaaaaccatacaacgggtccctcaactgtcaaaaccagtgcagatgaggtccctcggcggttttgagagcggttttggctgacgtggcgtatacgtggcaaatttgacttggtcttcatatgatgtggcattgacgtggcaattatgtggcaaatcaatcccaaaaacaaaaaaaaacttcgtgggacccacatgtctgtctcacacacaaattaacaaaaaaaggtggggcccacgtgggccccacaagtccctcttctcacttcctctctcccctgtttctccctctccctgctagctatggagcgacggctgactccgggcgtgcgcgcctggtctctccacctccggaatatgaacgacgcggcggagctgtccgtggggaccgcgtcggcaacggacacggcgtcgtggtgcttcgcaatggcactgatcaggcttgtgttgtgcacgctccacgctgaggccgtggtccgtggaggtccgcggccggcggctaggcggcgcggcggtgaagccgtgcgaggaggtgtacgtcgtcggggaagacgagatgttgcacaccatcagcctcactcctcccgtcatccctctcccttctctctcttcttccctctcctccctctctctcttcttcgcggggagcgccggaacggacgggctggtgggcagtggagcagcagccggcgacctcggcgaggcggcgccctcgtcgccgccttccctctccggcgatggccttcacgcggcacctggaccagtagccagtaacgacaacgacgacatggttggctcgtgcaactgcctgtggctcaagcgacatccccttgtctgcggcagcatcatcgtgatcaacccggtcaccggcgagtccctccatatcccgtcgccgccgttggcgaccagccgcagccgccacgcgggtatgatcagcttcggctaccattcgacgactggcaagtacaagatcgtccatttcccttccaatggcgggctggtggatgaagtcacgctggggggcaccgcatcgtcgtcgtcccctcccgccatggcggcggcaacggtgatggggtggtgaatatcctcacgctgggagacgacaccaccgccgccggcggcgcgcggtgggggcgtcgccgtggagcctgtgcgtcgcctggggcgttgtcagcgtcaacggcgccacgtactgggtgaccgagggcaagtagatcatgtcgttcgacctcgagcatgagcgcatcgaggccgtcgcattgctgccgacgatgagcaagtgctgcttgccggtgtccatggagaaggaggacgcctgctgccagctgaccacccccgccacaccggcccccgctgcggcacccaccaccccgcgcctaccaccaccacacccgccgccgcgcctaccaccccggctccggccaccgcggcacctcctctcccccggttgaggcttccgtcgccggcgctgttgtccaccgtcttggtccagctgccgcgtgaaggccatcgccgaagagggaaggcggcagcaagggcgccgcctcgctgaggtcgccggctgctgctccgccgcccactcgcccgtccgctccggcgctcccgggaagaagagagagagtgagggcctgtttggcacagctccagctccagcttcaccccttctggagctggagctcagccaaacagtttcggctctaccaaaactgggagtggagctgggtggagctctctcacaaaatgaactagagttgtggagctgggtttaggcagctccacaactccactccagactcaactcctggagttaaatttaggagttggagctgtaccaaacaggccctgagagggaaagggaagaagagagagaagggagagggatgtggggcccacttgggccccaacatttctaattttctttttgtgtaactaacatgtgggcccacgatttttattattttttctgtgatagaattgccacgaaagcgccacatcaatgccacgcgtaacgaagaccgagtcaaattaaccacgtggacgccacgtcagccaaaactgctctctaaaccgccgagggaccttatctttaccagttttgatagatgagggacctactgtatctggttttctggctgaatgacgaaaatcggattcgttgacgagttaagggacctcagatgaacttattcctttccagacttcagatccagatccaagttccaacccaacagctggcctattttcccaaggccgtcaaagctcgtaagcccaaaaggccacaagtctacgaaactaggccttttaccccgatctgacattccatcccatttggcccatgttgtcccagcccacagctccacacgtatgcaggcatgaaccaaacatttctccgggtacgcctcggtctcccgctgacaaattgcactattgcagggcatatctcctcacttgttcatctccagctctcctggcacactccaagcacaaccttctttcccgttctgcatccttccatcctcgccacctgcgatgatgggctcgggccgttccttgatggcgcctcgcctccccgcctcctcctattcctcgctgctggcgccgacgtcgtggtcgacgccggccgcgcgttctccgccgggggccgcgtctacgagaggagtgcagcgagctggaggagctgagcgccagcgtgcactggacgcatgtaccaccgaggcgaacggcggccgacgtcgcgttccgcgtgtccgcgctggcgatgatgaccagaacggcaccaacgtttttttctgcacttctggtcaggttgcaggatgccgaattgccgatgcccattgacgatgctcagagcaagtttaataatataacccactactagctaattcatacaatagttgcttattatactattaatacatggtctcacttgtcatacacacattacattttagagttcgtgctgcagctgggctacagatatgtagtctgctgctcttctctctctttctttattattttaaaatatgtttatagctggtttatagccttctattttacctattttacctgctctcagaatggtgaccgtgtagccgacggaccaccagtacaagttccagtcgaagcgaaccttaacggtcgtctttggtggcatcagcagggcagaaacccgagacagagagacagaaacaccacgttttagcacgtaaacgcaataacgaagttgctgaattttgtgctctcagttctcacaggtagcatcactggactgtctcattcaccgagtagctatctcaaaagcatcgatattgtggagtactgaagagttgctagggggaaatgtcaatacgcgcgattcagagcacgactgtttccgaaggtcaggccgacccccccatccggcggctccgattagtggtgaaaacggtacgaaaatttttaagattttcggctgccgtttccaatgaccatttcagtcagtattggttaccgtccgtgttagaaatggcaacggtaatatcttccgaaaataggatgaaggtttttctgaccgttttatcgataaccgtatttgtatggtaattttcgtcaaaattctaaaagttccatagcgactcaaccaatcaaacatatcggaagcctatgaatgaaggaagcctagcaggtttgtagcacattagaaaggggaagtgaccaaaggaaaacgctgttaacgctagggcatggcatgtggacgttgctgaactttggtctactcaacttatcggtgttgagatattgttaaattttgtttatattgttgatcaaacttattattatatcattaattatcatataacggtgttatgtgaagtgtgatgatgcaagaatgaagttataaagtcatcttcgtacataattaaatgtgtattaggccacacttttctgattctgacatgaattttcgacttccgaccaatgtcggttgattccgtttcgacggtcccatttccgatatactgatatcgttactgtttttgaatcttcgaatctactgttccgattctgttttcgagaaaaaaatgaaaatgaaaatagtatatggtttttctgaccgctctcatccctgctccgattatgtaaccacagcattggcattttggcaggcgccatggagatagaaccaagcgatggaaacaccatcgtttacctcgccagtcgccagtatgacgcattgacgccgacggaacagagcgccccaagcccccccaacccacagcattcagaactccatggatgggtttgtccttgagattttcaccttgaccgtttgcttcaagaagagtggaaaaggctccaaccaaggtggctccatggatggcacgtcaccttctacttttcaatgtacgccgtgtttagcttcaaagtttttcttcaaacttccaacttttctatcacatccttctaattttaaccaaacttccaattttaatgtgaactaaacacagccgtattctaacaatcctgattattttttaaagtataatgatctgcatctgttattatgtgtatgtgcaatttcagtccagtttctcgtatgtttggtctattgtgatcaaacggatatggcttcctatgtagacaaggaacagtacctcaaagcaatcgaggcttgtttggatcaatgccaatacctatcctcacaaaaaacttacgcaggggcaatgtttggaagttaccaaaattttgataattgtctggactaagatccatacaaatcattggttgaaatagactggtagctgcgcttggcacaagagcaagtcttatggaaaaggtagatttcacccctaattttattcatgtagactattcatcaattaaaagatagcatatacaataaatcacacatatattaattgtagtgcactaaccctaatagttttattttatttgtttgatcaatcttctcttccttttttttcccttttttattataatttatgtgaaggttaccccttataggaggggtgactatttctctcttctcttctctccagctcatcatacgagtgtatgtggcatcttggagtaaatgtttagatgcccatagcacttgctctaggcccattcatagcgcctcctactcataagaggagccccggaaagccatgtaggctagggctacgggtctaaattttgagttctttacgatgcaagtggctctaggagtggctataattctatatttcagctccccaacatcttttgttttagttctcattttttttcaatttgtatggaggtccaaaatttacactaaacaccctaaaatctaaaaaaaattatattaaaacccctctctcccttatcctcacccccctccccggcatgcccacctccttcggttaccacgagcccatggcgccctcctctcctctcctcatgtcgcggcggtagtcaaggagattgggggcacgatggcggtcgaggaggctgaggcggcgacgaagccaccaagcggacgatgacaacaagctcaggggtgcgtgacccctcccgaccgacgatgaggagatggagcccctcagaaggcgacgacctcaacaacgacggcatgggagcttggccaccaccgtcatcacctcccctcttaggcatcaaggaggagcgggatccgacctagatagtgccacctggatctagcccagcgctaggtggcagcgtggcatgtgaggcagcgcagctcggtggacagtgtgtccggtgagcttcagccagcaacgcggattgaagtggagaggacggtggggaagaagaagaagagaaaggggtcgacgtggacaagctcaaactctctcctcgccgacggtgtcaagctcgaagtgaggccataggcagggcgatgccttccatagtggttgtagcttcgccctccgaacgacctcgctctgactcttctgacaaggttcatgcgttcttagcaagaacgatgagccttgcaggggcatcgtggagccacatcaaggatggggcgtggtaaggaaattgccacatccttacattgtgaatggcttaatcatatggagaggaaagtcacttgttttccgcactcacgttttccgaactactaaacggtatgtttttttataaaaaaaaactatataaaaggtgcttaaaataatattaattaaaatttcaaatttaaaataattaatactcaattaatcgtgtgctaatggtttagcgtgttttatgtattttcttaatcttatacaatcattctctctccaacacttcctatttagtccttttgggatatgctaacagaatctgtgttttttttcaagtacaattcctcttgtattcgtactaagggagcattcgttttggaagaattttaacacataggaatagggaaggtggaggaataggaatgtatgcacacttcgatccatagaaattttcttagaggtttgagtagatggaaaatttccacgaaaaattttcgttggttttcctatacatacatttctataaacctaatgacactaataggaatccaaatactttgattttcctcaaaaaacgaataggccctaaaacaagtaattcaaaacgtgggtaaaagaattatcaacagttcaaaatatacgaaaaatagttaggtggagcgccttgcacgtataggtagcagaaagtcataatgtaacctaaaagttatggtgacgtttccgtgatgaagaagccaggaagcagatttatagaagcagaaatcatgaactaatttttagagcaagtacatatatgccatgtccttaaggattaactacctaaaaagggtactccgtccacatgaggcccaaagctactttccaaaagacaacgaacagaaaggcacgaaccacatgccatgctatgaaaggctacattaaactaaaccaacaggcaacagcagaacagctatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48396 - DNA, 22852 bp, Oryza sativa
tttatattgtaatatgctacctctgttttttaatagatgacgctgttaactttttctcacatgtttgaccattcgtcttattcaaaaattttatgcaaatgtataagatataaatcacacttaaaggactatgagtgataaaacaattcataacaaaataaattataattacgtaaattttttgaataagacgaatggtcaaacatgtgagaaaaagtcaacggcgtcatctattaaaaatagagggagtatattgaggcgtaccaccgctgcattgcatttgcaaattattttgtatgcacatgcatgcgtcgtttagaaacggtacaaatttctggcctgctgatgacgctagtgaccgacctgtcagaggcagtaatacatgtgtagtatgcatgcatgcaatgcactgaatatattttaacttgcattttttcttttttttccctccctttggtgtgccatgcatatgatgtcagtgtcaccatctttcaaaaccgaaacagtctacggttgtgttggatcgaacctaaaaggcaaatccgtatgatttttaggtgcatgcactgattggcgtgtcagttctagctggcctgggcttctttctttagaagcatgggacggagtagctgttagccccatgcatgtaacaatgttgaattaatttcaaagcttgaaccagacgttcatgatttgcatttcggaatttaattcactcgttacatgcatatggagcagtttcacctatataaaagcactagataacatgctgtaattagctctcctgcagatacctcagtacctcaccaaggttttaaccacaaattgcagcatctttcttgccaaattgatctcttactacctttaaacgttttagattcatcactctcgatcagttcaaaatcaaagccattttcatctaattttttgtcacttagaaattggggggaatacaaggtttcaaatagaacttgaggcaattttcaactgaacacttgacagtttcaaatcaaaaccgagcgaaaatccaggggtaactgaagtgactcgtgcggtttaattagcaaagttggttggtttgcattgtatatgcatatagtttttttttttctctttcagcaagaaagaccaatttgtaggcgcatcactaactagtacaagtgtgtacttgtgtgcgtgctctaccaaacatagggaccaaatcataactcataatgttctccacgccactgacctaccattcacacacgagatcacgagtcccttaattgtttttgctggagggaattaacacaagaaggtgtcttggctaggtggagttcacgagtaccttaatagcaattcatagtagtacaaatattttgagtttagaaccaatgccattcaaaaaattacatgcacatatacttcaattttcaaatttacttccagaaagaaaaaaaatgttgaggaaaaaaattcatgttgacaagtagttttgaccacgaaaggtaaaattattcaactcacatggatttaagaatttcagataaaataaagcctccaacaattttccactgggcaattatctcctttcaccttgccttgcttgcaccctttaattcaagcagacacacgcctgacctaacatgtgtaactactgcccccacaagtatttacagagattttgatgtcatgaatttgacaaccacgaacagctttgaccacagctgctcatgagctcactccattcatgctacctgacgtccaaatatttttgacagaaaccgtctgaaacgtactactactactagtctgcagaattccatgaactaacacattatgcagaatatactcacgctgtgttgacttgctctgcatttttcatcatcatcaccaccatcattcgttccaagttcttgtgtatcgcgtccttattctgcatcagagctatccggccagccagccactcgatcgatctacatctgaatgacagaacgggatacagaatcactcacctctctctgtttctctcttatgcaggctagctctctgtttcaaggttgagtatttttgccgtatggtctacagtgtccagcagccacgctttgctttgcttttgtgtggccacaatgatgaagccattgcactttgctttagtttcagcgagcaccagatgctcgatccccttgctcctttatttttctttcctcaaccaaattcatcttactcttctctttctttaatccttctcctcaccttaagctttggtgattttgttctgtcctgctctaccctgtctttactcccttcgtatattctctttgccgagcagtgtttgaaacaaaagaacaagaggcacatacatccatacatgtacatgagccatttgtatgcgtggacctgatacggttcacatgcagggatgaggcaggctagcttttttgcaatgcaacaatctccatatacatcgatctcacctcgccagaaataattgcagtagtggttgagtccaaaataaataaaaaaagaacatcttgtctctgtgtctctgtgtgagccatggctggaatgaagaggagaggaggcagggccacgctggtggtgcagacaaaaggaaagccagcagctttcagctttctggaattttaagcagccgtaacaccacctgtttgtctatggggataggagcacaagaacaggaggcaccagacagctttgtccgctggtgcttattccctccgtttcaggttagaaaacgttttgattttgataaaagtcaaactatttcaaatttaactaaatttatacataaatatagtaatatttataataccaaattagttttattaaatcaataattgaatatattttcataataaatttgtgttgagttgaaaatattattatttttctctacaaacttgaaaaaaattgaagcattttaactttgaccaaaatcaaaacgtctcttataacctaaaacggagggaatattagcttcgcggtagcgatccaatggaaatgcctttcccattggaggccctgaaccaaagatgagaattttatgcaaaaaaaaaaaaagattgagatttttatttctggctcgatatatataatcgggcacatgtaatttacacggcatgggaatcaattaattaagctcgatcggggagggggagtaggaagtagctagctagagagtgttctagccagtttgattgctacctaagctaggctaatctacatcgtcttcgtcttcgtcgtcagctaatcatcgtgttctagcctctggttcgtatgatggtgatggtgccgcgtcccggggtgtgcagcctggtgaagccggcgacggccttgccggagagccccggcttgtccgccgacacgcgcggcgcgcacgcgaactcgccgacggggtggcgcaccggccgcgacggccgcatcaggatccgcgcgttgatgtccgccagcgtcgcgccgccgtccagcccgtccggcttcagcaccgcgaacgggcgcagcaccctgcacgccggcgccgccgccgccgccgccgacttctccggcgtcggcgtctccgcctcccttcgccgcttgctgctgctctgtctgcagtactccgcctccgccgccgcgtcctccgccggcgcggcgcgcttcagcgacgaggaggaggagcagcgaggtggggcccgcgcgacacctggcgcggccggagtggcctgcggctgggccccactaacctcactgacctgtgggtccgcctggcagttggaggatgagctgctgagtagtggctctgccacgcctttctctggcaatgtgggacccgtcgagaaaatcgagcccaggagatcatcgtcgtctgcaagcaaaagatgacaagacaccacttattaataatctactcctactcaagtatagtaaactaatcacctactactaatcacgtaaaggctcaacgttaacaagagcagtaacgaagaagattagcagaatctgggtagtgtctaaccacgtaaaacccagatctgtctttacttgaaaagaagcgccactgacagttcctaacaaggtcagacgcatcatgccatcaaatgcatcctctgctataatactatatactcataactcatcactattctatacactactataatctaatgatgcatcgatcatgcacaaatcatgggggtcgtgacaacaactacgtgctgctaatcttccccgcgggtcccatcgccattgacagaatcacaatttgatgacacaaaaaatattactatacgacttcgtgttctgtcctttggtggtgcgaggtcatggaggacctaaaaaacgcagaggattgctgctgctctgcgcgtgtcgtggcaaaagctggtggttttgtaggcgaaaaaaggcgtaaaagattttaatttcaaactcttcttctcaccgtagaagaagttggagttggagttggtggtggttgcagtggcagtggtgctgctcgtcttctcctgcaggatgcagctggaattgaaggcgacctgttgttgttgttgctgctggtcgctgcttgcgtcccagaaattctgcaggagaagcagattagcgtaggccctcacgaaaatctgcaagaaactgttgcctttgctcttgtctcgtgcgagattactaccaggagaaggtcgtcgagctcctccggcaatgccaccgcgtcctgctgcggcggcgccggcggcgactccatgtctgcactccaagccggtgcacggattaattcaccaattcgaaggcttgaacataggtaaagaaagcgagcagggcacgtacagagtgggaagaggccgtggacgtcggcggcgaggacgccgaggcagccggcggcgaacggcggctcccaaccgagcaggaagcaatcgccgccgccgccgccgctggcgccgctgctgctgccgctgctggtggtggcgtcccagctgctgcttctcgctgcctccatcgcgtggaaaggccaggacactccctgcagctgcagcagctgcagctccctttcttgggctgctgcctccatggcgttgcagtgcagcagagcagagtgagttgccgagtaggatgagtgaggagtcgagtggagtgaggagagacgagacgagacgatagagtgggcgaggcctgctgcttaaataggagggcttttcgaagagtcctcaaaagcgaaagcgcccgagctgcaggcccgcgtgtcaagtccacccctacaccctagtttatacttgttcctatttggaaaccgacttttcttcttctaaattccaattgggataaaacctttttactatgattattgaacggaaaaaagtataaattaccccctaactattgtgatagtatgaatcccccctccccgcgaaccacaaaacagacatattaaacctcaatctattgaaaccggataaattacccccctcacttaatctggagcggttttgatcctacgtgacatacatgtggcactaacgtgaaaattcaatcagcaaaaaataaaaataaagaaaatatagggcccacaagtcatatttctatctgtgtgtgctgttggcgttggaacttgaacgcgagcggctacacgcgcggctttggtctgcggtgggcgtggcaaggattggaactggtcggtggcgagcggcgacgggcacagctgggcgaggggtggcgggagtggcagggagggggaatcgctcgtcggcgagcggagagcggcgacgggcgcggctgggcgagcggtggcgggagcggcagggagggggaatcgctcgtcggcgagcggagagctacgacgggcgcagctgggcgagcggtggcgggagcggcagggagggggaatcggttgtcgagcgagcgatggcgctcatcggctcgtgcggctcttggacggtgcgacgcgattgcgcgagattttggcaccggccgccgccttagccaccgcccgttgcgccgcctagccgctgcccgcccgcgcgcagataagtcgccgtcggcttgctacccgccgcccaccgcgcgcccggtcggccacgcctccgtcgccgattgcagcagtcctcggtctccctccaccacccccaactggctcccacccccggtcaccgccgccctcagctcgcctccggtggtggagatggaggtgaggggagggagaagagagagagttgggaaagagagagagagatagagatggtgaaaaaactaccatgtggggcccgtcttttaaaaaaaatgttgactggactgccacgtagaatcaaaaccaccggcgattgagccaagggggttatttatccggtttgtatatttggggtgaaaaatgtatgatttttagatttagaggtgtaattcgatctgaaaaactgtactctgtgcaataccacaactatggttgacctgtatttttgtgtgattgtagaggctcgatgagttcccattaaaataaaacaatgcaagtaaaccatttctattatcaaagagaatgtgataccagtggatccaagagtttctttagcattggtatttctaacaagggatgccgcgattattccactgctattctaaattttaacaaagcaattggtatctgttttgcacatcgatttcgttaaaaaaaaaagttgcacaccgaatagcctaggcagccacccgacatttggagaaaactgtgattatgccatcacataaaattggactacctaaaaactactccctccatctactttttgatagtaatatcttatcttgacacaatgaccaaagataagtaattttacttatcatccatttaagcatgctactagttatttctcgtaaacaagcgattcattaatatttacatttctcgatgctcatgtagccaatcttgtgtggaagaatagagagtcacgcattaaatccgagaaagtcattaagaggatagatggttggattgaaatatgtctatcaaaagtaattttttcagatttagaaatatgcctatcaaaagtagatggagggagtatcattcaaatgggcttcgttaaaataccacacaactaggatggcttcgtcgaaatatcatctgggacaatattgcccctagcacttctcctccaagtgttggaggagctcaccggcggaatgtgagcatgtggaagaccgagacgaggcatgtggcagagaaggtggcgttgccgatgaggcagcggatgtgcagggtcagggccttgtgctgatacgcgaagtagaacccgttaaggggtcggttttaactcggggacttgcgacttgtgagctcctcgacttgcaaaatcatctcggatggcattctgacgaagccatcctggttcagagcgacattttaacgaatcctatttaactgatggtatttcaacaaaattagtttttctttatcggatctgaagttaccatttttttttaaaaaagaagaaatctgccgttggttttatcatggctacttgtgcaattgtgtatgtgcgatatgtgcgtctttctgcgtttgatatggggcgacttgctggggtgtgaggtcagtgagcttaagataagagtggaaaccgaaaagagttacaggcgagcagatgccgagagtacaaagtccaaatgaagcaacgaaagcaaaagatagaggtggttggttggttacggccgctttctcgtgattcgttatgttcgtcttctcctgctttgctttctcttgctcctccttccttgatctcctttcttttatgcttcttctacttcaacctctgctttcttttctccctccctctctctctctctctctcttttgataggatcctcgtccccttttgtttttcgtgccgatacgatcgatttgttgcttgttcttcatgggaatcgctgtttgtagtacgtaagtactgcaggttgtagtgaacttatactactactagtagtgatcataattcgaaaattgtcggcagctaggtctatgggattaggggcttttgtttttttgtttagtcaactttaacacttttagttcactcctgtcacgtggtttggatcgttttcgtttggactttttggctcaaggtctggattgatttatgttactgctctgtatatgagatgtggcaaattgaggagaggttttggttctatccgagttggtgttttgtgatgcctgctgttgcaagtaggtcaaagctactagctgttgcttggtgaggtcactagctgaaactgctgtagtgtatggctagcttggtcctgggactggatgtgccagtatgcataataagtccagaatacctgcaacccccccaaaaaaaaaagatgataacggtttttcatttggctagctgcttgaggagttcagtgttttttttttagttcatcccttttatgattaactaggacctatactcgcctacctgtgtcatatgtccatcacaagtcacaaagattggtgctttagggatttacagtttgacaaggagtaaagatgttttaatgggatattacaatttctaaaaatttcctctcttttctttttccacatctacacatgctgcgaaactgtggcatgaacttgtcaaagaaaaaaacattgggagtacttatagaccactagccagcagcatattgacttaaacaacactctgcaaatattttactaagcaccatgaggaatgtgcttcatcagtgccaccccataacatactcacctcagttgagtactccacaattatcttttttttttttttttacttttaccaccagctgactctgttaaaaaaaaacatttttgcagtacatacttcaaaccaaaaacctgaggtcaatcattcacactaaactgctagtacataaatttggttccaacactattttacccactaccccacagaagctcctcctttttccaaagggccccaagtgttactattaggagctaggggtttggtgtgcaattgaacaatgttaattgtacacttgatcaccgttacttttttcagggtggtgggcagaattattgcaccccatcatgtgactaaggcgagacaaatccaagcagaaaagggctccacataatagaaccaaaggcaagtgtcactccaaattttgggagcccctgaaatagaagagaagaaacccaatcaaaagcagaagagttactaatgtcttaccggccccggagtcgtcgggtcaacgaagaagaggcaaagattctccgtcataatgcgtgctggctgatggcgcgcaaccgtgcatgcgtgtatgtgtgggcttgctctgtttctgaagattctgaatatttgtggtgttttgctttgctcactgtaacatttttatttttgttagcttctgggactcttactggaaaatggaatgagccaaacagttgcaatgtttatgatgtttacctttcacagttctgatgtttggatttgtaaggttttgtagtaggcaggattcatgtttacaacgaaagccagcctagaaccgtgaaatttcgaggtctcgacgcagaaggataatatggctgtgtttattcacactaaaattggaggtttggttgaaatttgaacgatgtgaaggaaaaattaaaagtttgtgtgtgcaggaaagttctgatgtgatggaaaagttggaagtttgaagaaaaacttctgaactaaacacggtgtatattctaaccggaatttcgaatggtcttcaagaatttaaatttgaaacagtaaatttgctcgaaatgaaatccgacaaactttgattgaaattgtcaaaaacagtcatgtacacaccttcaggggtcaatcggaaaggtgaaccttggtggtagctagtaaaatgtggtagaaaaactcttggaatcaagtgaattttgaatagggggaaaaagtgtcaacgtctagctcaggaactatctgtagcggttggtggtgtcaatgtccggattgcagttgtctcggcctcaaaatgttctggaacgagacactacgctaacgtcctcggttaggaagaggagaatggtccactgtactggttcttggatcagtctgctaccacctgcactgcatctaccatctcccagcagcaaatcaagggagcagctacagtatctttttttaatttttaatctcttccatcttctccttttgaaaaaggagctacagcgagagcaatgttgcaaacattgaaaaagatgcacgaattgcaggcagtatctcttctcctttctcgctttaccgtcacttttggagcctgattttccatcaatcacgccatctagggcttccttgctgctattgcatctgtcggtgtttttcctcgctagacatttcttaccatatggttgcttatttacagtttccagtaaaagacagagttagtcggtaaacaaattttaaatttcaaaacttaattttagaattaattttgatttttttactatagattgttttttagcacttgcttttatgtcactaacaatacatataaaagttttatgcataaagtattttttgactgctagtaacaaacgttatggtttataattagtacctatgaatattttaagtagaacatgagaactgtgatgggatgatggcgctgcagtgctgcacaagttaattatgcagattaatcaaccagtttttttaaacaagattaattaaccaggtctggctgtccatctacactcttgtttgattcttaactaacattgtcaatttgtcataactcataattcactttaaacgaatgtggcttgccacactttttgtcctataaattataagcaacacttatagcaaagttagacaaagaatttaattgatgacatgtgaggtaaagtgttaagaaagtgtgacttaccacaactatgacaataaatcaaatataaaactaagaaggacgtgttagtctaaaatgtgatgcgataaggtgaagcgttgaaccaaaccccctaaagctgttgcatgcctacaaaagcctagggtggtaaaaaaaattacctggtgcaacaacgattagacggcaaagggacaatctctaaggctagattagcagttactgtatcctagaacaactgatgggatgtaaattgtcctcatgacacaaaacagaagaccactttttgcacaccactattttagtttgaatcacccaaccaaaaagcactgctgctgctgaggaacggacaagcaaacaaggtgagtgagtaccactcaaggaaaggaaggcacatccacaaaatgtaccgtcgagtaaattctggaattgacgaggtaaaacctcagcatttccactgtacaaaatttcagcacttccacgttgagttcgtcttggaagctatatttgtacgcactgaactgaacttgaagatcaaatatgagagatacagacttcaaatttgtgaaagttgacgcgattccttcttcagtttttagaagatgcaacatgcgaaccatgtcagtacgacgtgctgaatttttctatacgtataatgtatacagtttacataacgcagtaacacaatttcctgatcttacacttctaaccgtctgattcctagttccaatcgatcaacatcgtaaggcaacagacaacactagtgattcaatcgatcaacagctcatcagaccttgtacagcatgccgatctcaactcgctgttgcagaggcatcccaagaaccggcagagccgaccggcagatcccatgcaagaactcatagaatccgagcatgatcttatcaaaccagccggcgtcctcgccgacgtagaacctcatcttgccccggacgtgcaccacgccggccaacctcgccgcctccagctgcgccatctcttcctccggtgaccggcggccatcagtgtccatctggatgtgccattgcaggcagctcgtgacctgcgcggcgaggtcgtcgccgccctcgaggctgaggttgtcggcgtagccgtactgaacggtgcagccgtacaccccgtttggtccaagcctgtttatcaggatccttttgctttgatcaactttggcgacgagcagggacctcagggtgacaaaaattgtgaccgtgtgcagtgagctcatgttcttgatgtaatggctgaggattggagttagcccgtcctgtatgttgctgtagaagaagcagaggccagggaccctctgaacctcaggccttgccaagagctcgccgaggtgctccaagctcactttgtttgtcatctcgtactcaaatttcctttgccgaccgtagtaccagccgaacatgatcattgcaagggttatggaaaccgcgaaaggaagccaacctccttcagggatcttggtgaaaactgcactgacataggccccttccatgatgaagaaggggacgaagtacagcccagcaagcacaagtggtgttctccatatgatgatcatcacaagggtgagtaggactgtagttatgagcatgaccatgatgaccacaacacctgcaaaaataatgtacattgaggtactgaatcttcttatacaaaataattttgtattgacaagtcgagaattttgtagaacttgcttaccgaaagcattccctatagccttgccaccaccaaatcctagtataacaccgacacacagtaccatgagaatgtaattgatttctggggagtaaacctcgccttctttgtgttgcgacgtgtgcaccactttaacacgagggaagtaatccaggacaactgattgcttgatgacagagaatgtcgcggatattaaggattggctcgcaacaattgctgctagtgttgcaacgacaaacattggccagtaaacgggacgaggaacaaatttatagaaaccatcaccaaagtcattgacattgtttataaggtatgctgtttgcccagcataagtgagcaccaaagaaggatatatgctagacagaaatgctatctgaaaaaaaaaagatcaactgtaagaaattatatcgtgtataaattgcagatggacgtctcaatgaaactaacctgaatagcctttttgctgaagtgcccaagatctgcgaacatagcttcagcacctgtgtatgtgcaggaggttgaactttacacctatcatcattggtaggagaaaagaaaatactcaaagttgataatgctggtatggaatgtacctgtgatgcataaaacagtcccaccaagcagttgccaaccttgccttttatttctcaggaagaaatgaacaatataatacggtgaaatggctttgaagatgccaggatagtaatgtacaatactgtataagccgataattggagtggtgaaagtccatgctgccatgattggagaaaacagaaagctcacttttgaagtcccatacttttgcaataagaataagccaatgagaattgctgcagaaagggcctccacaacagctggaagaaacaaaaaagaaaagaaaggatgaatgtcaaaaggttagtattagaaagatttttcattgttcattagctacaatgttcctgaggccttacgtttgctaacagtaggaaatggccctcttatcccatcaattgctgatagtactgtaaaggggtaaagaaatactgtcaggtctcactatgatcacaagaatggttagattggcatgtaatttataaatagcaaacctgaaatagcaggagtaagtatgccatctccaatgagcatgcacatcccaagtactgctacgaataacaaaactcttcttgcagttatgctctgttcaaagaactttcccagcctactaggccttctggctattgcagactgactgtgaagcagtggatcttcttctgcatacacccttttggaaggaaggatgcctatatcagcatgcctacacaacaaagaatacatggcaaatgtaccacctgcagaaagtatacttttaagcaacaatacatatcgatacattgcaaaaaagaatttcagacctatccataaaataaagattgccttccaaagaaaatacagtatgttccatctctatcagacttacaattcagcttatcaagtgctgtctgaagaaagaaaaatctagagatattttcccagtaaggcagtaataaaactaaatgaatgttaaaagattgatgcatgctgcctccatacgggaataatgagtactattgagaaacaccctatgtctgataaaaaaacacaccctatgcacactatagatcgaagaggcatgcatagccccaaacatacatatctttcatcaacatatcttctttttttttgtaatgaatcatccttttttttatgaatatttttcttgtccaaatgctattgcttaattcaacaattatctggaaaggtagccactcaaaaatgaagaatagagagaggaaaggtagcagtagaattggttagttaccttcaccatgatcatcagcattgagagctatgcatacatacttgaccacaccaattaaagtaagagtccaaaacattatgctgtatatccccaggtagtcagcttctgtgggagatgacaagttcatagagggataaacgtagaggggagaagtgacgaggccaccaaaaacaacaccaagagtcttgtaagcaaggaatagatccttccaaacattgctatcctgctcagagttgagagaaaacattaatataaactgtaaaacacaaagatgatacttcaagtttctatttggaacacaacgaagaagagcgatgaaccacatttatcatataaatgcaactgatcagacctactcatagcaagtcaatgcagtcaagcaaaacacaaattacataataaaatttaagatttattatgctgatgggtactgtgggactggtcccgttgaccacgtggtaatgcatacaggtcttcttggttcacatctgattacattggatacttgtagggatgtggaaacagagcctgatgatgcaagcattcgtgacatcatcatcaggggggggggggggggtgagcatcccttctgatacttatatggtcagatatcttaaaacattaaataatcagcagcagaatgatcagatacatccaaattcaaaggaaggggacaatctggttacttaatcacctgaagatctttttaaaaacttcacttaaaatgcaaaataatattctaatcaagcttgcatgcagctccttcatatccactgcagctaccgtgtttcattcacaataacacttttcagtttttggatagctatgcaaaaggatgcagctaactgaacaaacaatactattaatacattcaccatgttctgcattgaagatagggggagggggtgagtgaatgtgaaattatcatccacaaaaaaaaaggatacaagaaaaaggaaaatattcccctattccacaccaagacaaaatatattagtcatttttccaaagaaacaaacaacacatgcctcgcgttatatctatctgtttggactattctgaagtaccactaccacatatccagtattcgaaaataaacgaaacaaaatcagtattaatttctcagttgtcaccaaagccggccagaaaaggctgggaaaagaagagcacgagcttagagaaaaatgagacacgaagctatcatcagtcgtttgcagcagcagcagccaaagtcagaatttccaacaccctcggctctacagcatggggcgacaagtcgaacgcaacgatgtcatacaaaataaaatctacaccatctctagttctctacatgagcacatgtctgcatcacattgaccaactaaaccataaacatgcttgatcattcgtacagtaatattgtaataagatgcatgttcttccatgcaaatatcttattctcttgtcagaaactcgcaataaacagcacgagtgttctgttcaggccttaaacctgcagacaatggagcgagttccatggcaagaaagcgcacaggaatcacgagacgtattgggtgaaccgcaacaaattaccatatatgattagaagaacttaagaactcgataaaagaacattgctgcacatgaaagagaaaagggtgggggttttccccacggggacactcacatcggtctccctgccggccgccggaccgccgccttcgccgtcgctgcggggtcggattgaccccgcctcgagatccatgtgggccgcctccccccgcgcttgtcacggggcctggagcacgcaggaagccgcactgaggaggagcgaggaacaacaaggttggagaggggggaggctacgccacgcggcggcgcgcgacgcggccgagaagcgaggcgagtgggcgtggcgtggcgtgcgtgcggccgcccgagagaggccgagaccgtgtggcaggcagctagggcgttgcgttgcgggcggaggttggcctggccggccttcgtgtgaccccccgcggtagaagacgtcgtcgccgactcgccgccgccgccgccgccggtagcccaggcgctcgcgtcgcggtgctcgagtgtcagggcggtgcgcgtgcggcgcctctcgttcgttccgagcttatgtgagcgggccgtacagaccagccggaccggaacgaggctctggctcgtgcggatatgacaatcgggcccgctacaaaagtaagtcgttagtataccgatccgtttcatattattgtcccgatccgtatcctgtaactatcgagtcaaaacgataccaatcccgctaccctaatttttataggccctgtttagttctaaagttttttttaaacttttaactttccatcacattaaacatttcatacacacacaacttttctattacctcgtaccaattttaaccaaacttttactaaacacagccatagtatctcgatcccactgtgtcttcattaccgcatgattctacaaaccgtacagaccagccggaccggaacgagactctggttcacgtcagtatgtcacgttcggcttatgtttagttgggcctgaacgggcccgcggctcacatgcggcctgtatttaggaaggctggaacagggctgcgattcacgtgggccggaatgggggcccgcgttgttggacgagggcacgaggctttacgtgttttccaatggaataagttcatcctaggtcccttagcttctcaacaaatccgtcgtcctttaacaggaaaactagatacaaaactggtgcaatataggtctcatggcgatttggacggctgttttagctaacatggtgcctatatggctaatttaactctgtcttcatctgacgcggcgcttacatggctattcaatatggaaaaataataaaacccatagtacccatgtgtcagtttcgtacacataataataataaatgttgggactcacatggccccacctgtcattctcaatcccctcctcttgtttctcctctctctctctccactcccctctcttcatctctctcccctctgcatcctcatctcgcggagatgaggatggagtggcggcggcggcagccggggggaggggatgaggaggcggccgctcagcgcggcttccccttatttctcagcggcgtgcgggcggacggtgcttggggcagacggagctcggtgcgggggaggcggccactcggcgcggcttactccccttcctctcggcgcgtgcgggcggacggagctcggcacggtttcccccctccatctcggtggcgtgcgcgtagggaggactagggcagcagcttctcccacctgcaccgccggccagctcctccgcggctgctgcctcccgcccacccagatcccgcgccgacgatggacgcctgccgccggctacagggacctctcatccgtccttgaccgccgccggctacagggacctctcctccgtccttgaccgccgccgtgacctcgatcccaccaaatcctcctccatcgagagaagagagatgaagagtgagagagaaaagagagtatgagtatataacaggtgggtcctacatttttaataaatagaatgatgaatggactgccacgcgtatgccacgtagaccaaaaccaccgcggattgagtcgaggaggataattcatcctgtttgtatagttggagataaagaatgtccgattttatagttcaggggacaattcggttgaccgcgatagttcaggagataattcatactttttccaacttaaaaacaacgaggtagggacatcaagcgaactttttctatttcccaattcgactatattttgcaagaggtggtttctcctccggaaaaagtacacccaaggtccctcaacttgtcatcgagatacagtatcatcctcaaaccgcaaaaccagatatcccgcgtcccttaactaatcaaaaccggacacaaaaggtccctcggtggtttttatcccggttttatcccacgtgtctgttgaatcagcatgagacccacgtgggccccacatgtcagggtaatccacgtcatcaccctccctctttctcctcttctcttcttctgggtgaggcaaagcggcgggtgcagaggggccgaagccagcaggcgaggcaggagagaggagggcgcggctgcgcgacggtggccggtgcccggcggcggcggctgcagcggaaacacagcgacgcggcggccccgacggctatgtcatcaactgcgtgccgacgcacctgcagccggcgttcgaccacccgaagctgcgaggacagaagcccgaggtgaccgagcagtcggcggtgcggcggcggcggcggcggcggcggcggagcaggaggaggaggccgtgttcccacaggcatggacggacagcggcgagttgtgcactcgtgcccggagaggacggtcccggtgcggcggacgacgaggcgcgacgtgctgaggtcaagctccgccatccggttcgggatgaagcagccatgcgccgccggcatcgtccgccgcgactccaccagcgacggccacgaggtcagtcagtcaactcgccggtctgaataagttactacatgctgaaatgatcgagtaggagtatagtatacgttgtgctgcacagctggtgcagtagcaatgggcaatggcaacaatggcgatggcgagttggcaacgaactgaattaagagtgtaattaattagctgagattattcatgagctgatgaaaacgatgatgcagcatgcgatggggtacgtgatgggggatcagttctacggggtgaaggcgagcctgaacgtgtggtcggcgagggtggcgacagcggcgtagttcagtctctggctccttcggcaacgacctcaacacagacgtgggcgacgacgagtttcacggcgatgagctgactcgggaagctggggcagggcggctagggggaaacccgcgggcgtcggcggctttggcggcgctggcgaggtggcctccgaccgtgtctgtcgccgccctcctctcgccggccgaagcctgccggcctctgcacctgcagccgcccgccgaagactgcgtgccgacgcacctgcagccggccgccgtcgcgctgccgccctcctctcgcccgcctcacctgccggcctctgcaccgccgctttgcctcgcccataaagagacaagaggagaaagagggaaggtgatgatgtggatcacgctgacatgtggggctcacgtgggtcccatactgactcagccaccacgtaggacaaaaccggtgataaaacctattatgactggttttgtatagttaatggaccccgtatatctggttttgcggtttcgaggacgtgacaagttgagggaccttcggtgtaccttttcctttctcctcctcgagaatccccaaatctcgctcgctattcacgcgaccacgcaaaccgaccttcctccgtcgctcggccagcggccggcgccggcgcgcggggtccacctgaggcggccatccccttcccaggctctcaagccaggaatccgctcgccgtgcgacttaggcggagttacgagagggcgctccctgccgtcgcgaaccaccatcgccggcgcgggcggcgccgaagggggccgcggccaagacggcggccggtgagttctctaatagcagataaagtttatctgcaccgttctagttcataagtttttgttaatttcatgtttgcctcagcaagattcagtttttctcccttggtaacagttgctagctttttctgtattgtcctagttcctctgcagctttacttgaccgaaagagataaagataaaaggtttattttgtgaattgtgaagaaaccgccgctgcctggcaactccgaacaggatttagaatcgggttgaggaattactagtcccaatcggatcgaagttcggatgcctagctcgatttgcatggccaatacttcctttataagtggggaaaagctctcccctcggtgaccagactatatatatatatatttaataactcctttttaagtgcaaagtcataacctatctcctcgtcatcttctgcagatcagcttgagagattgttgtcatggcagcgaaacaatctggtgactactcggccgcgaaaggtgatgcgcattgttatcaactcttggtcgaggttcatgccccattacatccctgatgatgtgatgttcaacatcctgtcatggctgccatccaagtctctcatccgatttaagtctgtgtgcaaggcttggcatgccatgatatccagcccgtgtttcactgatgctcaccttgagtgttccaagagaaacccatcgatactcatggtccctggtgcttatgagaagcaggaggacggtgagaatatcgccttcatgatggtcctctataagtaccatggaggtaaaacaatggaactggtccatatgcagaactttccgctaggcattggtgtatggactcgccctgtgcactgtaatggtttactcctcattcccaccatgaacctcgaaatgatgatctgtaacccttcaacaagacagattgttttcctaccaaaagtcagtggcaacatttgcacaggcacaagggctggatttgggtttgatcctcacagcaacaaatacaaggtggctagatctttctatcaaagggatagtgaaacacaagaattagtctgcaagtttgaagtgcttactctgggcactaatgcatggaggcaaactgaagatccaccatatccaattgatgctttaactccagtccatgtgaaaggcgccatctactggatagtgtgtagttcactttgcccagatccacctaatgcattcctccgattctgtttgactgatgagaagttcagtttgtttccgtgtcctccatccaatgtaaagtctgtccgtttcacagaggtggagggtgaactgtgttgtgcttgctttttcagtgagacgctagcgctggagatttggaactgcagtggtgggcagaaccttgaatggactcgacgctatgttatacagattccacctgatgttgttatgaagtaccctgtagaaagaccccctttaattgtttttcgtgaaaaaatgttgctgctggcattcaaaaaggtctacaggtatgatatcgaaacctgtagaatagtagaattagcttcaaaggtttcagacttcacctgctatgaaccatatttggagaaggaagcaagggatttgcatctatttaattatgctgagagtctagttccaattagagaattttgagaagttacttctgtctgttagtgtgagcttctccacaacttgtaatgatccaaggtagggagaagtttgttttttttggttgcaagtgtcagccaaggttcattttcattgaattcatctgtgctactattttactgtaacaatcaatttttctttctagcggtattgaccatgaaacgcaataagtatcatgtgaattgtcctcagttatgttgctcagaataactcctatgcattttgccacttacatatgtgatatgttcttttcttgttttaattaacattttatattagcaaatatattcttactaatgccatattttcattgttgtttattaatatgttctatcatctgaggagatcatcaaaaaataatctggtccatctgaaactagtactcccaacagagctagtgctttttaagagggagaagaaagcgggctacagatatgtgattcagcgctgcaagtgaatgatcccaatctttgctcttgcaccattgctcaaacttgtgccatgttttttttatcaaggagtttcaatcggtcagtcacttgtgattctttttacagattacatttgttgcacttgctgaagattaaggtatctgttgttgcttgctggttctcgtgctattgttctctactgtttttgctgaattcttcagctggtgctgctgttgatgtgctgttgtcgaggccacgatcaggagttcgtgaccgtgatttcgcagagggagagacggaaataaaattcagttggtggtttcgtagagggcccacttttaattttagaaagtcaattttagacaatctcctggagggatcaatattttagcacatcaaattttgtttagcattcccataaaaatagttttgggaatgaaatattgggatactcttggtgatcttggtgatgctctaattcccacggcagccagcctaaacgtcgccgtgcagtgtgcggacgcggcctgtgccacctccgtaccatgcgtatccaattctcggtttattcgggaaaaccgaacaagaaagctgaacactttcatatactatggatgtgtttagttctttggtgtaaagtttttaagtatacggacacatatttttgggtgtaaagtttttgaagtatacggacacacatttgaagtattaaatataaactaataataaaataaattacag

SEQ ID NO: 48397 - DNA, 8424 bp, Oryza sativa
tggttttttcccatatttaatgtcccatatatgtgtctaaacatttgatatgatgtttttgaccaaaattttttgagatctaaacaaggcctataactattggccgtgtacatccatcttgctgtagtggtcgggttttatataaatcttttatctataaaaaaaatgatactcattgctagcacatgtatttaaagagttctacacaacaatggatgtagaacatattgtgataattagttgaccacgcaatgaatcttttgccagaagcaaatcagaatattaagatgatatgggtctcgtgactcatttctcaaagctgttccatggaaactgaattgaaaattacacatcaacctatatgaacatcattaaagatcgctttctttgttaactttaccaacatctgaaagccattttttcaatatccaattgatttgaagccatttctagatagagattagaggaacgctcggcagagtccagcggaactcatgatacaaaaatcaagaagccaccaagtcgtttgttttcatagttcatgcatcatagcacagctatctggattcgagtcccagaaagtaaaccggtgtggatgtatggctaccaggaactccacagtgactggtcgatgataagcaggtactccatccgtcctaaaatataagcatttttaaatctcgccacaatcttcgagatgttactttgactaacaatatctataaaaataaaatattttaaataaaaagagttgtatattataatagtttgattaatgataaatctagtaacatcaattttacatgattgatcttttttattttattgctattaacaggcaaagttaaaaatagttgacttgacactatgctaaaaatgtttatattttgggacggagggagtacaaaatacaaatccacgcagtgaacggagctaatagctgaaccatcgaggctcaaactgtcaaacacaggtaccaaaacaaagcattggtgcaaactcagcatagtagtactttgccagatgaaaaatctgataacaagacatagttttataaacacaatcgtaagttacaacaatacaaagagtgcactctaaaccatagcaaggaacaatccttcttaagcatctaaagctagcatagtgtctattttctagtttttttaatagataatggataaaagccagcctttgcttctattttctagttgcttgccaaccaaaatgtaacaacaatctaaagacatcatgttcacctccttgatagaggaaggtgagacacaccagacaccttgacaactttgaattggacaccaagaatatctcccacagcatgacccttgcgaccaaatccagcaatctaataccttgtcctggataatgacaaaataaataagggatggagcaggcatttaagaaaatacaggatgaaaaatgtacattatcctcgatgaagttgaggcaacaatcattggacacaaaggcaacaatcttctccacactcatggatggcagaattagtccacttagcttcaataccactgcaacagatccatcaaaatctcattagattaagctcacagaggtattgaagtggtattgaaggggtgattcattgaataatataaataataattgtttgtatgctaccaagcataacctcccagatcaaaatattttgattacacagcaacaacagattggtatcagtgataattgaactcatgcaaaacgtactcattaatgtggtgaaaaggatgcagaaaatacacaattgaaaacatggaacacaatttcattactgccacaaaagagagtaagttgattatgaactgctatagtgaaccaggatagaataaatgatcaataactacagggagcagagtatggtaatcaagcaacagtagtccaattatggtatgttttcactcacaagcgggtgtagtaagcttttcagtgtgaagaagcagatttcacagagcttcattgtcaaggaccatgcaccatcagcattctcaacgagctgatgaatagattgtgtggcattgtagggtccaccacaacgtcagaaaccttcggtgagggaaaaactaagtgtcaacatcactatctgggtactccttcctgagtacggtgccaataccagaatggcagaatcatttcatcctcccagatgaaatgaaatcctttggtaaataaaatacatacattgcacactgtttgtatccagttgttagtcaacccaggaattagaacaggaaaaaaagattatgcacacagctcttttcaaaattttaagggtagccgatacatatatactaccaaacagaacacatcaggttgaatcgtgccactttgcttgacacgaagtgaaccacttaaccactgatgtgacaacaatttactcaacagttatatatcagtacacaacatatttttttttctaatgtatcctagcaaatactatcaaagggttgcagtagaacaaacgataagttgacttcaaagccaaacttgaattacaccaattaaccaacaagtttccatatccatagaacagtagtaccattccagctctagctagcattattaagtgtaaccaacaaccaacaaagacctccaagtaaggcagcgcaaagtatatcaaagtagagctccacatttgctggtaagcaagacaacaagccaatcatatcagcaagcaaactcagaaatgacaaactaaatgcacattttccatcggcagttgtaacccggcataaaatagcaggtcaaacatcatctcacacaatgaacgctaacgctaaaccaaagataaaaatagggtgtggaacaaaaagatctacatgtttaggaggacacgctatctcctacaggtaaaaaatgcccagatctacgagtaaagaaccctacaattgcaccaaagacccaaattctcaccattcccaagaagatgggagcataccttggaggcaatcgcagttttcgacctccttgcggacgacgtgcatggaatcgatgagctcggcgccctcgttgtagacgtgtagtgctcagacagcccagttgattccacccgcaacagattggtggaagacgaagttgtcggggttgaaccgtggaagccggaagatctggctgtaggccgcccagccgccgatcaatgacaccgtcgagaaatcgtagaacctactgaggttcctagtcgctgcgcagcggcggctgctgaggtcaagcgcgctgacgaaacggaagaagtcggagacgcccgtctccgccacggaatcggcgatgagctcctggaactcctgcctcgtttctgaccccggctcgatgacgtcttcaatcaaagacgttggacatcaggttcatcacggagccgaaaacggcgagcctgacgcggactgggcgcccagagagcgcaccgatcgaggtggtcgacgagctcctagatgccgcggctagcgccgagccgccggcaagtaaagagcagtctgcttgtcaaggtgcgccatgtgcatcactgcttccacagcaggctagagatcggcagccacgccattgagatggtcttggtggcggaggacgtcggcttttgtccgccacccaccgggaggagatttcgccgtccttcttctggaacgcctcgttccttcgtgccccgcatccggagacaacaggtcgtcgtgccgagccgcagcgacatgatggtttccgagcctcaacaacttggccccgatctggttcttgcattggcctctcccggccatggatgtgcaggatctcccttgcatttgctcattcaggttgcgtgccctgggccaggatgcgcagcggcgaagggagatctcaaccggaggaggaggagggggggtgtggaagcgccggggttcatggggattggggaggccaggtggaaggaagattccggataaggggaagtggacgaaggtggggacggcgacgacacatggagtactactacagtactatgttactactactctactagtactaccaatcaccgtgtacaagaatgtgcacatgttgaactgtagtaaagtacttcatttggtactgatactgtacgtgtcaacgagttgagacccgctcggatgaacgcggtacacggttatgtgcaggcccgaacaaattcactacacgttagaacctgattatttttaacccgatcgggccagcagcaggttaaaatctcccagggcagactggtttcttcgaccgcacgacaccgccacgtcgacaaccacctcagcatctgtgggggcaggctttcttcccccacacggcacagccacgtggacaggagaacggaaatccatttaaatcccacagatccccacgcagacgcacgcctcgctatccctcgccgtagtcctcgccgtcgccgccgctccgaaaccctccccaccgcttccgctccgcccccatccgacaaatcatccaaaattcctcctccaactctaagcctcgggacgcatcgaccgctacagcgctatcggagccccggatggcgccgccccctccttctccgccgcccccgtctccccccccggcgccggcgccgccatcttcacggtgggacacgccggtgccgcagtgggtgatactgtggagggtcccacgagtatatccggccgacgtgccctccaagggatcggagttctccctcgctctcgcggctccgccacggatcagctccctctccctcgcggcgccacctcatctatccagtgcctacctcacggcggcgccaccgcagatctccgcccatggacgcttcctctccggcgacctcggcccgttcgcccccttcgtcctagcggcggacgcttctggggtcatcctcgtgcacgcctactccgcccgtgtcctgttcgaccacagcggcagcggcagcaacagcggcagcggcagcggcagcgggggcccgttcgtcgccggcgacaagggtggttcccgcataggtccctgcctctacgtgattgacacgttctctgcggcggcggatttcctgcccgaccgcaacaccaaccccgggctgaccaacttcgctcttgtcgtgcacaatcacgaaggggtcgtcgcgcgtagttactcagtcatggaactggttctcgaggctgacagtaataaggcacagctttgggaattcagttctgcttccggagtatggtctatgaagacactcacatgccccatccacttaccatggaacagtaacatttcattcgttttttgagggcaagatttggtgggtcgacttgtgccgcgggttgctgtcttgtgatttcagtgctgagggagaagaagagctcagtatgacgctacttccagatggcttgcatgcagaggaggttgaaactctttctagtgtttgcgtcagcgagggcaagatcacatacgtggctgtatctggacatcctgggggattaccttctgagggcaatgttctcgtctggatttgtacagtgactcctatgtcagtcatttgggacacgatatgccatgctcttggtctgcagaggggagctccaccagtgatcagtgtgcttgaccggcaagatgccagcgtgctctacttctttatgcagcaacacctagtgggattccacctcacaagaagactggtaaaacattcttgcatctgtggccatcaggggggcacttctcgaatggttctctccatgggaaccccttccaattgctccaacacaaggtgatacgaatttcgaaattctacgttgttcttgttgtttattattttgcacttcttgtttattgcttggaagtgcgttttgctgcattgcgtacacctcgtgctcatgttgtgtttgttgcagtgtactagcgtcattctctgcaactgcaactgcaataggactcgtatgcaacattatttgtactaggcactaggactgagatggcataatggatattatctcgtgcattttttttgtttttctaaagaagcttccgttatgttaaatgttcacacaaattgagaagtcactgtatgtctgtataatactgaaactcctgcgcaaagttgtggcatgtcgtattagtagtggcactcaacttgcctttactcaaaactgtgctaaattggagtacacagtatgtgattagttcttgtttgctccttgtttggtttgtgattattaggattcaatagatttttattactagtacgcaacattatcataagtcatcttagcaacattaatttggggggtatggaaaccaatcaccagttctaattatgacttcacctccagccactgcaggggaagaagataaggaacagcatattgtatatgctgggattacaacagcggccgaagcagccctggagctgtttgaggctcgaatggattcgatccaagatggaccaccggctcatgttgtggttccaccggttcatgttgtggtttgtcaagtgaagaacgcggactcagggagcggacccccgtccaacacagaagactgacagccttgtcgtcgaacagtaccgaagagttgtttgactcctctcctcttagagtagtggcacattgagcgattgccaatctcatgaagtttggtttgtgatgctagtcggttcgaagtactcaaaacattgaagcatgcattatggatggaaaaccttctaaattctcatcttgtcgactgagtaggtaaattttgattgactcgatggtaactttagttagggcgtgccttcggatgattgatcataccgtgcctcattggttcgcagccaatcttaaccaagccaaaaactccgttttgtttggtttgtaccaaaaaaattgtcttgccaaattactttttttattcgtcttgccaaattacctagtttaatgttaagatgcaacttggatagcaaaccaaacaaatgctagtcatttgcgaaaaattttggcaatggccaattcttgccattatattcaactcgttgcattaaatgtggagaccacggtgttatggtcttgtggaaggggtacacggtatagacggatagaccggcttgtctagttgtctccccgatgaacggtactaggtcggcagctttccccggctacgtccgcatgtagatgtagtacagccgaggccgccgacgagaagagcaccgcgcgcgtacgtcggtcagtggcatcacgattcacaaaccaacacgacttcacgcgcgcgtgaaatgggaccgtcgtatcgctgaggcttgcaattggcattgcggccacactcgatcgtgctctcgtccccagacgcggtgcgcgccgtctccgttcgggacaaacgccgacgctatggagtgtggaagtacctgcacactactgcgcaatgcgcaccgtggtgagcatcctgtgcatgttagactctaaaaactgattgtgaacttagccaacatgatcacctcttctaggagcaagtttaatattatagccaactactcgtttcaaatcatctataatcaatttagtagctaactcatataatctttatctataaacatgcactacataatttatacttggtcccacatgttatacacacatatatcttggagtctgtaccgcaattagctataaatatataacccgctacttttctctcttctcttttatcttctcgacagttggctttagcttagattaactatatagctgcctagattttagcttaaattgttacatgggttaactaacaaaagttatacgtggttgcaaacctcaaattaaaatgatgaaatgatgtgatactgaatcatccatatactaaatatattgttgtatttatatttaggaaaaagtacgaattacctccggactatcgtagtcgtccgaattactccctgaaccacaaaaccaaacattattcacccccaactacgtaaaccggacaaattaccctcctcgacccaatccgcggtggttttggtctacgtggcagtcaagtcaacaatttatttattaaaaaataggtggcccgtctgtcagtctctctctcttttatctctcactctctctctccacctgaggacggtatagttggccataaggcccgaggcccgaaggcccggcccacggcacgcctttttggcccggcccaagcacggcacggcccgacttgggtcgggcccgtgctggcccggcccgaccgtcgggccgtgcctgggcctccccaccggcacgctgggctggcccggcacggtcgggccggcccggcacgatgggccggcaggccaggcccggtacataaagtatggggactaaaaatagacatataaatgtaactgtctaaagaatagggaccttaaatagacttattttagctatttatataccccagcccaaagaagagggaggtaaatagactttttgtagctgtacatatgtcaca

SEQ ID NO: 48398 - DNA, 33014 bp, Oryza sativa
cgctctctctccccggatgccgcccagccacagcgagccgcccccgtcgttccgggcaagcgcgtagtccgcgccgcggaacatagtcgcctcactctccgcgacgaccctcgccgcccccatgggcctctcccccgccgaggggaagccggcctggacagacgaacggtccgcggcaggcaggcggcaggcggcgcgagacaaggggaaggaggagcccgtcaccctgcctccgctccctccggctgccgtcctcggatcctcgcctgccgcccgcacccgcctccgccctcgccggcggccgtcgtcggctcctcacccgccgcctgcggccgcctccacgtccgccctccgccctcggccgcatactcagaactcggaactcaccagtgcatgcacttgttcgatctgcttgattcacatgctccttgctcaatttgggttccattagttgatcaaacacctgagaaatttatggatttactaacgaattcgtatgatcttttgtgaattgtgataatgttctttcgatcaggaagctggcaatgcattaaggttcgtaatccatttcataatattgtttcgtacgatgatcgtgttgttcttgctgagaaatcgagatggatgaagctgacatgggccattcttggtggcgtgcagatgccggcgttcatgggatgcgagagcgtcgagatcgaggtcggcttctcgacagcgccggcggagaactacggcggcggcggcggcggcttgcaggcgagcgtggagcaggtcttctccgaggacttcttccagcccggccgacggcgcctccacgtcgctgctccgcacgctgacgcccatgatggcctcgtcgtccgccacgccatcgcctcgagaactcgcggcgcaagtggcgacgacgacgacgtcgtcgtcctggctccatccgcgcccgccggcgccgcaccacttgtcgccgttctctcgccacggcggcgtcggcggcctccacttcccgagcgccgaggcccgccgattgctagagagagagagaggcagagaaggagagaaaaaaaaaagatgacaggtgggcccaccggttttatttgtttttgctgactgtatcgccacgtgtgtgccacgtaggctgaaaaccgcttagaatcgagttagggtgataatttatctggttttaagagtttgggtgttaaatgtccggtattgtagtttatgagggtaaatcgtactaccgcaatagttcagggggtaattcgtactaatagtctaatgatctaatttaaaattagtgatcgtccatatattagtagacagatacgtctaaaaccacatcaacaatcataatttctataattataaaagaagtgattagacatatcttacgtaattgcgcatatataatataaacaagagacgattgggtatatcttcctcttccactaattgctatgatatgcatgatgctgaccacacatttcactctacagcattatccatcgagccgcaagtgagctctctcatctgatagatggcacccctaatccctaatcttggcttcgcccttggctggcttatacggagtagtttcatgaagccattgaattcacattgatctggtattatttttatttcttttcattattctttagagcaggtaccataatagactataagtcagctagaagcttatgtgtggaggagataagagaggagagagaagataagcggactgcagatttgtaaccagttacagcacgaactctaaaaaaccatatatgtatgggggtgtttgggagagagtagggacttattgttttgtgagagggattaaagtttagtccctagtttccaaacaccccctatgacatgtgggaccaatgattaggcacaagaaccaagaaaatttatgagagagacatgtggaccatatatttatagttaagagctaacctctatatgagttggctaaaaattagactgtaaagatctatgcagtcaacggttggctatattagcccttactagcgtctgacaactgacatcgatcaggctctcatcttagtgttttctgggtttaccaacagataattcaacggcatatgctgatatccagccccgaaatcaaatactcccagcccaggtgcccaacgcgattgaaaaaagggttgattgaatccatgtcattataattttataggtattagagatatgccattgcatacctcttcagtgcattttttatttctttgggaccaaaatgccctttcgtcttcttctctcgctagcaccgctgtctttccgccggcgacgtcgccgccgagcgtggaccccggccggctcccgtggggttgtatcggtagatggggaggaggagggacgccatcgcgccggcggcaaagctgcggaggttgtcgggctagccgcggctatcggggacaatggagctcggcgaggaagcacggggacgatggagctccgccggcattcctgccgccgcgccactcactcccccgctcctgttgctcgcgccgctggctgcgcagctgctgtcgctcgccgcgtcgcgttgctgctgctgctgccaccgcggctgccgccgccgccgggccgcgccgctgctgcggccgccgctcgccgtcgggcctgctcctgctgctgccgcacgccgcgtcgcgttgctgctgctgctgccaccgcggccgccgccgccgccgggccacgccacgcctctgctgctgccgccgctctccaccgcgtcgcgcagggccgcgctgctcgtgctgctgctcgtgttgccgccgccgccgggccacgccgcgcggctgctgccgccgttatgctcgccgccgctgccgccgacgcaccgttgcgacctgagaaggaagagaggaggaaggagaaaggggaagaaggaagaagagggaaaaggggcattttggtccaattatttttaaaaatgcatccaagggataaggagtgacatcttttcaatgtgtgaaattataatggcatattttcaaatagtaaatagtaatggtatattttaaaaccgacaaatttttaatgacatgtatctaattaatccttgaaaaaattagacactcctgtccaacaggcactctctcccttctctctctgtgtttctcttcctctccacttcgtccgtttccaaggacgggatctggagcggcggcggcggcggcggggggcaagctaaggcccggagcggcgacggcggtggggagcgcgtccggagcacctccggcggcggcacggcgtacgagcccggcattgtgacagacgacatcatggtggcgatgtggatcaggcgacatcagaggcgtggaacctgcgcgcgtcggtgatcgaggcgcatgacctgcgggtgccggcgccgtcgcctgggctgccgttcgatgtgcgtgtcaagataaagatcgggttccagtcggcgaggacgcagcggtcggtggcgagcacgagcagcggctcggcgttcgcctgggagtgggaggaggacctcatgttcgtcgtgtccgagccgctcgacgagagcctaatcgtgctcgtcaaggaccgcaccatgatcaaggagccagctcgtcggggggcacgtccgacatcggcattgctcccggcggtccgggcggtggcccgccggggttctactccggccggcttcacctccgacactgcctagaaggaggcggcgcacgtgtgcagcgagtaccggccgacggcgaagcagcagtggaagccgccggtgggcgtgctggagctcggcatcatcggggcgtgtgggctgctgtcgacgaagacgaagggcggcgccaaatactcgacggacgcctactgcgtggccaagtacggcaagaagtgggtgcggaagcgcaccgtcaccgacagtccgacagcctcaacccgcggtggaacgagcagtgcacgtggcaggtgtacgacccgtgcacggtgctcacggtggcgggtgttcgccgacgacggagatgagcggcaggactaccgcatccggaaggtgcgggtgcacgtgtgcagagttacgagacggcgttgacgggggtgcagatacacggcgtcgtacccgctgctcgtaatcctcgatgtaaagtgccttgatgatgtgattaaactcttgtactagtatctggaatagaaatttgattctgttgattaagcatactatgtgccatgcgcaatgtgttgtttagccagacagcttgattatttctgtgcgtctaattgaattcactagatcagaatgaaaaggaattttatttctgcgcgtcgtacccgctgctcgtgctgctccgctcgccgctcggggctcaagaagatggaggaggtgcagctcgccgtgcggttctcgtcgccggcgcacctacacctcgtcgctgctgccgcagatgcactacctccgcccgatcggcgtcgcgcagcaggagacgctccgggccgccaccgtgcgcctcgtcgccgcgaggctggagcgctccgagacgccgctggggcgggaggtggtgcgccacatgctagacgtcgacgctcacacgtggagcgtgcgccgcgccaaggggaattggttccgcatcttgggggtgctcacctgggccgtcgggcttgcccggtggcgcagctcgtccaccaccgtgctcgtacacgtcctctaccagtctacctcgtcctcgtctggtatccggagctggtcgtgcccacggcgtcgctgtacgcctgtacgtcttcctcatcggcatatggtagtacaggttccggtcgcgtgaccccgccggcatggacacagagcccaacgggagaatttaactatttgctactgttaggtttgtcaattatctaaatacccctcttagatttacacttaattttttgccattgaagagagacaactttttttttgccacttttgcatgtggcataccaacgaggatgtcctgtcatcttcttcctccttcacctactctctatcttctcttccccttctctctcacctccggccatcttcgtcagtggtgagaggatgattagttggggggggggggaggggatcgatgcgatggtggggacatcggtggcgaagcaattagcgaggggttgatgaggagaccgctagagaaggccgtggtggcggggtcacgacgatggtgttcgccgcggcgggggtggtacttctcgtgtgcggcacgtcgctatgctgctcagcgctggcagcggccaagaaactcctcagcggcagggtctccatcgaggagctgtgcggtggcgatgacgaggagtgagacctgttcgacggggagtgggtgtgggaggcatgccccttcctcaaagtcggcttttgctgctccaagaacggccgccccgacgactccatagcgctggcgcccctcccgctgcgatctccccaggttggttgcttcctcttcttcgatcaatttctacttcttcctctcatctactatcatgcttgcattaattccattgttggattggggtggcttagtttggaggtttagatagaaatcgattctaaatgtctactttctgcgagcttgaggaagacctatgcagaaacatcttcactgagatctcttggtgcaatccaaacatctagaacattgcagagatggtgattgatgacggggcagcctcgttggcgtgccacgtatgcaaaagtggcaaaaaattaagaaattgtttctctctaatggaaaaaaaattaagtgcaaatttaagaggggtatttgaataattgacaaacctaaaagtggcaaatagttaaattccccgagcccggcgacctagaggaggagttcaacaccgtgccgccgttgtcgcttgggccctcgcccctccgccgctgccgcagctctagatcctgccccctggagatggctagagagaagagaaacagagagggaaggtagagagagggaggaggaagaaggatagagaggggatgacatattggcccatatgttaatgggcgcacaatttttttaatgatgaatggggtcatatatgtttttgattctagtgccacataagcgtcacatcaacaccatagaccagatcaatgctgtcacgtaggcgaaaccactcttcaaaaccacgaatggagtaaaattacaccggttttaatagttgggggggtcgagatatccgttattgcggtttaagaacacagattcagtcactagttaagggagtcaaagtggacttattgcaatatctgcagaggtccactagagcatgtgtgtgcatgcatgcaagggcccatgcttaaactatttcttttgttataaagtatttatttttatctgattataatattatatttaccacaattaattttttaataaaatgttacatgattatattctgacaaaaaatatgtgctgcaattaaacctttgtgttgcattcaattttttttcaactagcaaaatgcccgtatattacaacgggtaaatacaattttaattatacatatgtatattctgagtattcctcattaataagtagtcaacacaacaacatttcaaacacggtgaatgtgtatggagcataaagtcccttcagatcgattgatgtatgctagaaaattgaatcatctattgtgcaacgaagatgctcgatgtatagccgggtctctttcaaccaccttcctcaccaagctatcaatcacaaggaagtctaggtttccaagcaaccacctaggattagcaagtctccaagcgaccccaatgtccaagcttagacgacgagccccggtccaccagtgaagcttgttctaccatgcaacctcctagaagatagctcggattccactaaattacctctttccttgtggaggtgaggaaaaccttcacaaacttcccgcaactcaccacacacttgggggctcaccgggcgacgccttgccgtctaggaggcttaacctccaagagtaacaaacacaatgaaaacttgcttgctatgaactcaagtgctcaaagatttgagtaaagctcactagctctcaacttatgttcttaaactctctctcaaccccaaatcccttctcttctcaaatcctcttctctaatctcactcacaaagagttctaccacaaaggtaggatattggggagtggctctttggttttggatggttctaatcttgcccaaagtcagcaaccatggatagagggggtggagggatttaaatacccgagctcttcaaaaactagtcgttacatacaactttgcacagtcctagagtatccgggtcccatgcccggagtctcctggacgccctaaaacctagccgttaggctcaggttagtataggcccggagtctcctggatttggcccgagtctccaggaagccctttcgggtgcccgaggttcaattttggagcctcctggaagcctcggcatgaacaggcctggagtctcctggccacctaacaacaccagaggaaaaaaccataacttcttacttcggagcccgatttcaacaaacttaggctttatggaaagcttattgaaagggctacccgaccccaccaagaacaaattctaaaaccactcataggataggctaaaacttgggtctctctcaagtagcacttgcataggttactttaagcaccgagacataaacaaacacatcaacgttgcattcctcataatagtacgagattcatatacccaattgcaaatagaaaagctataccaataggaataccttcacaccattctctttcttcacttcgagggttgtcaacatcaaagtcgtttcaccattgggacattctcatacaactcaacaagcacattagtcccagatcaattatacctttgccttgatcaatgcccttcttgattatcaacgaatcaaatattcttgatctttggctttgcatcttccatttctcaaatgattgatacagataatccatagtttcaaatggcctcgcacgatccgtcacgacaatgtcttcactcgcccttctccaccggatttggttcatcggtgccaagtcccttgcttgcccttcaccaatgcatggtccatcgtagccgagcttcccttgcgcttcaccgtcttgccatagttagccacttcatacctagatcttcaatctcttctctttggttctcatcaaccgataaactccatcttctagcttctcacaccattttcattttcatctcaatcttcaatcatggtatttatcttcttcaacatgtccatcaactcatgatgggatctcaccaagcattctcatcatcggcatttgactcttgttgattcccgatatgtgaggtatcatctttcttgtcatcaatccacaatccgatcacttgatcctcgcatatgagtcgtcaacctttttgcttgatgccggaacataactatcatcacaaactcatacaaaggttagttccaacaaccattgtcattaatcaccaaaacaccaacacaatgttaggagcacggggttggcgagagcttgggcggatcgggtgaggagaaaggagaagagaggaaggagataatgaggatgacatgtgggccttcaaggatgattttgtaatttggtgacaaggtgagggacctcttttgtactttttccttttacttacgagctgtcgagctgcctataattacgtgggcctaaacgagacttgggctcacgtgaggcccataagtgggtgggccggaatgggactgcgattcgtgtgcgagccatattcaggtggaccgaaaaggtaggccgggttgtcggacgacagtacgacactcacgtaatttcttcttcttctactcggtttctcttactcttgtgaagaaaagggaaaaaaaatcccaatctcgattgctattcgcgcaacgcaaccacgcgagggaccctcctccgtcgctcagccaagccaccctcgccggcgggatccacttccgccggcgccgaagtacagccggtgagttctctgaaaccagtgaagtttttctgtatggctctcgctgataattttgggtcagtttcatctctgcatcaacatggttatattttctgaatttgttggtagctttaaggttaggtttcgctgcagatcttgcccgaaagagagaaaaagtttattttttgtgaaagaaaaccgccgccacctgacaagttcgaaccgaatttagtttctcatcactttactagcccgagtagaattttaagttcaggtgtacataatccgatttgcacagagaattctcctgttatatatgttgctgcagtctgcagaggcagacccccataactaaactaataaccaatcatcttgacgctctcatctcctgcagtttcagggattcttgtcatggagatgatgaaaagatgctcagacattcaggtatcatctactcggccgcgaaaggcgatgcgcattgctatcaactcctggtcgacgatcttgctccgttacatccctgaagatgtgctgttcaaaatcctctcatggctgccatccaaatctctcatccgattcaggtcggtgtgcaaggcttggcacgccacgatatccagctcccgtttcgtcaatgctcatctcgagtgctccaagcagaggccatcactgctcgtgatccctggctctttcgagatgaagaagaacggtgagaatattgccttcctgatgagcctgtataaataccaggatcctaatataatgcatctgcaggattttcctcgaggtatccgtaaatggattcgaccggtgcactgcgatggtttgctcctcatttctaccaggaagcacaagatgatgatctgcaatccatcgacaagagagattgtttccctgccagaagggagccatagcctatgtggcggcatggggctcggatttgggtttgatcctcacagcaacaagtacaaggtggctagagctttctaccaaagggattatccgacaacaagacaggtctgcaagtttgaagtgcttactctgggcactgatgcatggaggcaaactgaagatccaccatacccaattgacaggttaactccagttcatgtgaaaggagccatctactggaaggtttgtcgtacgccgctttgcccgtatccacccaaaacatttctcagattctgtttgactgatgagaagttcagtctgtttccatgtcctccatgcagtgcaaagccttactgtttcacagaagtagagggtgaattgtgttgtgcttgtttttacagttggacactggaactggagatttggacctgtagtgttgggcaaaaccctgaatggactctatgctgtactgtacagattacacctgatcttgttatgaatcactttgtagaaatacctcctttggttgttttccatagaagaaagctgctgctggcatccaacaaggtctaccggtatgacatcgaaacatgtaaactggagaaaatagcttcaacatttgaagacttcacgtgctgaaaatagcttcaacacccgaggaatggtgtgtaccaaacatttttgaagaaggcagtgatggatcttcacctgtttaattatgctgatagtctagttgcggttagtaaattttgagaagctacttctttgtgtaacaattagtttgcatctataaatctagttaattatactgaataggatctacgctactatttaagaattaagcgtaacggttaatttggcattccagtcataaatctcaggtttgcagaaatggaggctcattctgcaatctgcagcagcaccagcagcagctctcgtcacagcccttcttgctgttgctacacttatgagctgcaactttaaaggtgcagacagttagatatactgtgttgtcttgatacatagtaagtgatttttttctctgaagatgtactctaatttgcaatgttgttctgattacgaagatgacattctgtacacacaaaaggctggcatggaagaagttcaatgatgtgatgcgcagagctgggattcgatccttatcaactcttagttcttttcattaattaaactgcatttatgtgtgctccttttccttccttggatcagaaatatttgaccgttagggcaaggtttaatcaaacatttaaaactttgaccattaattttatattagaaataaatttataaaagctaataagcttatgatattataatagtaatttcaagacatataccatttttcttgtttttaaactaaagcatttgagaaactgttggtgataaaaaaaagtttgaccaaatcttagtagtgtcacaaaaaattgaccggagggaatacttgcactgacactatcctaatttgcctgcagaaatgtttgctacaaacaatctggccggcgctgtcggatcaactgtattcagagttatctgaatttataattgcggcttcgatatattaacttttgttttctttctttggtacatgcacagatgtgatggtttgtggttaactgcaagtattatttgcgaaattggcacttctgactgaaaacttaagccgtccttgcagactcagcagatggagaagttataagagcagaccttgcattgcctacctggagcaatgatgctcaagtaggaggtggtcgtcgtgattcctagtgcattttgaagctttcatggcttgtatataaaattggggcgcttactgcaacaaaaaggagaacccttttcatttcagggtaagtatatatggttcagaagaaggcaagttcaaccatagaaaactgtcatgctacatcaatctctctttgtcaacttgctcaaaataaatgtacaacctacaacttgtgcaaatatacaattcatcaatgtttgatgatcgaaccttccaaacaagtaacgtgcgattctgcaaatatatataactccggtgtataacttggatagcaaaaccgtacatgacaagatcaaaacacattcttggatcttgtgtgagactattagtagagtcccagcaggggtcttctgtaggattcaatctacaccttaaattgatattatcctttgttctgattatcataccagtataaacttctcaatctaaatttaaatattttagtttttcaatgatgaccatgctttgatatcaagattattttacttcttgttttatcttagagaaatacttccttcgtccctaaaagacagtagttgtagcaagtaaaagacatattatgtaggaggttaaaagaatattatgtccttcatttatcgatgagaaaacgaggagaatgagggaatgctactagctcaatgattaaaatgagaaggaaaaaagatgaagggagtactattggttcaattgttaaaatgagaagaaaaggatgaagtagtattaaaggacatttagtggacctgctctaaagaaatgaaaaaaaaggctaaactatacgcttttaggaatggaaggagtactagtaaatagtgagataattcaagagttaccgttagaaattactgttcattctacctcctccattcaaaaatgcgtattagctttcaaaaaacttcttttactattcattctgcttcctccattcaaaatgtgtattagcttacaaaaaatttcttttaccgttcattctacttcctccaatcaaatatatgtatttgctttcaaaatgcttctttgtctaatttagaagggagttccactaccaacatgtgtaattaactcaattgttagaatagcttccattgagtatttgcacctattgtttactttgttttctagtttgaaaaccatttgttttctcaaaacacgggaatggctaggattggccttttctaagttataggtttatttgaatttggaagttaccactcatgtttccataccaaggctcaatacagtcaagtttgtagtgtctaccgagttcgccatccactgactatcaacttaacctttttagcactgtggccatgtcctacatggtgaccaagtacgaggaccattgtatgatcttgaagcttaatgccaagcacatcgtgagttacacgttggcacacgaggttcatttcatggagaacaacatatcacgatgctcatctattggtttggcggcccaaactgagagatgtacttcactctactagtttggtggcccaaactcagagacgtacttcaccttcacccagtatagtcaaggagaggaagaactgccggtgtagcggctgacatataatgtcatcgatctccatcatgaggtggtcgctaaacccgctgctttttataaattatgtttataactagaaaaagtgcttgtgcgttacaacgtggtgaagtctcacatgtaccggtgtgctgcgttcgccatctactcacgagcctagctagttggaggggtcgaaatcgccgccgatcagggtacgtacatgtgtttccatctgttctacgaacatggagttgggtacgtaaacagaagatgcgaaatgcacgtacggtgaggctgggggttggtgttggtaatgtagattagatgggcctagagggcttcagaacaccatcaacgatcaacagccgtgattaatcgatttacttaatgaatagtcagatctttctgattaacgtgataattcctagaaagtgcttctagccggattagtataggtatagatcctaatgaaagcaaacatccgtttcgcctgaataaaaaatcacgtagcatgtgaatgatgacgacagatgaaaattttttcggaagtcttacgtatttttaattaggtatagatattgtaataataacttattaattaaacacttgataggttcgaatgcaaattatattaagatcatagggaaatctatggagttgtaaaaggtttaagcgaaatagttgcttcagtgaggcaaaagggggccatggcccccctctagaggtcctttaattttgctactttagtattaaccaaatatcaaaatagcacatactaattttttacattggtcccctcaaagctatagatcaagcctctcaatttaagattcaagccatatatcctaggatgtcatgcctacagcaaaaaaaaacaatgctaataaattcctgcaccattccctatttttatcatgtttgtgtattttccaaggttatacataaaaagctcatacattgtccatgccaccaaactacaaatctgctttttatcttaaccacataagtatgaattatatagtagacaaatctgctttttgaagaagaactttgtaactagctacccaatcaaaaccaattaaactatagacaatcagtccatgcatatcaatctgaagggagatgtgtgagatcttaataagaacatatgcaactagaatatcatttttttaaaaaaaaattcgatcgaagcaagggggtgtaatattttatcgcttaaatttttcagtaatgaacattcatctacgcaatagcatagggtagagttgagtacattccaacaaccttttcttggtagaacattatacacttagtgtttataattggggcactgattgacattctacatttcataaaaaaattatagctacatacattcaacccaaagaattgggcagatcgtgtcacttgtttatgaaaacgatagatgaactaaaattaatatcaacttctcatattcggcaacacttaaattagtgaaatctcagttggaattgttagttgaataacattcattttctggcctagattaaagaaaatggtgatgaagataagtgcaacaactatcgacagtcctgaagaagattttagagcaaggtcttcttatttttcaaggggcagagcttcacgtagatttagttgggccttccgctcgacaaaatttcttaagctcataagataaaacaattatgaggctgtattctaaactcccctttcccaaattatatctcctcattttccatgcacatgactgctaaacggtgtgtgttttgcaaaaagaaattctgtaggaaagttgctttaaaaattatattaatccatttttaaagtttgttttagctaatacttaattaatcatgcgctaatccgtcgcttcgttttgcgtgccaggggtgaaggttcccaaccctcactcatgaacccaggagtgattttcatatttttccgttaagaaaaaaacaattatttaggggcatttttttgtaaggtgggagcatgtttttataatatatttatttggtgttgaaaatatcgttatacttttccacatacttgatcaaaattgaagtgtttgacttaggacgaaatgaaacaccttatattttgaaacagaccgaatagtgcacttatgcaactattgggtgaaatctattttcaaaattaattaatgatcattcccctatcacttttattacattttgaagcttttgtgatgtcgacgagctgtacccgtctactgtatttatatagtatgtgagacatcggtactaaggtatacgcgagattgcagtaaagtaagtgggagacatggatttttatacatattcggacccccctactaacaagtaatagctctactcctgttggccgaagccagtgttgctattatataatcaatctcccacaaatacaatggggaggagacctaatctagtctatgtcagtgtagcggcataaggctcaaataggtggtctacgggtatctattgtcaacttcctcgaacaggccagaacatcagcgagattggaggttgcaataaatccctcttgttgacttttgcggtgctcattcgattgtattggcctcgtctgggttcgtcttagcgtttgttgatgtatctttgcttgtcccctctctcctgggagtcatgtatttataccctctgatgccccttatccaagtagaactacgaaggcaggtatggatattgtcagggttatggataccacatacctaatagtagttgactaaatctcggcaagacccaccacataccatgtcttatacgaaaacaaccttcggatataggaggagttccgcataaggaaggatgaccagagttctacatggaaacgactaggactactcggattgtatccatactggtttccctagttctacttggacaaggagacacctatgggtatagatacaaggtcccctaggaagagaagggacacacccaccatagaagacacgaaacaatagatcaagacagaagatcaacatacaagccaatatacgccaagacaagacgccagatatcgacttcagagataggcatggctagtcccctacggtgcctatggctaccgtcaggagagatatagcgctgtctctgacctcgctgggcacggattcgaggaggaaggctgccatgttgtcgactacaagtcagcacttcagaccgccaagtctacaacagatagatagtctaccccaaatattgtactggtgtaattatggtgaataagagcaacgaccggcttcggccaacaggatgtagggctattacctgacaattcaggggcccgaacctttataaaaatcatcgtctccatctcttttactacaatctcgcatatattctagtatcaaagatccccatactatgcaaataccggaatcgcgacatcaaacgtcgacgtcgacagatacgatcccgagtagaccttttagggactgaatctgaataggactttgtttatcttttcttatctaagactttttctatacataagaggatttattctgtataggacttgatattatggtgggccccaccaagtttagtacacatgtattgggtatcccatatatagaacactgacacatgatttatatatactccctccatcaacaaatataagggaatatgtatttcttttagagatcaaagacaaaaataaaagattatgatgcacctcactggatgaagagtggttggggatggaagggtgttggcgctaagatgtgatgaaaattgaatgagtgatgatcgatggtacaagtagaactccaaagtcccttagagcatcttcagcaattctccaatatcctccccatcccaaaatactgccactgctgagaatttgtgtgctctaccagtcccccaataacccccccacaaatttccaataattattggcaataaccagtaatccaccctagttctcctaaaatagaggggtgaaggatatccctaaataatccacccccaatcccaattaccatgcgaggtgtccgattccatgctcatcccgagctctaccaccttgccactgcccctcacaccaacactcgaaggagctccgctacgctaccccgccatcaccgccacgatggagccgtcgtgtgcccacaacatttccccaacatcgtcatggttgcaaggcctgctctagcattggagagtcgactctgccgcgtttccaccgcagagctccgtttgctttgagtacgtgcatgcatgtgttttcctcccgcctggagtagctctgccgccaccatcctagcttcgccgattggaggagctttgtcggtcggcccaccaccaccacctcaccaccatcgtcccaatgtctactagatctggccgtgaaggagagatagaaaagagtgatagatcatatggtattgggtcactaacaaatgaggccatatgtctggtggtatattggggatggggtattgtggaagtgcaaaagcaacttccgccaataatcctgaagtaatattaaggaggctctggggatggactattaggagactactgaatatgttcttacattagttaataaatggtgagatgtaaatctcttatatttatggatgaagcgagtcaaatactagcgagtaagagtgagcgagagggagggggcaacacatttcggaagtatgagtggctgggcatgatcaagttgaaccatagagaactgccatcctgcatctgcatcaatctctctcagactttctcaagttactcaaaacaaatgactacttgcaacttttgcaaatatacaattcagtgtttgacgatcgaaccttgcagaacaagtagcaacaggctacataacaagaccgaaattcgttctcagatctttgtgtgcactaatggagttgacgacgatctcgccagtgttcctgatctcacttcttggcgttccattgctgtacctgctatggagcaaggcaagcaagtccccctccggcgcgcctgctgcaccgccgcctccgccgggcccgacgccgttcccggtcatcggcaacatccccgacctcctccgtggcggcgagctgcaccgcgcgctcaccggcttagcggcgtcgtacggccccgtcatgtcgctgaggctcggcatggcgagcaccgtcgtgctctcgtccccggacgtggcgcacgaggcgctccacaagaaggacggcgccatctcctcccggtgggtgccggacaacgccaacgtgctcggccaccaggacgtctccatggcgtggctgccgagctccagcccgctgtggaagcacatgcgcaccttggcgagcaccctgctgttcacctcccggcgtctcggcgccagccgcggcatccgggagcgcaaggcccgggagctcgtcgactacctcggcgcgcgctcggggcgccccgtccgcgtcggcctcgccgtgttcggctccgtgctcaacttcatgtccaacgtcttcttctccgaggacgtcgtcgagctggggtcggagaccgggcaggagttccagcagctcatcgccgactccgtggcggagacggccaagcccaacatctccgacttcttcccattcctcagcgcgctcgacctcagccgtcgccgccgcgcggcggccaagaacctcaagaagttctacgatttcttcgacgatgtcattgaccggcggctgagcagcggcgagaaacccggcgacctgctcgactcgcttctggagctccacgccaagtcacagctcgagcgcccactgattcgagctctcatgacggtatctcatattctttaattaggccccgtttagtacccaaaagttttttccaaaaatatcatatcgaatttttaaatacatgcatggagcattaaatatagattaaaagaaaaaaaaatatacagttagaggaaaatcgcgagacgaatcttttgagcttaattagtctatgattagctataagtgctacaataatcaatatatgctaatgatggattaattagtctcaaaagatttgtctcgcggttttccaggtgagttatgaaattagttttttcatttttgtccaaaaactccatccgacatctgatcaaacatatgatatgatacttaaaaattttcatttcgcggcccttagttaaaataatttgactcgatgtgagaattaaaaatgctcatgattagacttgatgtgaataatttaatcaggatttgttcatcgctgggagccacacgacgacgaccacggtggagtgggcgatggccgagctgctccgcaacccgagcaagatggcgaaggcgcgcgccgagctcggggaggcgttcgggcgcggcgccgtcgaggaaggcgagctcgcgaggctcccctacctcaacgccgtgatcaaggagacgctgcggctgcacccgccggcgccgctgctgctgccgcaccgggtgtcgtcggactcggagccggccggcggcgtgacgctcggcggctactcggtgcccagcggcgcccgcgtgctgatcaacgcgtgggcgatcgggagggaccccgcggcgtggtcgccggagccggatgcgttctcgccggagaggttcttgggcagggaggcggactactgggggaggacgctcgagttcatcccgttcgggtccggccggagggcgtgccccgggataccgctggccgtggcggtggtgcccatggtggtggcggcgatggtgcactcgctggagtggaggctgccggaggggatggcgcctggcgacgtcgacgtcggcgaccggttcggcgccgtgcttgagctcgctacccctctttgggccgtgccggttaaggtttaggaaggcccaaggcctacaaaatttgatgggcctgaataccggcccatctatatgagtgggctgggatttaggcccatccgaacaaggccgttagggtatttcatttctgttcatctatcgtgtttatatttgttagtttcctttgttagtcgatcgtttatgtctgttcggtattttaggatggataatgatatcaaccaaggtgtaaaatgttcatgtaaacgagccggcctgccagcccactgcccacaacccatgagcccaactcctctcgaactgaaaatcattggttgttgactactactaataaacaaatgagtaccaagatttgtgcatatctgcaaggtgcttgtacactcgataccaatttatccactaatcacggagagatcatggtgggttgcattatactaagagacgagatgtgtatgtttcatcttaaaagataacagaatgatcaggttttcacattggtcatatatcacaaactcagcctctcaaatggtgctttgtgcactagacactcatcccataattaactaacaaacaccatccaaatctcctaatcttttattcacctcaaagtggtttatcctgtagggtcgcactcctatttatccacttaccctctatacacaatttactgtctctttctgacttctgattcctgaaacggcctgaatatttttgcaccactgattgagacatcaaagcagccgcccttccatttgtctactgcaactggcatcatcaccgaatctgatcggcgaaggcgtcagagattgctcgcaaacgcgcaaatctgggaacgaacaccacattcagggcggcgatcgagctcatattatattgtgatctctgaatttttgctacgaggagtcaaacaaagttgttgcattggacggcgtcagcagatgagggccaatccgttcgatcattcggccatcatatccaatcacaagcacacaactaggaaacacactgatgggcagttggagagaaacaatattcttgagcttttttttttctttagaacaatattcttgagctgaaaggtcaaaagctagccttcatgaaagatgaagaagcactagattggagtagttttaaactcaaagcatgcatgccatctgcatcagatattgtatagtttaggatagcatggatctcgaggattatatgttagtgggggaaaaaaactttgtttattatttgtgtgaaatgtggcaaattattcgcgtaatttggtgcaaagagtttatgaaaatggcgtaattgtagttctagaataccaatcatgttactactatttgttaggacaaggaaacaaaatccagtaaatggataaaaaaaaaggaacgacaaggaaactcatttgtttggtgtacgtttacattcttccatgtgcaaagatatagtgtgtgtgctcgtacttatgctacttagataagggcaggggcgaagccatgatttgagattaggggtgtcgggagatatgggtccgggggtatgcgaagtgtggggaatctaccttcccatcctgccgtgtgtccctacagcccggtcctacccccgcagtccgtgaaccgcaggagcggccgggggggtcagggcctcggggtgccacgtcatgcccctcgggcccttgcgccgctttgtcccgaggccctcgcccagccgccatttggcgggggagcgagcgaggagggggcccaggctgagcctcctttaatgtgcgcaacgccccaactgccccctgtcgcatttaatgcagtgagacagacgtgcggcgtgctaagctgatgcgccataatcaagaatgaccggtctgtaaccggtctgacgccggtcacatctgattggaccgacaaccgtgctcccacgtcgcgtctgcttccggcggagtggaggtaggtatgacctgtcccatcggagggtcattcggacggcggccaccacaagtcttcacccattaatgagggaatgacagggctatcccccgtgtcatgcgagggacggcgctgggccccactcaaggacaagctgttgcttagcttccaggcgaaggcacgggtcgagttccggtcaagatagggtgggtccccacccgaaagaagagtaggtagagacggtgcatgtggtatccccttgagatataaaaggaggaccttacccaccgagaagggggacgagactcagtaggcctgaactctaggagaagaagagcgagagtgctctccagactttaggatctctcgtaacactccaccataatcccaaacacaagagtagggtattacgcttctcagcggcccgaacctgtataattcgattgtgtgcgagctagctaggggccttagggacggatacgtggtttctagaggcgagtttcttcccccggccgaactcacgaaaggggggtctcacgatctcccgctatagagggccatccctcgacaagggggtgtaaggtgaagataaactataagaccgaataactaatattgatagcaaaggaggtcaaatagtcaccatcaataacaagcaatgtataaagtagtcctttaagaaaaacttgaattttagctctttaataatatcattgaaagtttaaaactagtctttattgctaaattcttttaatgtaaactattgaataatctcacaaataagtatcatctattttactttgaaaaagatgagaaatcacaaactaattttgtagatcatgtttcttgctaatatttttagacttgctaactaactaaattgataatactttcaagctacacaaaacaaactagataaatacttaccctagctaaccttaatatagagtaaaaacatgggggtgtagtgtttgtagtgtttggataggggggtgttggcaccctttggcacccccctagctgcaccactggataagggcagtcccagtacaagatactaccgacagtgtatatattcttcatgacacctagaaactagtataaggtccaacttttcccatatatatactggtacaatatgcaaatttaataccactactcttaagcaagatattatgtagaaactaagtcttatacaagatctaaaagatataaaagaacttccagttgaaaacttacctacttgtccaatattcataagctgtaggatttaagcacaaatggatggagtgcatgaacctatatataacttcatcaccacaccttcggttcttctccgatgcactgtcttttggatccttagggctagggggaaaaactgcgtcatgtaaaaaaatatagtttatattatgaagataataacttatgatttagtaaggctggttgggtaacggatatataaaatgcaaccgggtgaaaatggtacgataatttctgatcagtaccaagactgtttcataaaaataatactgtttccaaccattttcgtttctaatcatatataaatttagtttttccaatttctcttagcattgtattaaagttatcactaaatagttaaatttgtaaaaatgaaaattttcagaacatagcaagacagtttctataacagtactataaaactgatatcttttccgactgttttcatctcttgctatagttgtatacataatattatccttatgagctgaagtagtgagtgatctcagtatgtccacacaccacaaataaaatctctcccaaagatcgtgctccctatcatgaatccacggcagatcccataaggtccatcagagattctctagagtttagaaacataagcttcgataccagtttttataacccaataatctccatattgcatatatatattggactgtatggaccctcgtatcatggcctacgtaacctaaagacttactcccttcatccaaaaaaaaaaatcgaatctagtattagatgtgacatatttcagtacgtacaacgaatctggacaaaggcatgtccagattcgttgtactaggatgtgtcacattcggtactagattggttttttaggacggagggagtatctgatgggcaccaatcaagccaggactcgggaacattgtaaaatttaggtagtgtaagacaatacactggatattagctattcttatagcgaattttaatagacgaccatggcaaactccaatgcgaagctgccaacctagcatgcagggtggaggctccgcaactgctgatgggtgatactttttaatgttgtgttactgtatcaacaatatcttagagcaggtacaatagcatgctattagtcagctataaacatattttaatgagataaacgatgagaaagaagagcagcgggctacagatctgtagccagctgcagtacagactccaacaatacacactatatgtatgacgggtgggaccatatattaatagtatagtaaacaagtattatataaattggctattagattagttatagatggattgaagctaatagtgggctgtactattagactcgctcttatgtgagacaccttgttttaatctaatgctctcaaacgaaactgattccacaaactttggcaaagtgtactgttatgctgcaaacgagatcctctgtggactgtgccactactgacaggcgtacatgtcggcgactcctatatgctgctcctctaatcctcttagtggttgaagcttggcacacgttagctgtaacagtcttgttaattggttgtacccctagaagagttctcttcaatctggggatggattattgtctctggagggaacatccttccattttgtgcatgccatccaaaaaatcattaaaaaaatagtaaaatagattaatatgtgatatgtcatctaccgacatataagtttaaattcaaccaatacaattaggaaaaaaaacaacaaattaaactaaaaataacatattctatttaaagtcaatttcgttattttcgtctcttctcatataagttgaacatgaatttgtatgctcgtgcaatgttatatcacatattgatcgatcttattattatttttaaatttttttatggctttttaggtgacatgcaagaacgaccttgtcttctctcttccttactcttcatggaacgtaggccagtgtttgtcgctggccccgcagaaaagagcgtttcacgccattatatatacaaggccatacggctttgtctgcttaacgagcagcaatatcatccgaagagaacgaaaaaatggaagcttcaaccatcctatggctcctctacgtctcgctcgcctcttgcctcctctacaaagtcttcgtttccactaagaacggccaccccaagatcgccgcgcggcggccgccgggcccgacccccgtcctcctcctcggcaacgtgttcgacctccggggcgagctgcacctcgcgctggcgaggctcgccgaggagcacggccccgtgatgtcgctcaagctcggcacggccaccgccgtggtcgcctcctccgccgcggcggcgcgcgacgccctgcagaggtacgaccacgtcctcgcggcgcgggcggtgtgcgacgccgcccgcgcgctcggcacccacgagcggtccatcgtatggctccccgggagcagcgcgctgtggaagcgcctccgcgctgtgtgcaccaaccacctcttctccgcgcgcgggctcgacgcgacgcgcgccgtgcgggaggcgaaggtgagggagctggtcgagcacctccgagggcacgccgccggcgccggcgaggaggaggcggcggccgtggacgtcgggcgcgtcgtgttctcggcggtcatcaacctcgtctccaacgtgctcttctccgaggacgtcgccgacctgagctccgaccgggcgcaggagctggagatgctcgtcagggacacggtcgaggaggccaccaagccgaacctgtccgacctcttccccgtgctcgccgcgctggacctgcagggccgccgccggcgaaccgccgtgcatatcaggaagttccatgacttcttcgacgagatcatcagccgccgtcagaacgccggcggcgaaggcgaaaggaaggaggatttcttggacgtgctacttcagcttcactcagctgatcagctcagccttgacactatcaagacctttcttggggtaagcgtataagcttaatccattagagcgagcgtcctcacagtagtgctcactgacatatgggccccacagaccctcgggtccatatgtcagtgagcagtactgatctggattgaatcccattagctcactgaatactgaatactagtgcaacgtcattgaaaattttatccattcaaaattctacatcttcagacttttggactagttagaactattgctatccaaatttccggttctgaaatttcttagcagcgatcaaatcttctgtctacatcttcagacttttggactagttagaactattactatccaaacttccggttctgaaatttcttagcagcgatcaaatcttctatagatctattgaccttgacagcagtatggaggagctgatcaattttgaccgaactggcgttgtttacttttcgaacagtacaaagtatgatccacaaattgcaaaaccacttgttaatttattcaacggatgcatgcatgcatatgtacaatttgcttattccagtcaacctaaaaaagcctcaacctgagtaaggataaaacatcacctaatacaacgaatttagataagtgtattcattgtcaccctagatgatgtcttattcttgtcgatgttagagtttttttttaacagtgatgttttgtttggcaaatgagattgggaaataatatccgacccttcaaagagcagtattacattctagccattcattcttcacacctcatttaatcctagctatttatccatttccttttcccaatcccacctttcatatatcatttgtcaaacacacccatatcccatttgccaatcacaccctgagagtatgtatatgttcctaagtcaaagctgtcagatttttatttttttttaataaaaatttgaagttggcaagcagtagtaactagtaacacgttttggtacgtggcctgcaggatctgttcaccgccgggacagacacgaactcgatcacggtggagtgggcgatggcggagctgctccggcacccggcggcgatgtcgagggcgcgcgccgagctgcgcgacgcgctgggcgcgaagccgcacccggacgagtcggacatcggcaggctgccgtacctgagcgccgtggtgatggagaccatgcggctgcacccgccgagcccgctgctgatgccgcacgaggccgtcgccgacggcgccgcggtcggcggctacgcggtgcccaggggcactaaggtgatcgtcaacgtgtggtccatcatgcgcgacccggcgtcgtggcctcgcccggaggagttcgagccggagcgcttcgtcgcggccggcgggtcgttccgcggcggcgagatgctggagttcatgccgttcggggcggggaggagggcgtgcccggggacgccgatggcgacgagggtggtgacgctggtgttggcgtcgctgctccacgcgttcgagtggcggctccccggcgggatgcggccgtgcgacgtcgacgtcaggggccggttcggcacgtcgctcaacatggtcacgccgctcaaggccgtgccggtgccggtgccagcgcgcccgtgatgcgattctgcccgtgtcggttaagaggcagatcgatcgatccagctgggggtgatttagaattgcttcgtccacctcaaaatataaatgattttagatgaatgaaatatactacctccgttttaggttataaaactttttaatattgtccacattcatatagatgttaatgaatctaggcacctatatatgaatgtagacaatgctagaaaatcttataatataaaacagataaagtattttagtactacgtacaaatctcaaatcagaccagtagtttatccattcaaagtttgatgaatgatggtgatagagtgggtgacaaagttacaaggctaaaatggaacctgtgtcctgtcacaaatggaacaaaacttgtcgggccacatgaagttgaagcctatggtgattgattgggtatgtatgttgtgtttatatggttaaataaacaaacttaagccaaaaagggtgatgtcgatcgatattgcgaaatttgtttgtgcgtaccagactcaggggtccatttgacaaagtacaccttttggacttcaatccattttattggaccattttaactccatcagcaaatgttgaaaacaaatttaagtcctgattttttttaacaaaacattatttgactcaacaattaggaaaaaaaatttctacataatataataaaacaaacaatggtagttgtcacaataatagtagagcactactacaagatgctcgatccaaagcaaaagaaaatcaaggatgtttcatcatttgttaaaatttttcaactcatatcaaacatttgaaatacgtacaacattcagaaaatattaattgcaacactaacaatccgttacatagggtcccaatggctaaacatcgaagggaaaaatcaatttgaaatatcaatagagtcaaatagtagttgaaacaatttgtttcttgcacatgtttaagaattgaaacattttttataagaatatggaaacgagaagagtgagcaagatatatgatgtagtatggctaaccaatgatagccatcctagcagtttcatatcattatgtagtatatgattgccatttacacctaatatgaagacaacatttaatccatcatttcctcactcgtctagtgatgtgcctttagttagaaaaattacatgtgtgcttctatgtttttatcgatctcatagattgctatgttttaaaactctattaaggagattttttttcttgtttatgctgaattgaagactatttgagtttcctagaatataattacatgcatgattttaggttcaacatatgacaacgctaaattatttccttttagtagcgaaaggaaggattgtcattcagtggatattccaacaaagctgtaaattggaggtaactttgcagatgttcaactcacataaatatgtgaagggctctagatcgattgcattgaaatttgtcattttgttttattgttgaaaacttgttgttacttttgttctggtttttccactatttgtcgaatgactgtaataacatgacagttgggttttgtgcatctttgacacaacaaccaagttttacattatcctaaaaaaatgtataagatggtgcctcgacatatcaattatgacaattctataaatagtttgattttggattcaagatacaagaaattggtgttttaggtcatacacaacatctgcagtgttctatcaagggtagcaagtaagattatctatttggaattttagatttgtagcacaattgtgtataatggagagtattattttatacaaatagttttttcttgttacatagtactgatattttccttgtatgcttagttttcattatttcctccatctgaatcgttatcaccgtcttcttcatcatctgtctccatgtcgaggtcaacattatattcttcccaactcccaagggtcatacaacatttttctcggccttgcatttgctcgagcatatttgttgtaattttctggtacgtttgttctttcttcttgcaaagctcgaatacttcaatgacgctcagtattttcttcattaggttgctatcgaacttgttatccaacttaacaatatgaagacatatataagaaaaatgcataagcttttgaagtggtcaatcttcacaaatcaaaagtgcaccctgcaattttgcaagaaatttgtgttgtgaacacatatagttaatctaatgtccaatcaaggataaacttctaattataattttgagttcatagcagaagtgtatatatagtacatagatactccttctagttataaatatatatttgacgtttacaacaagatttagtcaagcttttgaaacctcaactattgttgtttattaaaataaacttatgaaactaaataagttcatgatgccatgatagtactttttaagccaattatatgcatactatatctttttcattttaaattaagcatgttcagttgtcatcactatttccttctcgttaccctccatatcctccttgttgtcttcataattaattttgtgtgtatgcactaaaattgttctggcatttgacattatttcacgatacatctgtgagcgattttttataaggacactactcctgtcagtaaattgttgtccataaacttctattaattaactgcataatgtgtggccaccacaagtatgataaggtttataaaaaaatatggacgacatgtggtcataaggagtaaagtgaccaacaacgtaaagtttaatgtttgacatgacaaccttttgatagcaaatcaaatatggttttattgtcagcgttgtttggaagtaaaaatatatattaatttgactgcaaaatagataatactatgtagtaagagcatcaccaacagtctaactatatgattcccaaaactaattttgaaggattttagtccaaaaatcagctccaacagatcccctactctcctacccgagttttggagttccgttcccccggttcctcgctccgtttatatgcgggcgtgaaagtcgctcccaatcacgcaatcccgcctctctccttcgttcccgcgcgtgggagatagcgatctttctgcatgtgaaagaaaaaaaacggaattttctcttggtagtttaacagaagggcccacttttaagttttggggattgaatttaggctatctgttggagggaggagttttttcacttcctattttcagtttaggaaactcaaaaacaattttttaggagaaaattatagataatctgttagtgatgctctaatccattccgaaaaatcaaataaaatattttctatagaataaaaaccgaaagtttacaggaaagaaaatcaaaacatagtaatcatcgatggaatcgaaagttcaaaacccataagataaacgtccaagcactgctggccaatgtcctcagctgccgtcgctagtcaccacgtactcactagctacctgcttcagttggcaagtagctcgacgagacgaacaaactatactcctacggcgccagcgccggtgccggtgccggcgacgatgagttagtactgctctcaccgcccgatgacgatcctccggttgcatcctcaccggaggttggcacggccatcctcttcttcttcgtcgcaccgttcaggattggcctactactactagccgatgcagaagccatcgccgtggaggccacctgatctttccggcctcctcctcctgccaccgtcttggtcgacacgacggcggtctcggactcggcggcgctagctttgagcagtttcttcttcagctgccgccaccttcgcaagcattcgcggctctcggtgatgtgcttcaggcacatgcggtagccgggtgtgcgtcctccctacaacgccgtctggtcgtcgatgaaccgcgtctgtatcttgtgcacttccgacgttcctctgtcggcagcaagacgaccgccggctgttcttcatcggcagcactaccagatcaaagatttgcataagagcatggacattagtaggggtaaaaattaatcaaccatatattagtacgagaagtatgtgtgtgtagcggagttctcggtaccagcaactgtgatcattgatatactcaaattaaacaatttggctctagcaaatgattactgatatatatatatgtataatcaaatactagtacactttttttagaacatataatcaaatgcatgatcagattattggtgagagatcatatatacattgttgtgttgtgcatgtgccttgtagagatatatatatatatatatatatatatatatgtaacgtaattatgaactagatagctttgtcgaatattcataacattttctccaagttcgttgtattattctaaaatacatcaatcgtgagaacataatataagtatataactagtagcgttattaactaaacaatgtattttttcgctggtagtactttttctctgggctaataaatttgcaactagtagctagtactgtaaaaattgaacaacacatgtataggcacaagaccgtgtatatgaaaaagagttgaaatcttctaataatttaagacacgtaatcatgcatgatcggtgcacttgccgaagtgaaatatattctaggtttaccttgacaatgtactgtacgtaagtctctgtgtctacgaaatggacattgctagctagtgcaaaaaaattaaaacaaaacatacatgtataatgcaagatcatagaaaacaggacagatagatatactcacataaccaaatatatatgtattatccacaaaaaaacataatcaaaatatgtttggttaaatgcgtgaagtgtgtctgccacacttgtctagctgtgcatctttttttacgttacacaaagttaaccatgaaccaattaatataatatctactaatcgtgtctttatttcctatatatttccttcatctaatctaaaaatatagttattcatgccttcaaaagtttaaaaaagaggcatccttacctcttctctaccaaggcattgtcagcctgcttgattacattcttgccctcagcctccttccccgcgtttacaggtacctgcatttaagattcaatttccacatgagagagatgtatatataaaaaccaaatttaacatatgaactaacgtaaagatcaaataattaatttgagtgtgggctaatctacatgaacttcaaattcatttaaacaagataaatgtgtcttctacacaatttcagatctatatttatatctgttctttttctaag

SEQ ID NO: 48399 - DNA, 21050 bp, Oryza sativa
aaacttgttggttttcttatatgtcattggaagttggttccaatttaatattggttaaaatttacacaccctctcgtaccactaccatctgtcatgtgtcatgtgtctgtcttcctctatatccattttgcaaaatcatatagatgcaaaggaacacaacgaaaatgccatgaaaagttcggagctttccatccagctagctgctctgtctgtcttaccttgctgttgaccggtgttgaccgcggtatgcaactacagttttggagggcgtccgtatactcggtatttggaaggtgtgattagccaattatttcctatatcttatctactggtataaaagtacggatccaccatttgaagtgaaactcgatggctagatttctctagtttgttatattacacatggcggcttagaagcgtttgcaggagtgctagtcagcttagaagtgtgatagaatatttaatggacttttagtatataataatagaagatttccacgtgagagaagtttatatgaaatccaaatttaacataaaatgaataagaaaataaagttctccattcgtttcatattataagttattttggatttgttgtaagtcaaatatctcttcaagtttgatcaagtaatatagcaatatctacaacaccagattagtctcattaaatccatcattgattacatttttatagtaaatttattttgtgttgaaattattgccatatattattttattaacttggtcaaatattaagagctttgatttaaaacaaacccaaagtgacttaccatatgaaacggaggaagtaattaatttgagtgtaggctaatctacatgaacttcaaattaatttcaacaagatgaatgaaaaaaaaatcagatctatatttgattttcagcggtaatacagatctatatcatcaactaatagttagtcaactactttatcttaggattcataaatatttacaaaagaggtaaaccaaaagcaaagcataacaaaattaaaaaaaaagaagaagaagaatctaggagatctttttcacaaacaagagaagaaaaaaaaaggattaaccaatgaacttgcagcagtgcagttagccttgggactcactggatctgggctgggctccttgttcagatcaaagtccctcaccttcctctttccctgcgttgtgatgtctctcccggttagcaaaagcaaacacaatagcatatagagaggagtagatgtatgattcatccaaaaaggcttatcaggagcgtgaggatcttggattacctggttcgaggactccatcttcatcctctcccggtgtgaaatggtaactaccaagagacgacctgaggaaatgagacaagaaggagattgatatgggagtacaatgtgggggtttagggggggtttatatggggaaatttacatggaggtggtgatgaggcgctgaacaacgtttagttccagctgtttggtgatgagaacgatcgagtgaacggcataaacaggaaggtttccaatgtttcctttgtagccttttctgcctctcgttgcaaatctcaacaaattagaatcaattttgtttctcaatttattagaaatatattgaagtatcccacacaaatattaaaataaaggaatgttaccgaataaaagaaatattcaaggttttgtttaacttggcagctttgttaattgcagtatggcgtgtgtactgaaaaattatctaatacgttgtctgacaagcagaaacatattgcgaaagttgaaggagccaccacattcgctttcaaacacgagtttaatatgtattacgtaaagaaccagaaaaaagacgtgttagttaggttttaattttgacgatatagtttcattggatacattgcaaatgttgtgtgggagtaacacacagtctctatctttgttattatggcgggagttagacgatatagtttcatttgctacattgcaaatgtggtgtgggagtaacatatgatctctatcttttttaatatgccgagagttagacggattgaatgtagtaggcatactaattgcacacttggtcttttccgtttttagtatggcgggaatttcatgattagacagtaaatgcgccaatgatgtatgggatgtctttcttctcgagtttgacacgcgggagcaatatggattaaatattagatgcactttatttattgttgaaaatattgtgattttctatggtctatgtatatatattcattaatattaacataggaataaccaactatttctttattgtttctgtaatgcatattacaacaattaaattgtttgtgaaaaaaattccagttcgtttcatttaaaagattttcgtaacatcaggccaaaggtgaccaaatcaaattagttaaatttaaaaaacatggagcaaatagaacaaagagagcaaatttgacgacgtccaaattaaaaatctcctaggagttgctcttgttcaacaactttagaatctttttaaattttttgtatggtgtaatgttgaaacaatttatttggagtattattatattcatattcatgatttttagagcaatatgaataatattaatattaatctcgcagccgttacaaattcggaggacggaaagaccaagttccttttaagagacaatgttagagtggactcataaaactatgaaattaacagatataacagtatgctattttatcactatgaaattaaataaaaaatattacagccagcaggtgacctgttttttctctgtcgtacaggtgctacaattaagattaattgcagtcaacctaacattacatatttagacaaaacttctatcccaaaatattacaattttttttaaaaaaaatagacttatcctaatacaacgaatctagacaaaacatccgtccagcttcatagtgacccatccttgtactctctttgtctctaaatatttgacgtcgttgacgttttttaacatgtttgactgttcatcttattaaaaaaaattaagtaattattaattctttttcctattatttgattcattgttaaatatacttttatgtatgtatatagttttacatatttaaaaaaaagttgaatatgacgaacggtcgaacatgtttaaaaaaattaacggtgtcgaatatttagaaacggaggaagtaatattttagcacggaggtacggcgtttttagctcaactggaaaggagctgctaggagtgatgcgccggtctaggttcaattacacatgaacccgggttacctcaccatgttgttaaaaatagtacggagtagtagtagtaccgtagccaatcctaaaatgtaaaaatccatgctggctatacctcggaaagaaatggaaatgatctggattttctgctgcatatgacctggggtttaattccttccgttctgagattaaccgggacgcgatttctaaatttggacttgatcgtgcacgcgaggacacgttcagactgacactgctctaattcgtttgggctaggacgaaaccatggaccaatattcggcctttgggccttgcaaattacactgcttctcgacaatggagcctttcaaacgaaaaggcccatctaaaattgtacattttgtgattcgagaaaatgggcttacagactcggaagtttaggggaataagttcacccgtcatccctcaactttactttacgccgagtctatttgaggttccctaaccgcaatatcagaaatgtttaccgctaaaccatgtaaaaccgtctaaaaaaggtcccgaggtagtatagccggcgcgtttcgctgacgtggcatcctagtcagcaaaataagtaaaataaaaatgtggggcctacatgtaagtgagagaaaatggtgtggccccacatttctcctttcttttctttttctcttctcttctctcccgattctctcaagtgggcacgacggtagaggggagagaggtggccggcagtggagcggggacggcgggagagggggagagagccggccggcgtgacggcagcggcgggagaaaaggagaggaggcggccagcgtgacagcgagctcggatggtgcaacggtagcggcgagagaggaggtggtcggcgcgatggcgagctctgcggcgaagaggagcaatgtgtagtaggagagaggagaggagtggcgcgcggcacggcagcgggggagaggagcggcacggctttcgactcctccctctccgagagctcgccgacctcctcgttgtctccctctccactcgcgcttgccggcattacaccctgctcaccggcctccccatatccttcctctccgccgccaaactcgttatcgcgccagtcgccacctttcttcctctctagccgccgtcgtcgcgacgaccgcctctctctccctctctcccgccgcctccatcccagctccgccgccggctgggtctctccccctcttccgccgtggcgcaatctggcagcaaaccaccagcccgccgccccgctgccgtgctcgcccgccgccgctctgccgctgccccctacttgcttcgcctttcgctcgcttccgatgaaggggaggagcacgaataggatggtgttgctctgcccacccgccgccgtgctcgccccccccccccccccatcgccgctccacccaccggccaccggcctccctcactgaagaagagaagagaaggagaagaaaaaaatgtgcagcgggcatgtgggccccacatacttttttatttttattttttactgactaggatgtcatgtcagcgaaaccacccatatatatatatatatatatatatatatatatatatatatatatatatatatatatatatatatatatatatatatatatatatatactgccataggatcttgagtgtttgtgtaagtttagaggtatacgtttctggctttgtggttaagggatctcaaaaatctcgttgttaagttgagggacctctggtgaacttattccaagtttaggaagctaatttcatgggcctcagtagatggaattcactgcgttacaaacggtagctagaaaacataagctgtttgtttgatcgaaaactcgaaatttctgcatttccgaagtactagcagaaaacgaaaaacttgcacgctggacatcaaggtactggaaaagcagtaaataatggaaagcgaccggtgtttagtcgaaataaacgttcgtctttttcacacattcgctcaactgcggtgcaccgtgcgaagccccgtcactctctgcgcttaactttgtctcaaaatttctctgtcgcccaccgatcacgactaatcgcaaaattcgcggcgaaagcccaatcgccatgatctcctccatgattactcgctaagcattgtggatttactccagattcgcgatctcctcgtccatgacaatgtcatcatcatgatcatgatcatgatcagcagcgttaggtgcagaagaaagtgacaaggcctttctcgcttgtctttcctctccattttcattccgtggctaagaaaaaaaacatcatcaaagcatcgcgattcgcaacctaataaccggacagaccggcgaaacacacaagtacattggcgcagggcgtcttgctgagcttttgcttgcacccaaccatacatggcacgctggggtcctgggacatttctcgcagatgagtgggacgttttcgcagatgagtgagatgatggaacagtagtttggttgttgttttttttttctttctcttcctctgcttttgcctacaaggctttgaacagcgtactggctgcctgtccgactcagagcaaaaggccgggcaaagctaccagacttgtgctgttgcatagcgtaaaagataaccctgtggacctgtggtcgatcagcagaaccgccatggttgttcatccagacttttggatgacatgtacattatgcacagtaatcagtaatgtgacaactgacaagcaggtggttgaagtatgccaagaaaattttacatatttttttttgcatgtaataagtaccgtttataagcatgggaagcatgcaaacagaaatcgaaaatcagaaaagaagctagatttaagtacgtactttctaatatggaaaattcagatgtcgatgaaaaaaaatacagagctacattctttacactaaagaactgtattacagaaccttttaatttcaactggtacataagccctattccttttccataaaaaggaaaagtttgaatagaggggtggaaaagtgcaggcatgaatcttttcgcagagcaccttcaacaatcatactactacaatttcttttcagcatgctgtctcggccatgtcacaactacaattctactcccattatctttgagagcgccggacagccttgtgcatgcctacccttatctagttagaactagtctcttttttacactataaatgaaaaaaggccgtgaatgcagcgccactgcatgccctgtgtggtgctccacttaacacaagagctttaccataccattacctctttggtcaaagctaagtgcaagtcagaagggagaaaaaggtgtcaacttttgctctaagtttttgcttctcgtttttcctttcctctgccactgccttttaatttcccctttcctgcgagatccagatgattgcttcgctgcacgctcgtctgtactactactccctcccaatccttgtgcgtttgacccttgtagtaatcattcctccctcattgtttaaccaaaccgccttgtttcaaggccgtttttcattggcgccatgatttggttagcgccatcctgacaaccctgtagctctttacgagcaccaaatcatcgcatgtgaacatcccatgcagactacgattagctccacgcaatcagtagcatgcagacgctttcgtcgtcgcctccccgtccgggccgcccgccgtcctcgccggcataattagggccatcattgtgcgtgggaagagcccgtgatccggcacgcggccggtggatcggggctcggatcaggtgctgctcctgcgatagctcacgcagtcacgctcacgcgctgaaccgatcgagtgctaccgctagccatagctcgtcatgacgcggcacggcgcatgcatgggggtggtttcattgcgttgtgtgcgcgcgtacgcgcggggccggggctttgggccatcggattctcctcccatccccctcccccccgccgcgccgcgtgagattgcagcggaatcgtggggaaaaacacgccgattcatcgcgaaaacacggcgttccgctcggtgcgcggcatcgcgtcgcgcggggaaccaaaaccaaccagttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttataaaaccgggcggaccaggcccaatcaccgggaaattattgcgtggttactcgaccgtactaatgattgcgcctggcgtggtgtcgggccgaggggcgacacgcggggccgcccagggacggtggaggtgggagtgggcagtggctcggctcgtcgtcctgggccacgggcgcacacgcacagctttggttcgttttgttttggattcgttcggattcctctccctgcaaatgtcgcacagctttgggttcgtgctaacattcagtaacctacgaagcctgacctgagacaccggtttgaccgacgacagagacattgcacgtatatggaatttttacatttagcccttttaaaaaaattattttacaaaaagacattaaaaaactttatattccataaatagacccattttcagtggcagggttattgacaccacactcacactgttacagaagtaagtcagcgatgtgaagaggggcagtgccaatgacaccggtactgtgaacctatttgtaagaaaataatatggtagttagagataagagtcaaatacaaattatagagataagatatatcctagagatagaatcctagagataagatagagtcctagagatagaatcctaaagataaatctactcttatttgtattgtactccaagtctctatcccctatgtactcctatatataccccatgagagggtcgatccaatatatcagaaaataccaaaatacagcgtattagattttctacatggtatcagagccgtagacaaacgtcgatcgatcctcggttccagctaggttccatccgcgctgccccagggagatgagatcaatttctccctggggcaccgcaccgcattagctagctagcctctccaatcatttacagattagtttaccgcatatcattagatgcgttttctaataattagttttagatctattagctagccacagaaaaccatatgatcgtcaggagcaatgcggcaggtgttacaggagcagacaacgtcaacaagcatcataccatccggcctcatccatggatcgatctgcatcgccgctgccgactcgtctacatagatggacacctcgcgtcctctgacagattaatctgcaagacgcttcatcgacgacatcgaccgtgtcctctacgacggcaacgaccgcgtcaccgacaacggcatcgatcacgtcatgtacgactacaacgactgcatcaacccggcatcactattgtgatgaccgctatacggcgcagaaggaccaaccaaagtggtggcctcattgccaacgacgtcctctgacatatgcaagaggtccctaatggcatcctctgacatctacaaggtgcaagatgctaacaattacagtttttgtcttcacaccatggcgtaaatttttttttttcgcctttggctatatgcggctacaccgacaaccacagttacttcatgatcggctacattgacgaacgtctacaacaaaaatcattgacgaaaactccagtccaagcgtccgtgtcatcgctatcgtccatgacactcccgctatgactgcgggagggaatagaggagagtcaagggacgacacagaaggggacgcaggcaccaggtggaggaccgtccatcagagatgcagtcgatgatggtgagtcaaagaaagatgaagaaatagaagatttcaaatccagtcgcaatcgttcgcttcgctcccgttacgactgagggggaatgttagaagtataatatggtagttagagataagagtcaaatacaaattatagagataagatatatcctagagatagaatcctagagataagatagagtcctagagatagaatcctaaagataaatctactcttatttgtattgtactccaagtctctatcccctatgtactcctatatataccccatgagagggtcgatccaatatatcagaaaataccaaaatacagcgtattagattttctacatatataacattttaacccttttcaaaaaagttataaatagatctttggcgtcaatgttattgattttattcccattcacattcagttagctttggcagagggtgaggtgtcggcctcaagcttcattggctccgaggcattagtcctcggcgtcaagatcactggtgctgagaaaacagtccattatttgaataagttttttatggcttcatttgtaagataagtttattttaagaagactaaaatgtaaagagtaaatttcacaatgctatagatattttgactaaaccatcgtaaaaactatagatttaaatttgtgtatcacataattttagatttagcacaaaactacatatttaaaatattgtatcacaaaactatagattcattaatgaggttatcaaagaactataattttttagtttatattcataacatgttggggttgtaaaagttgtaactctatgataaaaccgatactaaatttatagttttgtgatagattgataacgtacatgtagtttcttaaaatttactcaaatgtaaaatatccgttttgcacgtatactacctagttcggttaagcgaatcgcggtttggactatccacaccccgcggatcaacgccaccgttattatccacgctagtactagtcgcggtagattgtacggatgattacagactagcggcactagtactagcgcacggcaacagcagtactctccgcttcataattcccgacggattcaggggatctcctctccgcggcgcctgcgtcgacctttgacctttgccataacgagcgctcctgaccggatcatgaggacaattatcaccggatgaagaggacagttaccgtagcaacgcccggcgtatttacgcgctgcatccgccattactccgtccgtcgcgcgcgcaccgacacacgcatgcattcacgccccgccccccccccctcctccccctcccgcagcaagccccgtgccaccagtacaacatcaactattcccccacattaaccgagcacacgtatacgtacgaaaacaaatcccttcacacctcacagtagtactagttgtagaagtactattgctgcttcctcagaggagactcctattgcccagcgtgctgataggggcgcccatgtgccgacgacgaccccccggccggcttgttctctcaaatctcaatcactggccgtctcttctgttgcacatcaatcatgtaaaagctgattgcaacggctgcttggttctctggtaatataggagtactagagaaacaactgaaccacacggagaaaaagacacgggcgagaaacgatcgatccactctcccatgaggatgcactcgatcttcatgagcagctatagctagacaccgctgagagctgtaccatccgtcatcgtatggtcatagcgttgctttgttgttgttgccggaggcgtccactgttgctttgccgtatggtcagaaaggctttgcgaaaggccatctctctcttttgtgttttgcgctccgaaaacggccagttcttcaggtcccgtgacgtgagatcggatcgagaagaggatgtgtgtgtgcgtgcgtgcgtcaaggctgcaaggatacgccgagagacttgggggaaagattctgccattttgcacgacggtaccgtcaaggcgtgtcaacattttcacaccaaaaagcatggcctaaactcgcttaattaaacgccttccattattatggccatgtatggcgtcacgtcacgcgataaatttggggctatttggatgcccaccttaatttaccatagttttttaatcaaagttgtggcaagatgcaaattgtgtggctcaaattttgatggccacacttgtggcaaactttggctaagaaaagtgtctatgactagttggaccaaaagaatagaaagtgtggcatgccaaagttatagaaacaaaccaaacactaaccacatttggtcaaactaacatacctcaactgtggcaaaatgtggcaccaaccaaacaggcccaagtctcagcggttttgattgatttcctacccactgctacctcgtgtgatcgacagtagtcatatactgttggtgcttggtacggagaactcgatcatatggagtacagtacgactagagtagtttttgcttgtaacgattgaccactcgtcttattcaaaattttttgaaattattatttattttatttgtgacttaccttattatctacagtactttaagcacaactttacgttttttatatttgcaaaaaaatttgaataagacgagtggtcaaacgttacaattaaaaactcaaaatcccttgtattgtgaacggagggagtaccctcgaacgactgcatatgttggtcgaagtgagaagtcgtgtacacgttttctccttttcgcgcgatcgcaggggcagcacaagacttccatgaatccattatccatgtgtacgttagaatacgtgggaatatactgatcctagctaatagtcaagtgataagctggcattgcgaagcagccctaaagactatttacaaacacatgatacaaaaaatgtaggattcgagtgttttgtcaccttaaatcctaagtatgaaaaacacggaaaattatatgaattaatgactattggataaagcgaaaaaaaaaacgcaagaattagtatagacagatagacaaacattttttttttccgggaggttaaactcatgttgaaaatccttcaaaacacctatgatttgagacgaacttaaggaattccaaagtaattttgcgtccctttgttccaaatgattatatagctaggaatcctttccctacgaatataaacctttgaaatcatccaaaattcatttgtaacgaaggagtcctaaacatatcatactcagcatgccctgcttcaagttagtagttcaggccctatttgaaatgcatggatggtaaaacatatgaagagaaaaaatacatggtggtagaaatgcatgtgcaaaatggagtattagaaaacataggaataaaccatttggaatgaccattttaaattatagaaattggatgagaaaaatagactcaaaaataagaagttgaaggtacgacaaacttttcttaaaaattatgtatgcattatgctattcctctgaaatttttacatggatttggaaatctcccatccttggtttcaaagaactcaaatagaaaaaatttctataggaatggaatcatgtaaattcattcacaaatccttggtttcaaaggagaactcgatggatgaaacaacaaattcctactgaagaaaaaagttaagggcccctttgaatcgtaggaatgaaaaaacagagaaatagaaaaaacacaggattctgacaggaatacaattgtaaaacaaaggattgcaaaacacagtaaaacataggaatggccgtttgattggaccaaaggaaaaacgcaggaatcagatgagagagatagactcagaggaaatgttccaataggttagacctcttgcaaactttcctccaaaatgtgtgtaggattacccatttcataggaattttaaaggattgtatatgattcaatcctttgtttcaaaggtcttcataggattttttttctataggattaaaatccttcaaaattcctacatttttttctacagatcaaagggacctaaaagggcaatatcacagaattttttttaaaaaatgttcgatttccctacttgaacatcagtgcgtgtcctactgtacttcagcatttcgaagcaaaagagggcatacagtttggtacagtagcctttcacatgattggagaggtgaatgcccatttgtccccaccaccgtcggcttttgcttttgcgattggcatgccccccgcacgcagcagcaggcgcggcgcaccgcagggcagcagccgcagcagtacacagtcaccctgtcctcggtaaccggacggcgacgagttgttgacgacggcgagccctgtgccccgatcgatggatggaacggcgagcgaatcgcgcccaaaagatcttgccaatcaaagcaacccgacgggaccgggcccccccccccccccccccgggttcacatcgtctgccgttttggctgacggcaaacattaccgttgcattcatccctgccacatatctttttatcaacggatgcatgcagtggttccaccatttatgattaattagggactactaatcagcagaatcacttatttctctttcaaagaaaatcagcaaatagaatctcaggggcaaatcgcgcgagaacaaaagtagagctgagggaaagctcatgctttttgacgccaagaaaatggatcgactgacagaagcagagcagagcagagcaaaatactacagctaagcaagcttctgttatactaagaagctattcaaatacttgaacaatagtatatgtcttataaaatatttaagtattcatttgacaaaaatagcattgctgcactactactatatcccagatagagtatttttcatccaaaaactagcagcgaaatgaagctactgatgaaattcttcataatacaactctcatccatctgataaaagattttgttgttctggttctgctgttcctgggtgaatagacatttggtgtcgatccatattcttggcgccaaaaagcaggagctgtccctctgctctgcttttgttctcgcgcgctttgccgctgagattctatttgctgattttttggaaagagaaataagtgattctatatgcttttgttgacagaaggatgtgtggcagggatgaaggcaacggcaatgtttgccgtcagccaaaacgccgtcagccaaaacggcagacgatgtgaaacccacccccccccccctcttcccccctctctgccggtgtgcgtagtgcatcaccccgtgcgatcgatcgatggcacgacgagccgagccgccgggtgcggagagccggagaccgtgcgctggggtgggggcgacgcgtctcggtgcccgtgcccctcatgcgtcacctgtgctccctagctaggagtaccactcgtagcagtagcgttgggccccttggttatttcgatctcctcccgatctcttcctctctctagtctacgtcgtgtccgtctcagtctgactcggtgtctaatcgctgggcatgagggctcgattgctgcatgacttcaataattgccgctgctactactactccccccaccggtgcgtcgcgtgtgcgtggcaagcccagccgtggagggtccatgcatcgtcgttcgacatgctcacaaagttgtggatccggatcgtctgcagtaccgcagaggggtactgtttatgtgagaggaacagtgaattaatgccatgaacagtgtctctttactgtagctacaggacctaaaacactgttgagtactgtttggtactgtgctgaatttactgtagcgaaaaatctgatcctttcactctcgatcggacggtccacagtgatcttaatgcgcagcactgttcatcctctgcattagtacctctaatgcagaggatccgaattccaaagttgttggggggtttagcaccagtgcgtgtgtgtccggttttgagaccactccattcaattgcatgcatcaatgcgtgtagagtgatggaagttttcgatgaggtattgatgagaattatgcgcgccacaggggggcgtgccaatcaaatacatgtactccctccgtctcacgatataagcgattttaagttttttcttctaatatttgaccactcgtcttattcaaattctttttacaaatataaaaaacgaaaagttatgcttaaaatactgtagataataaagtaagtcacaaataaaataaataataattttaaaattttttgaataagacgagtagtcaaacattacaagaaaaactcaaaatcccttatattatgggacaaagggaatataattaaagtgcctggtttatgtactaatgttactatacgaaaacataaatttcgttgcaagcagcaagcgcaagtaccggatactcataagagcaggtacaataccaagctataagctagctataaccacatatcgagaataaaagagaagagagagtagaaaacggactacaaatttgtagccggctacaacaaagactccaagacgttatgtgtgtatgagatgtgggaccgggtattaatgtcgtactatattttttatagataactattatatgaatggactattagattaactatagatgatttatatccagcagttggctatactattgaacttgctctaatgcagaggacgtagtacccgttagagcacccgcaatggtaaagtaaggtgctatctataaaacatgtacatctcagcaatagactaaattaatagtaaaccacttcaatggtatgtctacatgggtatctatagctctctaatcaattgcctcgtttttttctatagactatctccagattagtagatagctttgctctctctcttcatttaatctcttccaagtaggaaaatatgctgacatggatatcttgtagagagcctatagataaccattgcgggtgcccttagtagtagtggcgttatttcgctgcagcgtgggatcgcctgcgtgcgtgtatacgtatacgagcgtcgtactgtgcaagcgagatgaagatcgtgcctccattaacggctcgtactgtgtcgtgcagccgtacaggtacaccgaactggctgtgacctgacctctgaggctgcgttctttcttcttctcaacagtgattacggaaaacggagcgatccattagcacatgattaattaagtatctgctattcttttttaaaaaaatggactaatatgatttttttaagtaactttcgtatagaaactttttacagaaaaatgcaccgtttagtagtttgaaaagcgtgctaacggaaaacgaggaggactatcctgaaaagaacgcagcctgagtgctcgcactgtagagtgcctccgtcttaaaaaaaaaagataaaccctgatttccgtgtccaattttgactgtccgttttatatccgttttatatgaactttatttataattcgtatttttattgttgttagatgataaaacataattaatattttatgcgtaacttgtctttttaatttttttcataatttttttaaataagacggacggtcaaacattgggcacggaaactagtgtttatccctttttttttttttttgacggagggagtagtaggctcaccgtgaacgcgtgagccacaccagctcgaaaaatgaagccgcgggtttaccatgacgcgaggctggggctcgacaacaaacagtggcgcgtgcaggcggcccgtcggacaggagcaaaacagacggaagctttgcaagcgcgccagcaatccagcatgcagccccggccgtaagctggctgctgctggtggcagcatcgcagcaaggcaggcgtagtgggatgcgccccgccgcgcgcgcgacgcgatgccccgcgattaatgcccacggcgcgtgtgccgtcgcgccccaacaataaattctcggtggccgacgacggagagggggggcggggcgcagcgcagcgcaggcggggtcgacgcatttaccgcgccgcggccgcggcacgtgacgccgtcctgtagcgcgcgcgcgacggccgggggcgcgggcgcggccgtaccagcatgtgcacgtggtggtcgtggtcgcgcgcgcgcgccctctcgaacggtggcccctgcggctgggtagcgacacggtatggagggagttcaggacggcttgggggtgattttgcagcgcgccgcctgtgcgtcgcacatggagtccgcggccgctgccagtgtatgctggttcgggacagcacggggaggtggggcgtccatatagtccatacgtgcgcgacagggaacgtaggagtacgtacgtacgagacgggaagcaacgacaaaaatacgagggaggatgtgagacgtgagtaggtgacccttttgggcgtgcccacagtacggcgcagcttctccgtaaaagaatgatctggtaatgtacatgtagcttaattaatgaggcttagttaagccttgagccaacccaacctaaaagcccagtccaagcccaacctgactcaaacatggcccacacccaaattttggaatgttcaacatgaggtaaactatatactccctaaaaaaagagtatatatctacataacattcaaaagttttatgacgaaaaacatttaaatagtataattacactataactaatatgtaacaataatataactcctatgtaactgccgcaaaaacatacaacacgtacagaaaacacacgattttttccctacacttctacagcacgaatcttgatgcttatccgatgatccacatttcaaaagtttcatacctgatttttctgtcgacaatttacaaaaccgtaaaaaaaaacacgtggtatactctcttggtcctaaaaacaagtcattttggccactacccagtttaacttttaaccccctagttacaattgtagttgcgctagcacgaaaaagtagttggagtggctgattcagtatcaccaccactaaagccttttaaagtagcatagataagaattgtggtagctcattcaatttataccaccagttcgattttttttcttcaccttgtcttcatcatctccaatggttcctgctctattgttgtcttccaagcctactctaatctggtggggttggctaaaagtgtgttcttttctctccttttccaatttctactctctcgttttcaatgcacatgtttctttaactactaaaatgatatgttatttgcaaaataaatataagaaagttgtttttaaaaatcatattagcatatttttcaagttatttaatcgagtacttaactaatcacacgttaatatgtcactctattttcgtgccagaatggatgagtttccaactatcaccttagaacatagcctaagagtttggtgcactagcgaaggggacctaggacgaaagtggcatgctaagagtattgaaattttgagtaatccaaatataataaatactaaaatccattaagaaattactgatgtcctgcatgtgtactccctccgtcccaaaaacctaatctaggagcggatatgacccctcttagtacaacggatctagacgaagggttgtccagattcgttgtactaggaggggtcgcatcctgtcacgcccagaaattcacgaaccagaatttctaagctgaatgtgcattaaatccctgtctaggaccagccagggtatacgaacgacaattgttgacatacagatccacgtcttacaaaaatataaaagattacagatgcagcgaaaaaagataaaagcgagctaaacttggaagcttgacttctgcagtggggcgactccactccacaggcaatccttgacggcagcgacgaaaccaacttcgacaagacagctcccacaaggaagatcttcagctctggtgtgggggaaaagagagcaagactgagtactacccactgtactcagcaagtcataccggaagaggaggtatgatacaggatatatccaaaggaggctaagggcataaagcaggcatttaaaagcagaagttgaaagcagtaaaacaattgtagtagattaagcaagattaactaatcactgtccaacgctacaccacgttacaacaggcccaaccaaccacctgaactataccagttcattaagctaaactaggggtgagactaatcacggtgaatctggtggatcgcccataactgcgggcagggctattcgaatagttttactctggccagaggtgtacaactgtacccacaagacacgattccatacatgtcgccatgccccgaagtatcaccatgatactgcaaagggggaaatcgtgataagaccctccgcataaccctcccctaaccatccacaccacgctaaggtttcaccccatccctcaaaaggcagtgagcggtcccctcttgcgccgcggtgaatccgacagctggacaaccggacactccggccgacccaactccatcacgcccaccctcgccaccggtgcctaggaaagggtcgagctatacttcagatcaagcagttacccactcccgcttgtggtaagcacggtaagtctctcagggtttcccgtgaactggtccttaattgctatgagtgcgaccagcaaaaccatgcacccacagcccaccatttagtgtatttcctaaaccaacatctaatcattttgatacccaagttatcaatggcatatggtaaacaatatatggctgaataataggacctatcccacatgatattgtaaaagaatgcaacatttaatagaaatgcgggatatttgtaaattgggtacaatatgatcaattgtattgcatgacttgccttgctctcgcagtgatgagaccacagcaacgtcttcgaggaaccgcggatcgacgaaacggccgaaatctacgcgacaaacaaatcacacaagcaaaacacactataagactactgaaacagagaacaaaaatattttcaatagattctagggatttttatgaatttactgagacttgaatggacttaatcggagctcggatgaattacttatgaattttagaagataaactatgtttttactactaaagaaaaatccttaatcaattttattgcgcaatattacccagggctgacgtcagcgaggggggaggcggcgccgacaggtgggccccgcttgtcagcggtacaaggggagagggagggggtgccgacatacgggccccaccggctgcagctcaaaaaggggaagggagagggaggcgccggccgggctcggcttggcctcaaggccgaccggccgaccaaagcgaggcggcagcgaggcacggccaccgacggcgatgaccggcggcgcgggaagcggcggcgacggccgaaaggcggcggcgcatggccggagcagcggcgtggctcggcactcacgggaagggggaggaaaggatggggagggaggccccaccagtgacacggcggccgaagcggaaggcgaaggcggcgacgacgacccggcgagaggaggggcggacgagcggtggcgacacctagaggaggggaggagaggagttagggatggagaggacgaccgcgatgaccaaagtggccggccggagatggatgaaaatggagagctcaccggcgagcgagggaaacggggcttccgggtgatcggcggcag

SEQ ID NO: 48400 - DNA, 12282 bp, Oryza sativa
  unsure (1)..(12282): unsure at all n locations
gggggctcgggagagtgcttttatgggcgagggaggggaggacgtggccggggatggcccctattgcgccggcgacgtggggtagtggggaggaagagagagagagaggagagacgggattcaaaccgaatcccggcctctaaacgggcgcgcgcgggagaggtggaggaggtgggcggtgacgtgggtgcaaggtgcgggcggagtgggggtgcggataaggcgggaaacggcggcggcgtggggaggtggggcgccggcgtgggcggcgggaggttagggacgaccgacaggtggggcccacctgtcggcgcccgagagagagagggagggagggaggacttcggggaggggaagggaaggagggggctggcccagcaaggagggcgcgcgggagggaggttgggccgacggcccaacaaggaaaaagaagggaaagaaatgtagaaaaagaaaaagacttttcctggaattaaatattgcacttgctcatttttaattggttaaaattacttttaaggctctgaaaattccactaaaaatcttgttaatgtattgtgacatgtgaaacccaagaaaaatcccacaatgccatttccaattattaattgtatttattacttagggatttagctctaggttaattaaaacaatttcttcggatgatttattaaacaatttttttaaaaaaacaacggaaaggggaaacttcaaggcgtgaaacatcccctcttaggttatgtttttttggatgaagggagtactaattaataagggaattgacatatactagcataacacatttagaacataggagcatccctaataagtactctcttatattataagtctcgttttgattttttaacttctttaaatctaaccaaatccataaaaaaaattggcatcatttataacatcaaattagtttcattaaataaaacattaaatatatttttataatatatttattttgtgttgaaaatattactaattttttctataaattttgtcaaactaaaaaaaatatatctatctattatatactaaaagtccattaaacttcctacaaacgctctcaagccgccacgtgagactcctacaaacgctcctaggccgtcacgtggctctatctaatttgaccgttgatttttacttaaattggtggacccaatattttagaccattagattatattttcacttaaattggtggactcgacatttcaggtaggttattagattagatgtattttattttaaagaaactaattatttcgttactctgatacgtacgtacatgggagaaacaagaaaaaaaaccactcacggaattactataaaatcaataagaaagaaccatacgtacttggtaaaattgatgatatttagaatatgtttttctattatttaaagatataaaatattttactctataaatttacgtaaataccaccattgattctcatttaaattggtagactgtcacgcccagaaattcacgaaccagaatttctaagctgaatgtgtattaaacccctgttcaggaccagccagggtacacaaacgacaattgttgacatacagatccacgtcttacaaaaatataaaagattacaaatgcagcggaaaagataaaacaagctagacttggaaacttgacttctgcagtggggcgactccactccacaggcaatccttgacagcagcgacgaaaccaacttcgacaagacagctcccactatgaagatctttagctctggtgtgggggaaagagagcaagattgagtactacccactgtactcagcaagacataccggaagaggaggtataatgcaagatataaccaaaggaggctaaaggttcttttgcattaagctagcatttaaaagcaatagttgaaagcagtaaaacagttgtagtaattaatcagtattaaccaatcactgtccaacgctacaccacgttgagacaggcccaaaccaccacctgaactaaccagttcattagctaactaggggtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggctgtgataggacccttcgcataacccccctctaaccgatcgcaccacaccttagggttcgcccctgtccccagcaggcaacgggcagcccccctttcatgctgcggtgaatccggaagccgatcaaccggacaccccggccgacccaactccatcacgcccaccctcgcctgggtacgtcggctagaggaaagctacactataagcccagccgttgcccacgctggcttgtggtaagtacggtaagttcttccagggcatcccgcgaaccggtccttaatcgccatgggcacgactaacaaaaccatgcacccacagcccaccatgtagtgtattttaattaaccaacaccattacggtggcactaaaccaaagctatgccaataatcaaagtctatgctttaatgtgatcccctttgtgtactagttgaactaagcatggctaagcatttcctaaaccaacatctagtcattttagtacccgagttatcaatggcataaggtaactaatatatggctgagtagtaggattcatcccacatgatattgtaaaacaatgcaatatttaatagaaatgcgggacatttgtaaattgggtacaatatgatcaattgtaatgcatgacttgccttgctctcgtactgatgagaccacagcaacgacttcgaggaaccgcggatcgacgaaacggccgaaatctacgcgacaaacaaagcacacaagcaaaacatgttataagactactgaaacaggaaacaaaaccatttttaatggattctatacatttttatgaatttactaagacttgaatggacttaatcggagctcggatgaattagttatgatttttagaagattatctatgtttttactataaaagaaaaactcttaatcaatttattgcgcaataactcatcccaggactgacgtcagcacaagggggcggcgccgacatgcgggccccacgggtcagcggctcgagagagagtgagggagggacgcaggcacgtgggccccactggcagtggcacaaggcgggaggggttgcggctggcaggcgggccccaccggccgggctccaaaagggggggggggggtggcacctggctcggctcggctccgagccgaccggccggccatggggtggcggcgcgcgcggagctggcggcgggacatggttaccggcggcggagcgggagtcggaggcgacggctggaagcggcggcgggggaggcggcggcggccgacgcggaaggcggcggcgtcggccgaaggcgacggcgagtgcgtggagaggggcggcgcaaacgagagagatgggaaaagggaggagaggggatcctcaccggcgagcacggcggccggcgcgaaggacgaaggcggcggcgatgacccgacgagcgtangggcagacgggcggcggttgcacctacggaggaaaatggagaggaattaggggttgggaggaagctcaccgcggctagcgtggccggtcggagatgggaagggcggcgaaactcaccggcgcacggagagagaggtgttccggcggcgggattggatggggatgcggctgccggggtagctttggcggcggcgaagctaacggcggcggcggattggctcggcggcggctctagcggtggcggcgtgcggccagagcacggcggcgagcggcggcgctagaggagatcggcgcgagcgcggtagagggcgtgcgagagcgtggcgaaaaggggaaaagggagagggggacgcggggaagctttataggggctcgggaggggcggacacggccgggaagccccccgatttggctggcgacgtgggggagggagagaaagagagagagagagacggattcaaaaccgaatcccgccctctctggccgcgcgcgcggggcgggaaggcgtggggaaggtggcggcgacgtgggcgcggcgacgtggggcgagtggaggaggtggggtgccggcggtgcgggcggttggagctccggctccaacggccggaggtaggagacgaccgacaggtggtccccacctgtcggcgcccgaagagagagggaaggagggaggacttcggggaggggaggagaagcgggccggcgcgggaaggaatgggccggcggcccaagaaaaaggaaaaaggagggaaaatgaaagataaaaaggaaaaaggattttcctagggatttaatattgcactttgcttatttttattggttaaaattatttacaagtctctgaaaattccactaaaattcctgttagcatattttgacatgtagaatccaagaaaaattccacatgttgattctgattattatttgcatttattaatttgaggaattagctctaggttaaattgaacaatttcttcggacgatttattttacaaattttaaagctggaaaggggaacttcagggcgtgacacagaccaaatcgatattttagaatattagattagatgtatccattataaactaaaagtccattaaacttcctaaaaatgccatctaaccatcagtttccacttaaatgggtagatccatcggatatacttttaggaaaatcgtaagccaccatgttttatgtcttaaacagtagataaaataacagaaaatgtgagaaaataatggttcatcggtttcacttaaatcatttagataaaatcgaaaaaaccacccctccacttcgccctcccccacacatacgcacaacacgacattactcatcccatcccttatcggcttgagctctccactctacccattcctgtttatatagtgagaaaaaataaacaatattaaaacatgcataaattcaaagctacacatcttatttctaatctaaatattgttctatttataattaaaccaaagatttaaagatccatgaggcctatattttgaactggtataaaatataaaataaagcaagtaatagaatatgtcaatagggactcaattgaactatttagagaaaacgtaataagttcgcaaaaaaattggttcttgcattcactaaaattggaccaaccatcgcatgttccattttcgtaataattttaaaatgcttagacattaatggccctacatctttcctatatattacacatataaaccgcacaaaggttcgcagtatatagttcattgaaaagttatatttgttactattaaattgaaaattttggattcatgctaactaggtatgttcttttgaaaaatatagtatagatcacacaaatcacatggaagcgaggtatatgacatgcctttataaatttatatataagtatgtaacaacttgcatcaacttaaaccgactagaaggagaactacttgatggtacaaataaaacctatttattatcaataatagttctttagaatttgttaaaaaagcaagtaaacattctattaaaaaataacaaaacaacttatttctaatttacacttcatttgttagacacgttttccaaacaaactgaatcgaacttctttctatataataaagagatcgtagataattatttatacatatgtattaaatattatatattttaaaacctaaaaaatatcttggaaaaattatcaaagcaaaatgccaatgaacaacagatgcctcacctgatgtgttctgttaaaaagaaacttgcccgcgcaaatacgcgggctaacttcctagtttgattaaaaaaagttaaaacgacttataatataaaacgtagagagatcagctactacattcgtcaaaaatatgaaggatattaattgctcatgtactactatccatcaccaatttgatatccctgtagatactatcgatggcattgctagaaaaatccatccattatcatacacatgctcaagtatgtattattgctacattggatccctagcatctcatgatacaaatagaaactaaccatactcctagtatatactactgccatcatcaatttttgcttttggacatcaaaaccatactcaatcctcgaaaaattgcaaggaatggaaaaaaaaaaacctaaaggcaaccgaagatggagcacacaagtgctccccactcgttttttgggcgcgtgccgaacgaagaggcgttgtagctgcataattcctagctagctcgtcgtaggaacaccaaagttggggccggccggtcacttttgcggtggaaggaacccctgggtactactagtacgcgatacaaacacggatgattgcgtccttatgcgttttttcgcatgcacttcgacggatcgatcgatcgatggatcacacacacatcaaccccaaccgcaggccatcatcaccggcatcatggcagtaggaggcctcgacacctcgatcgctcagtcgttcgctcgcctgctcctctcatctctgtacgtagcccagccgcggcagcagccgccatcatgccgcatgattgcagcgagacaacggcccatcgactctgtccccattgccgcacatactatcaaacaggattgctcgatcgatcgatcgatcgatcgatctacgactactactaccactgtcagcagcatgctcgcagcggtggtcgtagtagttgtaggcacaacctgcatgcccacaacaatgatgatgatggcggatggccggagtgcatatgcgttggcctgcagtgcagtgaagcccggtggatgaggaattgatgatggccgtaatcatgcctgcatgcagaggagaagggaattctcccattcctggtcagtttcacatgcttccgcactgggcttctacaggtgtgacagtgtcttttgctcgttccatggaattatacaatctaattagcatcattagtcttcatgcaggccaagagaataaaaaatacacgcaaatccaacgtgctactgtacgtactagtactctccccgtctcattttaagtgcagctatgtttttccgtgtctaactttgatcgtctgttttattttaattttatttaaaaaaattaaaaacataagtcacgagtaaagtattattcatgttttatcatctcatagcaacaaaaatactaattataaaaaattttcaaataagacggatgatctaagttggacacaaaaactcatggttgtacttacaatgtgatggagaaagtaatatgctgcacgactaatcattctgtctttctttcaatttttccccctaagagagtgtcattatgcgtgtaatgcatcatgcgctatatttactatactctctcctagcctcctgataaacttaggctgtgtttagttcgtactgaagtttgaaaatttggttaaaattagaacgatgtgattaaaaagttgtgtgtatgaaatgcctcctgataaacttaggctgtgtttagttcgtactgaagtttgaaaatttggttgaaattagaacgatgtgattaaaaagttgtgtgtatgaaatgcttgctgtgatgaaaaagttaaaagtttgaaaaataaaactttggaactaaacagggccttagcatataatctattttatttaaaaaaatactcctaatggcagcacatagcgcttgtctcattctgaaacaagaaacgctggacataatcaaactagttgtctgaactccaaaaatactcctaccaaacactagtctccactacattaccactagtactcactcccaaacaaagacacaatcccaaggtcacaaaaaaaacccgagaaaaatccacgcaaaaatcctggaggattcaacaacagcagcagcagccattcttttatctttttaaaatataaaatatgtttatagctgacctatagcttgctatcgtaactgctcttatcccatccatgagcggctgctgcgtggccagctttctgctaaagattgcgggtgctatttttaaaaggggaaagattacgtaaccccagtgatgattacggtaattattgtcgcctgcctgctactagtactccactgtactaccaatccatccatccaaacccttttttttcacgtagccccccggcgaatccgcgaattgcagctcgccgtgtcgccggccgaccggggctttttcctttcctccgggtcacgtgcggcctcgtcaaccggtcaaaccccgccattatcacgcagccacatacgcgccggagggaagcgagcgagagaggtgtgaagtgtgaggtggtcaggtcgtcttcttccttcgctgctgctataaaacctcgcggcggcttgcgcgattacgaggttttccattgctgtgtgtgagtgaggtgagtgagtgagtgacggattgttgggagagatggagctggggttgagcttgggggaggctatggcggatgctgggagggagctggttcttgggcttgggatggggaggagggaggaggcggcggaggcggggaggagggatcatgaggtgaggagggagctggagttcgggtcgatgtcgagcaggtgcggtggttcttcgccggagccgacggtgcggctcacgcttctgcccatggtgcccggccttggcctcccatggccgccgccgccgccgccgtcgtccgagagcagtgagtgcggcgatggtggatgggtttttttggtggtggtgttgagatgggttggttgatgcgatctgtgtggttgggtggcagggcatttggaggcgtcgacgcggggattcgacgtgaaccgcccgccgtcgtccggcggcggcggcggcggcggcggcgcggaggaggagcaggacgacgtggccggggcggcactctcgtcgtcccccaacaacagcgccggatccttcccgatggatgacttctccgggcacggcctcggcggcaacgacgcggcccctggcggtggcggcggcgaccgctcgtgctcccgcgccagcgacgaggacgacggcggctccgcgcgcaagaagctccgcctctccaaggagcagtccgcgttcctcgaggagagcttcaaggagcacagcaccctaaaccccgtaagcttctcttcctctcatcgatcgaacaccatggcgtcgtcgtcgtcgtcgtcgtcgtctcgctctcctaacgttgcgtctcggttgcgttgtgtcgcgagcagaacagaagctgcgctggcgaagcagctcaacctccggccgcgccaggtggaggtgtggttccagaaccgccgcgccaggtgcgtgcacgcacacgctcgccgcgcacgacgacatgaatttccttctcccttctcgcgaggatctctaacaattttcggctgccgcgtcgtgctcgtgcaggacgaagctgaagcagacggaggtggactgcgagtacctgaagcggtgctgcgagacgctgacggaggagaaccggcggctgcagaaggagctcgccgagctccgggcgctcaagacggtgcaccccttctacatgcacctcccggcgacgacactctccatgtgcccctcctgcgagcgcgtcgcctccaactccgccccggccaccgcctcctccgccgcaacatcgtcgacggccgcgccgcccgcggcaccctcatccggcggcattgcggccacctcctcctccgccgccgccgccgcggcgccggaccacaggccgtcgtcgttcgccgcgctgttctcgtcgccgcgtggcttcccgctatccgtagccccgcaggcgcagccgccgacgagctcgtgactcttccaactctccggcgacggcgaggggcctgtttgtaaattcgctcacttttcttttatcgtttttttttgttttgctcctttggttctttgggattttttgtggcttgccaagtggtttagcgagaatccgagggggcagcgcgtctggccgtccgattgggacacgtcgacggcgcacgatgcttaaagaaaaaaaatgttgcaatagagcttattaacctttataatttctgcgattttttgttttctatcaacaccatggtttaaattttacgggtctcttgcaaaccaagagaaaattatgcattattcttgggtgtcctgccatgtccatttgttatagacttgctacgaaatcaaatgaatttaggcctctttgaaatactagataggaaaaaccacaggaataaaaagaaagtaagaattgaaatagtatgtttttctaatcctacagaaaatgagaggatgagctctttgattgcaccacataaacctaagatgtctaacactttgcttttttttttttatgaaattgaccatagtaatgaaatcctatgaaaatttttctatcatctatctatgaatcaaaaggactctatcggataaattattaggaaaaatgaatcctccatttcaaaggaaccttaacagataatactgtctctcctgcattagtgtatttttggtactgaagcgaaatgtaggaatcaagcaagaatgtgggagagcaccgacggtgacagttattgtccaccgcgcataatacgaacagtagacatacagtactaactacgtacggactacaacgttgtaatggtggtcccctctcacatcgcccgtaggccgttgtgtcgcacagccaccctcaaaacacttctacagatgaaaatgtgttggggttaacccaaacaggaggttaagaaaaaaaaatagagcaagtataataaggttagcttcaacagcggaaaaaggttcaagcttctctccgcataaaaaaaaaactaacctaagagggtatgtgttttctcttagtacaacaaatttagacaaataactgtctaaatcgttctactaggaggagtttttgggacggagggatctaaatcgttctactgggaggagtttttgggacggagggagtagagtagaagagttcaagcacttttcgttctactaggaggagtttttgggatggagggagtagagtagaagagttcaagcacttttcatcgatgtttcaaataccggttttagggaaaaaaatactgatccatctggctgaaatggacaagaaaaaaagaaatcactttgctcaaactattttaccacagcacttaccttttaaaggctcattttacttcctaacaatatttctttttttttctctctctcaattcaactctctattttacagtttggtaggatgatgatacatgtattataacttatgtctcaacactttatagaaccttttatgactgtttgcatgggctcaaagcatctactcactctgtcccaaaatataagtattttttattttgacacagtcttcgagatgctactttgatcaacaatatctataaaaataaaatattgtaaataaaaggagttgtatattatgatggtttaatgatagtttgattaatgataaatctagtaacatcaattttacatgattgatattttttattttttttattaatagtcaaagttaaaaatagttgacttgacactatgctaaaagtgcttatattttaggacggaggaagtaagattgatttagggtatgttcggaaccctgtgttcccaactctcccttctctttttccgcgcgcacgcttttcaaattgctaaacggtgtattttttgcaaaatgtttctatacgaaagttgctttaaaaaatcatattgatccattttttagcaaatacttaattaatcatgcgctaatggaccgctccgttttctatgctaactacttgtgttgggagcacaaggttccgaacacagccttaaacacaaaaggtcaaacaagcaatcatgaaaaactataaaaatattttttataactttgttaatggtgccatatatagttctacatatttgcccttaaaagataacttatacaaagatactactaaaagaaggagagaattgtttcagagtaaaattgaccaattctaatagtttcggagtgaaatgagaaaacaaacgatttaagattaagagcaagtttaatagtataccctactactgcttcaattcatctatagccgatctaatagctaattcatacaatagttgcttactatactattaatatatggaatcacctgtcatatacatattgtgtcttagagtccgtgctgcagctggctacagatctgtagcccgctgctattctctcttattttttatctcatta

SEQ ID NO: 48401 - DNA, 25547 bp, Oryza sativa
  unsure (1)..(25547): unsure at all n locations
atacttggccttggattagggagatggccatcaagagcaggtacaatagtaggctataagccagctataaacatattttaaagagataaaagaagagagagaagagcaggggactacagatttatagccagctgcagcacggactccaaaacgtaatatgtgtataacaggtgggaccatgtattaatagtacagtaaataaatattgtataaattagctattacattggctatagataattttaaactttctctaagggcgtacagtaccttccgtctgttactactattgctgataagaattcagactccggcgagaaagaacgaaccggtcaaaagcaacgatggccatatataggagtcaaatgtcacaggatatgagccggagattgagctctcggagtccatgtcacgcatgactcagaggccggagaaacggcacccgagtccatgtcatgaccgagagggcatcgccgcatagcgatgaatgccaaatcatttactcgatcgatcgatcgatcccaagtccatcgagcgatcgatgagatgagctgaaatcgcgtggtcgtcgctccatcaatgccgctcggaaatgctggccggctgagctgaccggtaggcatgcatgcacactcacaatctcacatcgcccatcacgaggtgaccaaaggaagagatgatgaacaaaggctgtgtttagttggggaaaagaaaatttttgggtgtcacatcagacgtttgaccggatgtcggaaggggtttttggacacgaatgaaaaaactaatttcagaactcgcctggaaaccgcgagacgaatcttttgagtctacttaagccgtcattagcacatgtgggttactgtagcacttatggctaatcatggcctaattaggctcaaaagattcgtctcgcgatttatagctaaactgtgcaattggtttttctttttgtccacatttaatgctccatgcatgtgtccaaagattcgatgtgataggtgaaggggaaaatttttgggaactaaactagcccaaaggcccaagacttgtttaattttcagctccccaatttattgccagtgttgcttacggccgagggaagcgagagagagagagatgacatcggactaagattggactaatcgagacccctcgacttgatactgcgagtctagccgatcatcatcgtaagaacgtatgcttagtccgagtttagttccaattttttttcaaacttcctacacacgtaaactttcaattttttcgtcacatcgttctaatttcaactaaacttctaattttgacgtgaactaaacacgcccaaataccttaccatgcaatcccagataaaatttaaaatctttattgtattctatattccagtattgattatgaacactattttaaaaaatgcacatacaagtcggtactatagatacaagaacaactaaaaccgacactctttttccccttcaaaagatgaaaaaaaccggcacctttaatacactaaactaccgtaaaaatgcagtttgagagttgcccactaaacctttttaatagtgcttatttttttttcttctcgtttttagccattgaacttaataatactcactcatagtttttcttttcaccatattaataagaggcatttgcaaatttgccacttgttttttcaattttgcaaggatgccactcgaatgacagttccagtggtatttttgtaattttttagtggcagttttgaaataatgattaaaagcagttgtaaattgcaattgcccctattaataaagggcaagttagtcttttaatatgccgcttaatatatgtctttaactagataaaaaaactatgctcttttaaagacaagggactatgtttaagttttaaccataaaatatactcactcatttccaaattaatcatcatataatagaatccaaaaattctcaaattgatcatcatataaccgcatggacacaaatttcatcgaaatacaattaatttagcatggaaaaatatgtacatgctagggtgtaattagcatggtattttaatcgatgcatgcattgtaggagaatgtatacatagtatcttgatttatgcgatttaaattattcttggtcttggtgtataaacatatatgataattattttgggatggagagagtatttaggggccgtttagattgtagccaaaataaacataccaaaattttggcaagttggcaatattactaaaattttagtaggatttcttatgtatttaccaaaatttagcaacaaactaaacgtagttatttttttaataattttataaaataacggtatggttgaaaatgatattaatatgaagagccccttaattacttcgtttatttttctggggttatccacaagtcattgatgtgcgtggttcagaaatgatgatgaatcggtatcggtcgaacagtgcgtagattttgttcaattctacgagggatgataaaaggctctcctgatctctgcatttacttggaaacctttagcttttgattaggaggtctttgttgcaattaagcttcggtgaacactaacggttgcgctaatctcatcgatctcgacgtgtgccttgctctcaagggcgccgattaccacctgtctcccatgctctgctgaaggcactgtatgtgatcaaattccacaaattcctacttagtaaacatagattaggcagctacaaggtgtcaagataaacgatgtaatgttagatgcgtacatgactacatggtgttgttttctcatcacgcctcaaccgaacatctcatattcacatggaaaaatttgacccatgctatgtttagtttctgaaaaaagttaaaagtttggaaaaaaaagttaaaagtttatgtgtgtagaaaagttttggatgtgatatgatgtgatggaaagttggaagtttggggtaggtggggtgaactaaacacggccccagtttaaccaggacgccgctgcggttacaacagtctaagcaattcaaaatttataattaatttgatcactggaatgactaaaaagaaacttttcttctttgatttaagtatgctaaacaatgtagaaattatgagtattacacttgtacgttgcagctttgaaacccggcccactggccacaggagagctctcactgctgtcccaataattatgcagcatagtagctagcagcttggccagtgacagtgaatagtgtgtccgctgcggccaggccaaagtgccaaaacaacgtcgtcaagtggcacgcactgatgatcaggaaaccatcaatccttcagaaaaaaaaaggctcactcagtcacgagcagcagcgagcgagagaagggccccttgatcatctccatcttgtccctcgggggaggcagtctaattgggaagttgcatcgtgtctccttgcccctctctgagatgttcccctgctactgctatatagctagctccatcgatcgcaagctgcagcaacggccacttgctgttgcctccctcttggccaccattgctgatccgctgctgctactctgctagttactcactgtgacaggttggattttggacaggtcagggtggctgtttccctgtctgatatctgcctttttgctgtttgtgtttgggaggagagagtctctggataacgagaaattaattaacgtgagtggcttgatgtgatgccctaaagtttctctcattgctgatttatgtgcactagtcgatgtgataattaaagtactagggtatgtttggtttggtatcatgataaaatgtcgatgatgctaaaatctagacaagttttttcgttgtgcaaatttggacaacttgtgtgtgttgttggcacattttgatgacgaaccaaatattagcaaaagtaataactaaaatgtcaacaatttgatagggaatattttggcttagagccaaaatggccttattctgtccatttttaaatggaaattttgagaaataccacgcgagatgtatgagttggaaaacaccaccacatgggacccataggtcgttgacacatgtgatgatatttttcaactttgaaatctttgcgatggtactcttacatattgtatttttgaatatatggcgtcattgattttaggaaatgtcgatcattagtcttggtgaaaaattcaatactaatataaaaatataaagttatgcttaaaatacgtttatgataaaacaagttgaaaaaaaaagatacttacctagtttttcttaataaaatgaatatttttagaaggaaaataaaacgaataatcgaacatctatctattatattattaagacagctcgaaaaggaggcaccacgttcgctgtgaaggctagaaattttcacattaatcggagaaaaagaaaaaaaaagaaaaggagagtccaagtaggaatacaatataaaaatagctgaaattcggaattaaaaataagcaatattgaaagaagtttccatataagaacccaatacgagattaatccaaatttgaaataaaaataaaataaaatccaaaattagaaaagaaaaagagagtccaagtaggaatacaatttaaaaatagccgaaatttggaattaaaaataaggaatattaaaagaagagtcaaaccaatatgagattaattaaaatttgaaataaaaataaaaataaatcctaaattagcaaaagaaaataaaagaagagttaagtaggaatacaatttaattaaaaataaacaatattgaaagaagaatccatataagaacccaatacgagattaattaaaattttgaataaaaaataaaataatatccaaaattaaaaactaaaagagagttcaagtatgaataccattttgaaaccactgaaattgaaataaaaaataccaatattaaaagaacataatacggtattaactaaatttttttaaaaagagtaaatttcacaaaactgcagatactatgaccaaattatcacaaaactacagatttaactcgatgtatcacaaaactacacatttaacaccaaatttatcacaaaactacacatttaagatgaagtgtcacaaaactacatatttagtaactaaattatcacaaaactacaggtttagaatcaatttaatcacaaagtattgatgtttatagctccaccataacaatggtgctagggatttaaactccaaaagttatagttttgtgataagttcaatattaaatatgcatttttatgatacttaatctaaaatctgtaattttttgataaatttggtgctaaatatgtagttttgtgatacaactccttaaatctgtagttttgtgataacttggtcaaaatacctgtagttttgtgaaatttactcaaaaaataaattctgaaattagaaaaagaaaaataatacttcaattaggaatacaatttataaataactaaaatttgtgataaaaataaagactattgaaagaaaagaccatctaaaacacatgacaagataaattaagtagcaggtctataaaggagtagaggggtggcggttgatacgacatataaaaaatattaataaaacaccaaatagaatcctaacaatgattaaaaggagggacgtcaggcaggccgtgaagcaaacaagtaaggcagttgctaggacttctagaaagtaaaaaaaataaaccccattgataatcatatttgatttttaaaatctcaatgacaataaaaaggagaagcagagccgccgacggttgacaggacttctagaaaataaaaaatgaattccaacgatagttatgttagatgtttagaatcacaatgacaataaagagtatgcggcggacgggttgtagagggggtatagtggcatcgtttgatgggacttctaaaaattataaaaaatgaaactgcaagtccaatttttaaaggtttggaacttccaaaaagtaaaaaaaaacccaatgataattatgttcgattttaaaatctcaatgacaataaagaagggaggcagcgggcgagccgtagaggagtataatggcaaagccgctgatggtttagccggacttgtagaaagtaaaaatgaacccaaacgataattatgttcgatttttaaaatctcaatgacaataaagagaagaaacagtggacgggccgtagaggagtataatagcaacgtttgacgggacatctagaaattataaaaacgaaacccatcgtgacaataaactctaaaaactataaaatccaatttttaaaggttttaagaagaatgaatagaaatagtggtagatcgagtaagcaaataaaaaagaagatgacgtaaggaatagcaactggtgtgaatttttaaaactatatatagttagaaacacgaggatgataaggtttggtcttttaaagtcttaagacaatgagatagctatttaataaattttaagtaaaattatacttaaaaaaatatatgattttatttgggtgctagccgcgcaattacgcgggccacccagctagttaggtttaaaagttaacttcttttaataagatgaaaaataaaacattatgcctaaatgttaaaaaaactttatttagtgagaaacggaggcagttatttcccgtattggtcgatggacttcagtcttacaagtgcaaaatcaacatttctactctaaagacaaggagatctatttcaggatttgattggttaagaagcacgtaatggctatcagataaaattactctggtagtactgcaagcatgcaggcacgcactcatggccatgcacagaaaaatgccgacaatgatcaagcctttttctgggacagtttagtacacatttaggcgacccgcgaagcacaccattatggtaggtccagcacattagcagaccagtgataaagtgctcaaagacgattcagatcacgtccatgtaatgatgtccatgagatgtgtgtatcagtattactgttggtgatagtgccagcatgcaattgcttgttctaagtacccagcctgatgactgtccgttatgagcaataatacaagcaaggacagggttattgatcattggtttgttgcgttctgtaatctgtagtagtagcagcagcagcagccaaacataactttcacagttcacttgcgatccactgatgtggccccacggcttaaactacttgttctaaagttgttttaaatatattttttaaaatatttaatttatcctataatcaagcagataatttgtattaataatatgaaaggttttactatgtttgtgaggtacttagaggtattgagagctggagtaatatagactgttgatcaagagaggggcaatgtatggaataaaaattatcataatcaatggtaatgaagtaattaactagtgaaatattgccattattactgaattgaatatcttgctttgttgatcgttaatgtacgatagagaaaatgtaaatctacctaggcatcgattagatctacacggaaaaaaaatcaggttgtgtcttctttctcttctcccacatcacttcgttcttactggggtttgaattggttcactagaaaaaaaaagggagaactgtcaacatggttgaggattgaagcggagatgaggtcagccggtcaatggcaaggcgaagcgcatccgctaagattccatttatgcagttgattagtgatttatatagctcacaatttcattcatataagagactggaatgagttctcctcccctattcttcttcttcgagtttttgaataggtgcactcgcatggagacacagtcatcctggttgagcatttgtgcaatctacaacgaatgtctctggatatttggccctgtggtgcagactttagggcaattgcaggccttttaatgtggcatgcaatccgtggactgcatgcatgcacatatatgcccaataaatggacatccaatcaagaggtggtttccattttattagatatgaggtaaatcagggatattgttattttggaatcaatattaaaatctaagtgtatggataatattataaaatagttatttaattccctaagacatataaaattttgttaattagtgaattctacaaaaacatgtaaaaaacgaaatgaatgattaccatgcgaatctgttcttaagaaaaaaataaatataaaaaagaacacgtaaataatgtcctagagatgataactaactgtacctatctatgtacttagaactaatacttaagacaattatacgcttatctatctcctataaaattatctttgtaccattactacctaagtatctgtgctaatatttaaatatcttttaattgatacattttattgtggagcgttagatttttaccttttttttaaatgcaaacaccgtaaaacctctctaacaatataataaacaatttatttcagacaggactattcattttgtacagttgaaattaaaacaggaaaaatttgtgcccaagtgaataacacacgccaaaacgatgagacacatggccctacgagttacttccccttcccctgtccaaataaaccaacttctgaaattgaaatcagaagaagttgattctttttaaagtcaaggcgtgtaaacgcctaaacggtatgcatcagatgattcagatctgacgaagccttccacagttagctgtcactgccatgacgcggccaataatttccttcgcattgactgaacagcaattgccatgtctgccgccgtgtttagttactaattctttaaacttccaactttttcatcacatcaaaactttcctacacatataaacttacagcttttctgtcacattattccaatttcaactaaactttcaattttactgtgaactaaacacagcctgcatcgatcgatcggtacctgcaccggtgggaaacgcctttactgccattgcgaccttcttccgccggccgtccggccacaggcccgcgatgaattttcccggtcgtcggcgacagcgacggcgagcgaccaccatgcatgcgcccgctcgaggaaacaggacacgggggcacgtgagcccgggtcaatttccggccactggcgacgccctgtcggcgagggccttgtgttgacggattccggcggcgtgttcgcccgtgtgtggtggctcgatcgtacgccgctctcgacttggccggccactggtctcccgggctttctcgcgctttttcttgcagaggagcaagggttgcaatccgacgtgatggagattggagagttggtgatttttttctgctcccattttgttgcttcttcaggtgtcagtttgcaacgatttttttgttctttgttgacattctagccggaagcccaatatgatggaatgggtagaaagctattatgtgatcttgggctgtgatctgtgtagccattcggccattactagcagtagcaaacagttcacccaatatcacttgctggaggaaaaaatatgtttgatttttaagtgaattaaaattcggttaaatcaaataaaactagtgaggtagctcattgcgtgggtagctttatttactgtgtttgtatttgcttatgacattgggtttagttttagagagaattcattatatgccaccgagtttaccacaagcctaccaatatgccatcgacttttgcttaacttctacaatttatcatcgtcatctggttagcctccgttagtattatataattttattcaaatgaccaaaatacccttgagacaaaaacttccaaaatttagacaaaaattctaaaaaatcatattattaacatacaattttatgttaataatatgatatttcagaatttttgtccaaattttactactatctctgtttcacaatgtaagtcattctaacattttccacattcatattgatattaatgaatctagacatatatatctatttagattcattaactcaatataaatgtgaaaaatgctagaaggacttatgttgtgaaacggaggaagtattaatcactgaatttaatatcatattataaacattgtatgatatttttgaaatattatactataattataatatgatatttcagaatttaatagcaaagtcaccgatccaaaatgcaataatgcttttcttccgttacatcgatatctcaccttctgactttgctatgaatcagtgctaaaaataaataccacgatatttcgcagggttctcttatggaaatgactagccccaaacgaggaatcgcaatgggttatcctgccctgattgaggatgacatgaggatcaagtcagcaggaaagcaagaagacgatcagcagctgatcgatggagtactaggcatccatgagctagctacgcagaaaatgctgcagaagattcacgggtcgcatcgatggacattgtggcgcagtcgacatgtccatagaattcttcccaacgcagtggaagccacggttgagctcgatcatcatatcagatgttcgcagctgcttcgatctgtacatcagctcttatgccagtggattagctgaagagtttgagctgtttcatggcgacattggtgagccatgtgggttgagaaggtttgtggtcgctgtgacgctggatcgcttgttgcacttgagattttcgttgctgaaacgaggctccgagaggtctgaagaagtcgcgtgttcgttgacagcgcagaaatacgggtgtaaaacaaatgaaatatatgttggtccggcctcattctcgtgaagattacttggtcaaactgtgtccctaaattgtaacaaaattaattcgtccggccaaattacgtggtgatacttactaatttcccgcgtttatttttctatatgcataggttaaatttggactcatgtttgcgaagtgataacgttatgttgatctatcccaccaatttttatttgcagaaaatcactttgactttttttaactaaatgaaaaactagaaatatctcctcaaaagacaaatataccttttcccatgaaataagcgagatcaatgttgcagaacgatgcattgtcctgtgcatggtcgatctcaagggtaaactcttttaatcactcggggacattcacccgtttcttatatataaattaaatagttatatttttttaaaaaaataacaatccatttcttatatgtcaattgaatggttatatatttttttaaaaaaaaacaagatagattcgtatgtaatatatcacttgacaaacttgtaaattcaaattcaactatttataagttataaaaataataaatttaactataaatatacatatactagttagagtttaatttgttattttttaataacttgtattagtcaaatttgaatttattttttttaattatttagtttatatgcaaagaaacgggtggaggttaatccatctttcgatctcaagcttggtttctgcagcttcaccggcgagctgatgcgcgcctctgtctgcaacctcagtcagcctactagtctagcacttgagcctcatcttcttcatcaacctctctgtctcgtcggcctggtcctgctccgtcgcggcggcgccggcgccggcggctggccggcaggtggtgatctccgtgacaccccgccgcttgtggagaagcctccgcatcagcgcggggaggtccatctcgctcctgatctcatccagcgcgttgcgcacccggaggatctcatccaccttgggcccctcgtagctgctcgtcctggccatggcgagcagcgcctcctccagcccgatcgccgcgccgaggcgggccacgatcatgtccagtatcgccagcacgccgcccccggccgccgcggcgtcgccgtggcccctggggacggcggcggcggcgccgccgtcggcgcgggacaggtagagcgtccccggcgagacgctgacgctggcgcggccgaggcggtggcgcggccgccacttctgcttcggggacgtgtacctccggtacgcgcaaaccaggctgtcgccgccgccgcgcgggctgtcgttgagggcgacgaggcagtgggcgcggctggcgtggacggtgagcatcggggagcccgggtcggcggcgctgatctcgaccacgccgccgtggtagccctcctcgccgcgcccgacgatgccgagcgcggcggcgtacgcgtcgtcgatgatggacagcgccatgccgtccagcatctcccacggctggtgccgctcgatcagcgccatgtcgtgcgccgccgcgtgcacgctctgctcagagtgatccattgccccacgatccgccggcgtaaggaaattggttccctgatatgcgcgacgcggcgtgtcccggaacctagggcggatcggatagccgtacgtaggcgagacgggctccgattccgtggaggagaaggacacacctcttctttcgcggttcgtttgctttgccgcgcgattcgctgggttcgcgactggccatgcgatgggatgagatgtcggcgatcgccgccggcgaggcgcggtggcggtggcgggtggcaggttgggccggggtgggctgtattcctatcgtgggctttattggtgcagacaagcagagctgcaatccgacgatctttctaaaaaaaattttggacctttaaaatttttaattttaaaaataaaccctcacaaaaattaaatacgaagattttgaaaaggttcgtatttcaaaatttttggatttgtattaagctttgggagtgctcaattttaaaatttaaaattaatttaaaattaaatttaattttaaaaataaaccttcccaaaaattaaatacgaacttttttaaaaaaaggttcgtatttcaaaaggtttggatttgtattaagttttgggagtgctcattttttaaatttaaattttaaaattaaaaattaaaatggttagaaaaaaagttacaatccgaagtgagagacgatggagaattggattggaggtggccttgtgcgttattattcattttcatttcttactcgacattgctcttctactttctggcgtcagcttgcaacaatttttattctgaaattcttgcccggcctgatgggatggatagaaagccattcttgcgatctgtgcagccataacttgccagttgccaccagttcgtcgactattacataatagggaaatcaattgtttcaatattaaacaaaaattttaagtgaaccaaagaaaattcagcaaaagacaggaagaatcagagaaagcatgttaagctgaaacatggggcattggaacagagtctgaacagtatggttcgaccacatttactgatttacagtcaccaagaaactcaaaaagaaaaatgtattgctgcacttgcaggaagccactgaggctattattcagctaagggaatgtcccaaaatttgcaactacacaattgtgccccaaattgcaatccattccagaaacgcttatgacagacccatgactttgccagtggctgtgtcgacgtcgatttcgtagaagcagggccttgtaggaagaccaggcattgtgctcatggtgccaaccagtgggtagatgaaaccggctccaatgctggccctcacatccctgataggaagcacgaagccagacggcgcgcccttcatggatggaacatgcgaaaacgagtactgagttttcgccatgcatattgggaggtttgagaagccttgcttggtatacatttcaatctgcttctccgcctgcacggaagtcagtcagtcagcagaataaagcagaatgttatgtgttcagtgtatctgtctaatgccattcccacagcatgttcatcagtgtcaaaagcatgaacatcaggggattcctctttcagtgtgaaatgaaaggcatgggagaaagatagtagatacaatctcaaacacagtaatcagaataggaggtagtagcaaggatacctgttcagagtattcaacgccgctagcaccatagaacttagctattgactcaatcttctcctttatgccagattctaaaggatacaaaaatttcagagggtctgcctggctctcacatgcccgttgaaccgcgagtccaagatcaacctgaaaacaagttaaatggtagaacagacatcagtttaatgctgacgatttcaaccttcacactcttcgtagatggaagaaataagcacagaattcccattaaaacaatatgctagacaataatggagaaataaaataagagatgcatgggcgtcacatatcataacactgtccacagtttataacttaagcaaactggaaaacctgccaggagcacaattattttgaggcaaatttttgctaggcatgaaagagcaaagtcacaaagtttgtaaacataattaggtaaaacataagtaccagaacacaatttactgattcacaatcaaacattgcccataaagagtggaagatttagttaaaaaataggtcaagatgtatagacatgactggattaataattaatgcaatgacagaaaactaaccgctcctttaccaccatgcgcatggtgagtgcagacaacagcatcaaaagcaccagcagccaaagacgcatttcgcaccacgtccatttctgcttcagtatctgatgcaaacttgttgattgcaactacaacattaactccataactctttgtgtttgcgatatgtttagcaagattgacgcatccagcttcaacaagagccacattttcactcacatatgcatgatccaaaggcttcccagccacaacatcagggcccccaccatgcattttaagagctctaattgtggccacaataatagcacactgaggcattaatccactatatctacactttatatccatgaatttctcagttccaatatcagaaccaaaacctgcctctgtaactacatatccacccttcccaaccaacttcagtgcaattttatcagcaactatcgaagagtttccatgagcaatattagcaaaaggtccagcgtgcactaacacaggagtgccttcaagagtttgcatgagcgttggatggatggcatctttcattaggacagtcaaggcacccccaacaccaagatcatcagcagtaataggctcacctgccttgctgttccctatcaccattcttccaagcctttccctcatgtcagcaagggaagttgtaagagctaatacggccattatctcactagctacagctatgtcaaagcctgtttctctcaccatacctttttcatcagggccttgtccaatagtgatttttctcaggaaccggtcatttacatccatgacccgtctccaagtaatggattcagggtctatgtcaagtcttgcaaagcgtctaacttcatctggagtaagctcattaggatctgtctttgagattccaagctttatcaggcgtctgagcattacatcagcaaagcgcctctttccttctttgtttggcggacatagtctattgaacagcgctttgtctgattgtgaagcctcatggaaaatccttgtatcgatagcagcagcaagaagattgtttgcagctgtaattgcatggatatctcctgtaagatgaagattgaactcatccatgggtatgacttggctgtagccacctccagcagcaccccccttgattccaaaagtaggcccttgtgatggttgacggaggcaagtgacaacctataatagcaacattaatattgagtaaagtagtaaagcatatcaataacataatatatactctataaaaaaataaacataatatgtacatcgatatgtcaatcgtttcaatatgctctggaatgcataatatactctatgtatcagtatcaacattcgccacttatactacgttcatgatggttagagacatataaagaaccatgcagtctatcatgactgttacaagaaacaaataaagtcatcccagacccccagaacagagcattgtatcaagtatttaaacattaggattttgtttttcctgaaaattgcttggtgagagagaatttatcaacatgactcttgcaggcaaatataaataaacacagagagttcagttctaccatggagttctgacaatgcaccaatgaagatttgatattaataagtttgacaaataaatcaaaccaaactgacagaattcttgattccactagaccactgcagaatttaaaaaggacagtgcctgcatccaatatacaggtgctagtgtgctactacgacagcataaaaagacttaaatctaatcaacaaagctcacaggctgatactattgtgccaagcaaactgattgtttacctcaacaccaatcacaaactttatctataaccaataagtaaccaagataccctgtcgattatagaacaagcgaaagtggcatggaaagcctctcacctttttatcaagaaacgcacccagcgcctggcacagcccaacggtggtggtcgacttgccctccccgagcggcgtcggcgtgatgccgccgaccaccacgtagtacccatcctgctgccctttcaactcatcaagaacagacagcaacacctgcaaaaaagaacaagcgaaaaaaaaaatcatcaacaaatcgcatcgcatcgcgcgacaacccaatccgcatctttggaagcggcgcacgcaccttggccttgtacttgccgtagagatcgaagtgctcggggcgcaggccgagctccgcggcgatgtcggcgatggggagcggcgagacggcgttggcgatgtcgatgtccgccggcaccggcgacgccacgtccagcctccggatcgtcgggctcggcttcggcgtcgtcatcggcaccaccagcggcggcggcagcggcggcgcgacggcggcgctggatctcacacgcagcgagcggtggtggtggttcgagtgcgagagcggcggatgcgagacgactgaatggcaattgtttattgccgcacgacgacgatggcatttgataatcgaggataaagatttcggataattggttggtgggacagacacatccatgacgcaaacacctcccccaaataatacagccacaaaacccctcaaatatcccacctttttcacttcaagattaccaagaaccctcaaattcctaacctttttcactgcaagatatttggggccaacaccaagaaacacttctcactgtactgagctttatacccttcctgtgcagccccaattcttcgggagttgtggatctgggttttgggaggatggcaggggttttggctgctcttatcttggattggttggatggaaaatggactgcaatccacaggagaagataagggttttttgtgtggagatgcggatgtgagcgatgatgatgttgttgctgggttgcaaacggtgatgcgtgcacaagattggggcttttgaaagagccaagtgtgtgctctttttataggtgattttgcttgagattttgggaacagttcatgaacattgcatgtgaaaaaactctactggcgtgcacgtaatgcagtgggtgaaaagaaaaaaaaaaggaacttttttccctttctcttcttgtcttcgttgaacattgctgtaagcctgtaactgcattggagttgatatgatcagtgagctgtaggacacatcatctctggattttgctgtgacaaaaagaggatctcatgtcccaaccacactcaagaaaaagcaagtaatgggacgaacaatctggtagagagtggtccaaaccacgtccgttttgcttggtttgtaagcgtgattcccttggattttgaggttttggggaggtcaattcccctgggttttgaagggtttaggggttcattcacgagggcattgaggcagataagaaatgctagccaaccatgctccatgcatagggagacgccttctttttctaatcctggattagggatgccatggtccatggcatgcattaccagacgagttggtcaactcatgccgtttgatccgggcgatttggatcttgggacaatgaggcccgttggtttactctgaattttttccttggtgaagcccaactgaaaagttaggcctaacagtttgatctgacgttcgatgggctgttctacttctatcccaccgataagggctaagaaacataaagaaccatttatttaaatttgttaataaaattcaaaatagaagtttcagaaatatcattgtactatctgagaattaagcctcacgaatcaacaacatacggcaatctttttttttatctcccaacgttctcgatggtactgagcaaattgagccaatgtaaaatgttacagtaccattaacaaaaataacaaccaaaattcactatgtagtattgacatgcatacaaatcaaacgaaatgaatcggatcaaagaatggtgaacatccagcaagcaacaggagcaatatatcatccattttagctccgcgtacttgtcgcaacaaatcaattcaaacactggcacctctcctctctcaatccttcttccggccatcgacgacggccaccacgggcgacggctccccgccggcgggcatgtcggagagcgcggcgagcatgcggcggacggcgctgacggagcgcgccggccgccgcggggcgccgccgccctgcaggctctgggccctggagaagacgtccgacgactgcgcgaggatgaggtacaccagcgcctgcaccagcacgaacacccacatcttcaccagcgcctcgtgcgagctcgccgccgcctccattgccggacacactcttcttctcgagctccggtgacacaaacgtacgcaacaagtgcgagagcagatcaatcaacttatcaaccgaatcttcgatcttcttctgctgctgctgctgctgatgcttgtgtgattgatttgtgtgggggaggatcggattgaagctttatatatatagacgtcgatcgacgacgtacggtcgccgggtttgaccgtggccggaggccggaggcgagcgttcagagtgtgcagagatgcttccaaggcgatggcgagttgaagtgttcgacgtgcgcacgagttcgcattggtgcgcgtcgtcgtcacgcgttcggtgaaaaagtatatcgagtttggcgcggccgtcacgggtgaactcgctacgtgagccggtggtggttgtttcgcgggtcaatggtcctccctgtcactgggattagaatgcaggggaaaaatactactccatccgtaatatttgacgccgttgattttttaaacatgtttgatcgttcattttattaatttttttattaattctttttctatcctttgattcattgttaaatatatttttatgtatacatatatttttacatatttaaagagaaatttgaataagacgaacggtcaaacatatttaaaaaagttaactacgtcgaatatttagagacggaggaagtacctttttggcatatatgtttattttttaaatttgtttgactgttcgtataaaaaataaacaaatgtataagacatgctgaagggtacttttggtgtagtagatctaatgttactcttttcactttacttataactaagtgaataaatatttttgttaaactctgagagaaaaagtcaacaatatcgtagtttacaaaatcgtctgtaattgtccaagcaactttatatagtgcacaattgttttcacatatctatgaatgtaccccctcaatatatactcaaagagatgaaaaccacgattaaatcttgacatcactaaaatcctattgaaaaaggcgttgtggagactagataattaatagtcttttaagtggcctgctactttcttcgattggccagccactatctccaaacgttgacaacatgctaaagaaatggaaaccatagtcaaatcctagcatcattaaaatcctattgaaaaggtattgtcaagctcggacaactgatagcgattttcagtgacctgccactgtatccaaacttcattagcaatcggcagtagaaacgcaatggcaaagcctggtttgcctcctaatcaatatgggagctggcttggacatatgtgcaatatctgtagatatagatggccatgtgggctgcccggcacggcacggcctaggcccggccatgcctgggctgaggcttgtcgggccggcacggcccgaccgatgcaccgggccatgccgtaccagtccacgtgccacgcccaggcacggcccaacatgcgtcgggccgtgccaggccggcccgaaggcacgatgggtcatcgtgcttttcctcagaataagtctcattttcctccctcctatcgggctgtgacatatatatagctaaaaatagtctattttacctccctcttctttgggctgtggtatataaatagctaaataagtctatttaaggtccctattctttggacaatgacatttatatgtctatttttagtccctacactttatgtggcgggcctggcctgccggcccatcgtgccgtgtcggatcagcccagcgtgctggtagggaggcccagacacggcccgtcggtcgagccgggccggcacgggcccaacccaagtcgggccatgctgtgcttgggccagaccaaaaagccatgccgtgggccgagccttcgggtcttatggccatctatatccgtagaccgtagtcattggggtttaaaacctattggattggagtcatgcatgcacatgcatgcctccaattttataatggttgattgaggaataaataaatgggctggtaccttgtcaacttatctttggtaaacacatcttaacggggaaaaaagttattggtcatttcctaaaaactgtgaaataatttactgatcgatcaatttgtttattttagacgtacggtttgattcctcgaaccgaacttcccataagcaaatgattaagcaaaatagctttttccatttgcctctagagctcaacgtttttatttagagaggttcatccgtgctgggaattgattacgaccgttgatcgtctctaatccaatgcatcaggataaaaggtatgatggaaaaggtacttaaaaggtgaaccaggtatagaaggtaaaaggttaaaatggtaattgattttcatggtttatttgtaccattaagggcaaatacatacaaacaacttttacctacctgttcacgtccgtttcctgatccctcgatctcgggttgagtttagtagaggctgcaactgattaatcaccgattagtcggatgagattagcatgcaccggcatggtgcttaattagtttctcaacgtggctgatctgcgtaattaaatgctcaacaattagccacaaaatatcttcttcgatcatatgctagcagcttagaaattaagcgcatcaatttcgcaaggaatcaattactccaatcttttcaattccatttaacagcttcacaacaatgaatcaatgcttcagcgttctgtaatcatcagcaatggccagagtccagcagcagcagcaacaacaacattacgcaacattcaacaacaatcagatcaaccgccgtacgccctatgcaccggcgctcagcatcagcacaggatgccactggccagcggatgggtacgggggttgaggaattactaatctaccctagttaacaatattttttatttctaaattatcctttcagaatcaacggttgatattaattgacttaggaggtacccaggtacctcccaagcattgtaaaacccctcattaatttatttatcattgctgcacacagtcacttacgcggttacacgtgcagtgaaaagtaaaagctaagtacgagtaggacacaaaactttccgtgtcgttgctgagtcagctgggatctgatccaaatcaaaatagatcagaggtgtttggtagaataactttcaaagctccaaccaagacaaaatactgttagtaaatgatagtttcctttatttgtatggtcaggtttctttgaagtttgaattcgattcccgtcgaaataacttacgaaatgtttgcaagtggtagaaccaaaaatgatctaggggcagggcgttgatttaggagatccaaggtcaaagacaacattttgatgtgtacttaactcatgagatagtgataggtgcatcatatgctcgtagagtcgggcctagacgacccaaactgtgagcttaactcatgagctgcagatttacctgcgttcgagaaaaaaagctgcagatttacctgcatatcagcaatgtaggagtaacaacgaatgcttagcctcactaatcaaagaaagaatccgtatttcttgacaaatcgtaataatcccatctccaaatctgtttaatcacagactgttgactgaccttaggttgtgtttagatccaaactttgaatccaaactttcaactttttccatcacatcaacttgtcataaacacataatttttcagtcacatcgtaccaatttcaacccaaacttacaactttaaaaggaactaaacacagcctcaatatagcaattggtatttgtaatttgtgcctgtcaccagtcacgactcaatcagtgtgttgctgccgctgacggctgatttccatgtaattaagcaacctgcggcaaatcctcctgatccggcgttctcccggcagagaccgccgccggtgatcggtcgcagtcgtcgtcgtcggcggcggcgatggcacggcctcttggtcggtctccgtcggcggcgaccatggcggcgcggtctcctcagtacgcatcgggacgctgcggcggcagaccgggcaggtgtttcgcagcgacagccactgcgcgatgcagtgggcgtggtacaggtggccgcacgggagcctggacgccggcgacgcgagctggagggcgtcggtgcagacggcgcaggccgccgccgccgccgcgtcgtcggagacggtgacagtgatcaccgtggccagcgccggtcgagacgacgatgggcctgacacgaaggaggagtcgtggatggaagacgtcggtggaccaccggcgtgcggcggcgtgtcaggatcggaggagatgaagtaatccgaggagagaaacggcggcggcggaggaggaggcggcagcagcagcagctcagtggagaaggacgacgacgacgacgagggttcccgccgtagcagcggcggcggcggcggcagtagctctgtggaaaaggacgatgacgacggcgaggctacgcgccgccggagtagtggctttgccggaagcgtcggcagcggcgggggtggaggcggcggcagttccagctctgtggagacgaacgatgacgacgacgatacgcgggagagtggcagatgcggcatcgccgtggccgaggaagacggcgacgaggggtggtcgtactggccaaagaagtaatcccatgtctctaagtccgggaatggcggcggcggcggcggaggcggcggcgagcggctggccatggcggcggaggtggacatggtggttttccacttgtatatcaggggatcgatctcgttggctttggtaaactgttttagcagccagtggtccacccgtttatagtatgtcatctaaatagttataaaagatattaaaaatatataaataagatagatcaatatgtaatatatatcaatcgtaaaatttaacttctacagtaatctatagaagttgctgtagaagttgaatttgaatttgtatatttgtggagtaatatattatatattaatctatcttatcaaattttttgaaaatttttcgtaaccatctagttgacataaaataaattggtggacgtccacttgagttagaatcctctccccgttggcttttgctttgctttttctcttgcgcgttgtgctgctgctgctgacgatacgggtgactggttcgcgcccttttttttttctctcccgcgtttttgtgacttaatcacgaagaacttcgacgtgaatggccaatcaaaagttaatcccacttaattagttacgtgtacttacatggttgatgggtgcacttgtaattaacctctagaatatgatactgcccatatgaatggataatgattgtactactactacctgaatcttggagtagagttatgaaaatacagtaacacatttaacagtttaacaccggcagtgacgagttagttatctttttccgaggatcacctagaaggcaacgtataaggtgaaaactaggttcctgtgcaaacttggaaactctcaattaagaccacaggatgctcatccgatggctagggacagaggtgggctaattttacactttaccacccgccattagccagactaatcatgttttttttgcaaatcaccccacccaattttacaattaacgaccatcgcttcgtctggtcgtttcgtctggcaacgccgccgccgccgccctagtcgccgctccctcgcctggccgcgaacgcagtggcgcccagccggctcgacgccgtcgctggcccgccgagtgcgccgcacgccgtcgtttcgtgagtcaccgccgacctcacccgcgatttgccgccgccgcccgcccgcgagtcgccgacctcgccatcagccgttgcccgcccgccaccgtgatggagtccggcgcgcgcgacgccatggagtcgcatttcggcgttggcagcggcagcccttcatgccatcgttagtttctactataagactttcatcttaactttgatagaaattaatctgattgctagcgtgcctgcatgcagtggacggtgagcctgtagtcgtcgttgattctacctctgttgaggctgctgccttggatcatgtcatcatcaccgtcgacgccggagttggagcccaccttgaacatccaagcacaccacaaccaaaatcttctgtgagtatagcagtaagttgcaaagaattcagatcatatgctcatagggtatttggcatgagtggctaatgcatttattctggaacatttgaatgaaatgtgcagatacatttccttttccatagtaaacatgtcgaactagttctgcctgatttgttgatcatacaattttacacttctataggtctcttgtacaagtgacacatgcaacacacattggaaagaacatttgaagcctatggttggaatgatctttgatacactcacagatgtggagaaattttacaaatcatatgcacataaagctggtttctctgttcgtgttggtcagcactagaagcaaaatgaggaaatattattcaagcggtattattgttcaagggaagggtacagacaggagagtgtaaaaaaagttaatgatgaatccggaaaaaaaagaaagtcaccaaatgtgatggaaactagatgtggctgtgaagcacatattgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48402 - DNA, 705 bp, Oryza sativa
ccaaaaatcatgttttgcattttttgaactttttgattccggtcaaaaacatcgcaccctcgtgtgccaatattcgcattaattgagaaaagttcgccgtgcgaatcatgaagtgagtttttgccacgaacgcacgcaatacactccaaaatgtccaaaaatggcgtttttgaactttttgattccggtcaaaaacatcgcaccctcgtgtgccaatgttgccattaaggacacggatacagatggatgaagtcgttgcgacgatggatatctctgaggcaaatgaaggctaaacgagctgcggctcggtaatcgagatatctaggcaaatgaagactacacgggtcggtgcccgttagtcgagatgccatggcactggactagtacgcgggtggtctcacccctatgcgtgtggcgcacccggtctagatcctgttgctcggggctcaatcctggcctgcctgtcccgagataccggccgtaggcagggttgggtcggtacttttgttcacggctaggatgggtgaagggttatgtcacatgtttacgacgggttccaaggccatggaatgggatgtcaaaagaagcaccatctattgactcggctgacaaggagattcagccggaaaagactgtgccgtaggagtactgcgacacacggttgctgctgtttccccaacgaaaggacgagcagttcgctcgttt

SEQ ID NO: 48403 - DNA, 24378 bp, Oryza sativa
  unsure (1)..(24378): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaggtggcttcggcgccgtgtacaggggatacctgagagagcagggcctagccgtcgccattaagaggtttgctaaggattcctccaagcaagggaagaaagagtataggtcggagatcaaggtgataagccggttgcgtcaccgcaatctggtgcagctcatagggtggtgccatggccgcgacgagctcctactcgtctacgaactcgtccccaaccgcagcctcgacatccacctccatggcaatggcaccttcctgacatggccaatgaggtcagtaactgtcctctctaacttcatctcaacttctttggtgatgtcaaattaatcgacatgttcttgattttaacttgtcacagggttaagattgttcttgggcttggatcagcactgttctatctccacgaggagtgggaacagtgcgttgtgcaccgcgacatcaagccgagcaatgtcatgctggatgagtccttcaacgccaagctaggcgacttcgggcttgcaaggttcatcgaccatgccgtggggatgcagacgatgaccgccgtctctgggacaccaggctatgttgatcctgaatgcgtgatcaccggtagagcaagctcagagtctgatgtttatagcttcggcattgtcctattggaagtggcatgcggaaggaggccaatgagcctacaagataaccagaagaatggcatcttccggttggtcgagtgggtctgggacctgcacggacaaggagatgttatctcagcggctgatgagcggctcaacggtgactacgacgtgtcggagatggagcgtgtcattactgtggggctttggtgtgcgcatccagacccaagtgcacggccgtctatcagagcagccatggccatgctccagtctagtgggcaactaccggtgttacctgccaagatgcctgtgccaacatatgcgccgccggtggcctcagtggaggggctcttcacatcgtccactggaatgttgtcctcaagtgcaacacaatcatcatcgacaaccagtggctatattacccacacctcaagttcctctaacacatccacttcagctggttcaaaggactcgtcttcgttgctcaaacatcaatacttatgatgttcaattcatttgcattgttactgattttgacttgatgcttgaatgggatgtacaactcgtgagccattgattttccttttagagtagtctaattgccaatgtgagtaatgtatgtgcatttatgccatgatttaaattttactcccattttagttattctagatagatttatcctgccattttctctctaatatctgactactataaagtgcatacctggcttgttttcagtgaatatcctagtctttagagggcctggaattgtgaattgtcgaagttggaagaacttgttttaaaaaaaaaaacaccaagagaagataactcttacacacttcacatatagtttgcatgttttcacttttcggtgaataacgcaaaggtgtaaacaacaggagctaaatataataagctaaattcaatagagatggaatatggcctctacagactggagacaatagtacaaagactgcttattttcagaagttcttatgcagttgtctcaaatcgtggatatttatgttggatacttcggtggtggaatcaagaacatccaagcaaaattgttaacactaaaaaatagtaacagcataatagttcactcactatgatctgtagcttttcagctggttgttttgccctgtttttcagcttttcaaccaaaaggttgttctcccccaaatcttaagaaaaattcgggcagcactctttgtcggcccgaaaaaaaaaagattcattaaattagacattcatgaaataaacatatcacctaggattgacaactctgctacctcacggatcgatcaagacaaatttggaaacaaaagagtggttctgatagactcagtaatgggtttgctgctgcaaaattctcaacagaatctgatagaacaacccattggacactactccttccagaagaaagggaagatctggaaacattatatcatggcacagtagcaagtgacccattctctttcacattatgtccttagccatgatcagacgcgcttggtcaaacctaccaagatgattgacagaatagtaatgagaacgaattttgacaaagagaaacagttccagtgatttacgcattcggaattaaaaaccactacaatagttacagcaatttttcatccataaaagtccatgcatagcctcttttgaatgtccaagttagctattcaacattgatgcaggattgtgctgacctaaaatgaggttgaagcccttacattcttttgttaaggggacatcgatcggaagacgttaagaggctaaactaatactccctccgtatttttatgtatgacaccattgactttttaatcaacgtttgaccattcgtcttattaagaaaatttatgtaattatcatttattttattgtgagttgatttatcatcaaatattctttaaacataacgtaaatatttttgtatttgcacaaaaaattttgaataatacgaatggtcaaactttcgtaaaaaagtcaatggcgtcatacattaaaatacggagggagtaaatacgaacatacccaaccttagaggaaagttagtgttggacaccaaattgggcatttatcacatctaaattatctcaataaaaaaacaaaagaaattcacattatacaagacaaaataaaaaaaaacagcagtaccaatgtaccattgtgaccaatcaaccactagcatttctcacattaagttgaggttatgaggtaaccctcacctagtcacctattggaagaggaacctccagtaggacaagtcggcggcgatgcactgtcgcagcctagcgtccaccgccgcgctgtgcagcaccatcagagaatcagccctcgccgccggcgcgaagtgcctgacaaggtcccgccattttgggattaggatagttcccttccagacctagctagcagcaagaacacctgcgggggcgggaggcgtggaggagctacagtatactttgccgaccggaactgctcttcaccggagatctcggtcggcgcgcggccgacgactcgagtatggtggcggcggcggcgcggtagaagacgcttcggttgcggaaagaagaaaaagcttaaaccgagcatggctagttgggccgtgcaacgtcgggagaacattttttattgggctaaactcaagtcctaaaatgggccttgggccagagtttttggaagagcgggggagtatgttgggcccccattgggggtgggacaagtctattttgtgtcggagccatgaaacttggaggcccgtttgatctggcatgggaggacgacgatgcgaaggaatgggggaaggggaagatgaattggggagacctacggtgagcgttgccgccttcttcccatagtggaaaaagccggaccggagaatgacccagtgagctcatctattcaccggttcaccggtcggaccgccggttcatggctaactatattttaagtcataattgactttaaactgttaaataaaataggtattccattctgaatagcacatatctcttgcccagttggttaggtgggaaagtacaaggcttgtagcgcctcaagcatgtggtctggggttcgactccccttctgctcatactagaaatttatatttttccctgccggtcttttctgcaaaccgaaccgtggcatgcactggttccctttttttccggttgaaccggtggctgaccggttttttgtactaggcttcttcctgttggcggagctaatgtggtaaggttgggacgacggatcgttggcggagctcacggtggttccctttttttccggttgaaccggtggctgaccggttttttgtactaggcttcttcctgttggcggagctaatgtggtaaggttgggacgacggatcgttggcggagctcacggaggaggagctaggcagcagtgcagctctccgacgagatcgtaccagcctgtcgtctccatcttcgctgtgaggaggtcgtctcgaatttgcccacgtcggctcgagtactggccgtctcgagctcgccgcagtggacgacattggtgatgctgatatggggaaacaacaatacatggcgtcgctcgagacccctatgtcaagggcctattgggtccactaggtcttttgtttttaaaatttttcaactcaacgacatgcaggtcccgttaagtttttattcttttattgtagtgccatgtaggatgaaagaattccacatacatacgtgatcttcgctaccggcgccattgccgtcgccaccaaagccccgcaacttctgagcctgacgctgccgttgacgagctcctgagcgccggatccactgtccttgtcatcaccactgaggtcctgagcgccggatctgcctctgccgtcgtcatcgccgctagatgtccctgcagctcccaaggctagcgccagattcgttgttgttgtcatcgctgccgaggttccgagtgctggatctgcctccgctgagttcccgagtgctggatctgccggttcctgagctcccagcccgcacctaccattgccactgccaaaagctcatcaccgccttcgcaagcccatcgccccactgctggctcccgtcgcggcgccccgccgaggcctaacttcgccagtggatctagagggggagaagtagaggtggagaaaagctaagtgagagagggagagagaaggagaggatagtggatcacggtggggggatggttataaagaagagggttggctggaaagttgtttttgcatacaattcttttaagtggctctgtggagattatggttaccccatatctgcatgacggttatactttagtcggatatacggcactaaatatagatagaacatctttatgaggattcgggttggattctaaacttgtatctcaagaaaatacccgggatcctagtcggttacgattgtattctatctgtaatcccatgttccgttaggatatgggctgtactttgtaatacggatcccttcccctatataaggaggggtccgggttcctctcgggacgattcttttttctcccaatcatacaatcaataatacactcggcggaatcatccccggacaggagtagggtattactttttgaataagaaggcctgaacttgtataaaatcccttgtctctaaacccatccactttcctaacttgatagccacccccttttattattgccgaaatcttgtttcgacagttggcgcgctaggtaggggtagcgtcaagttctcgccgactaagtgcgatgggtttcgtttctggcatcgacgacttcgccttccctcccgggcatgcgttccagttcggcagcctcaacttcatcaccaacgacttcggcaagatctctctccttgactcggatttaaaccagtcggggagagaccaggtccctgtgccattcggtatcccgaactcggccgaggcctactccaagatcatctctcccgagtcagcttcaaaccactcggatgagatccaatctactcttccgcgaccagatcaagacgacgggtcctatcccccaatcctgatgaaacttcctgatgatttggccgttgtcttcacagtcaagacatcttccactcgaagatctaggcgagctccggcttcggccccgatccgatccagatccagggaggttggcgttatactccaacctctcgggacagtctcgacggaagagttggatggctacctcagctcccccggcgtcagttctcgaccaaccgagatcctcgactacgacgatttcggctaccactacgaccacggcgacctcgacaacttcgacgatagctatgaggataactacacgcccctctacttcggcgtattcatggctgacaatgaaacggaggaacagcgccaagcccgagaagcggaccaagatcgcgcacggcaagaagctgaacgtcgccaactggaggaagagcgacagcgacaagagcgagaacgactacagcgtgagcaacaggatcacgaacggattgcaaaggaggctgaagatcgacgacaacacgccttggaatctgggcggagagcgagagagctcattgggcaacaagacgtcgatgggacagcagtctttcgcaccccccagcagaacgcggttgcagcaatcactctcctcgacaccctcctcaaggaagacgcactcaaccaagccgatcatgttgtcaacatcttgaaccagacgaagaccatgatcgctgcctcggttccagccaactccacaagcacccgcaccccgactggtagccgagtcccccacttccgatctcatgattatcatcagccaagcctcagcatcatcggcacaggatctagtcgcaggagcaggggtcacgacgaacgatctgttcactcgcctcccgaacgtcacagggagagccgagtcgaacggcctcgctctccacctcaccgacgtcccgtcgaccttcgcgacacgatcaaccagcgccgtgcagcacgaagtcaccgccattcaccagatcgctacgacgacgacgtggacggagtagctgccttcactaatgacctgcgtcgagtggattggccagccggctttaagccgactggaatcgagaagtatgacggcaccaccaaccctgagtcttggctcaccgtatatggtctcgcaatccgcgcagcaggaggagacagcaaagccatggcaaactatctacctgtggccctagcggactccgcccgatcttggctccacggactaccctgtggcacgatcggatcatgggcggaacttcgtgatcacttcatcgccaacttccagggcacctttgaacgccccggcacacagttcgatctctacaacgtcgttcagaagtctggagaatccctccgagattacatccgacgcttctccgaacaacgcaacaagatctccgacatcaccgacgatgtcatcatcgccgccttcactaaaggcattcgccacgacgacctagtcggcaagttcggacgtaaacctcccaggatggttaagcagatgttcgaaaaagccaatgagtatgccaaagccgaagatgctatcaccgcgtccaaacagtcgggcaccacttggaagccaaagaaagacacgccgaccgtaggagggagtggaagtaacaaccacaaggattgcaagcgtaagcccgaagaacttgtggcgaccacctctccatcttcccgacaacattcccgcgtcaacatcttcgacaagataatgaactcccaatgtccgcatcatcccaactctaaccacgtggccaaagattgcttcgtctacaaacagtttgcggagcaatacgtcaagaacgcacgcaaacctgcagacggagatcagggcacatcaaagaagaaagatgatgaagacgatgccccgactggttttcaagatcatcgcaaagaacttaatcacatcttcggcggacccctggcttatgagtctaagagaaaacagaagctaacagaacgggagatcaatgcggttcagcctaacacgccccaatatcttcggtggtcagagacagcaattaagttcgaccgctcggatcatcctgactgagtggtccacccggggcggtaccccctggtactagacccagtggttcgcaatgtcaagctccgacggactctcatcgatgggggcagcgcacttaatatccttttcgctaagaccctggacgatatgcagattcctcgcacggaattaaagctgagtaatgcacccttccacggtgttatcccaggattgtcagctacaccactcggccagatcactcttccagttaccttcggcactcgggagaattttcgcacagaaaatgtttgtttcgaagtcgctgattttgagacagcatatcatgctatactcggacgaccggctttagccaagttcatggccgtcccgcactacacctacatgatgatgaagatgcctggtcctcgaggggtcatatcactacggagcgacatcaagcaagccgtcacatgtgacaaagaaagttgcgagatggctcaaacccatgagactactctcgcccgcgaagagatccgactggctgcgaccacggcaagcgagggagaagtgcctgcaaccaagctgacgaagaccaaagaaagcggtgccaagatgaaaaagattcccttagatccctcggatcctgataagactgctgtaataggcgctgagttagattgtaaataggaaagcgcgctcatcacctttcttcagaataataaagatattttcgcgtggaaaccatccgatatgcctggtatccccagagaggtgattgagcactctttacatgttaaggaagacgccaaacccatcaagcaacgactccgccgttttgcacaggacaggaaggatgcgatcaaggaggaattaaccaagctgttagcagcaggcttcattaaggaagtccttcatcccgactggctggctaacccagtcctggttcggaaaaagacagggcaatggcgcatgtgtgtcgattataccgacctcaacaaatcttgtcccaaagacccttttgggttacctcgcattgaccaggtggttgattcaacggccggctgcgagttactcagcttcttggactgttactcgggatatcatcagatccgactaaaagaatccgactgcttgaagacctcgtttattacgccctttggggcctactgctacatcaccatgccctttggattgaagaatgcaggagcgacctatcaacgcatgattcaaagatgtttttcaactcagattggtcgcaatgttgaagcctacgttgatgatgtagtcgtcaagaccaagcggaaggatgacctgattgcggatttagaagaaacttttacaagcattcgtgctttcaagatgaaactaaacccggaaaagagcatctttggagtaccgtcagggaagttgctcagatttatggtatctcaaagaggcatacaggccaacccagagaaaatcaacgccatcctcaacatgaaaccgccaagctcccaaaaagacgtgcaaaagttgactggttgcatggcggcgctcagccggttcgtctcacgactcggcgagcgggggatgcctttcttcaagctgctgaagaagactgacaatttccagtggggacccgaagcacagaaagcctttgaagacttcaagaaactcctcaccactccaccagttttggcctcgccacatccgcaagagccgctactgttatatgtgtcggcgacctcccaggttgtgagtacggtcctggttgtcgagcgtgaagaggaaggccatattcaaaaagtccaacgaccgatctattttatcagcgaggttttagctgactccaagacaaggtatcctcaggtttaaaagttattatatggtgtcttaattaccgtcaggaaattatctcactattttcaaagtcactcagtcacggtggtcacatcgtttccactcggggatatacttcataatcgcgaagcaaacggacggattgcgaagtgggccttagaattgatgtctttggacatatctttcaaaccacgaacttcgatcaagtcacaagctttagctgatttccttgccgagtggaccgagtgccaagaagacatgccagaggagaagatggaatattggactatgtattttgatgggtcgaagaggcttacaggcactggagctggggttgttttaatctccccgactggagaaagattgagctacgtattgtggatatatttttctgtgtcccataacgtggcggaatacgaagcgctacttcatggactaaggattgcaatatctctaggtattcgccgactaatcgtccgtggagactcacagttggttgttaatcaagtcatgaaagagtggtcatgtctagatgataatatgaccgcttatcgacaagaggtgcgcaagttggaaaataaattcgatggactcgagctcacccatgtcctccgacataacaatgaggcagccgacagactggccaattttggttcaaaacaggaagcagctccttctgatgtgttcgttgagcatctttatgaaccaaccatgcccagaaaagaagcaaatgaagccatggatactcgaggcataggcatgattgaagccgactggagagaacctctcataaaatttttgaccaaacaataactccctcaagacaaaaatgaagccgagcggatttccaggcgcagcagactttacattattcatgagactgagctgtacaagaaaagcccatcaggaatactgcagcgctgtgtgtctttggaagaagggagacagttgttgaaagatatacattctggtatttgtggtaatcatgctgctgcacggaccattgtcggcaaggcttaccggcaaggttttttctggcctacagctgtgtccgatgccgacaagattgtgcggacatgcgaaggttgtcaattttttgccagacaaactcatttgccagcccaagagttgcaaaccatcccgttgtcctggccatttgcggtctgggggcttgacatggtcggtccctttaaaagggcagtcggcggttacacgcatctctttatggccatcgacaaattctccaagtggattgaggctaaatcggtcatcacgatcacagcagataaagctagatattttttcatcaacattgtgcatcagtttggggtacctaatcggatcatcactgacaatggcactcaattcactggcgaagcatttaaagacttttgtgaagacttcggcattaaaatttgttacgcctccgtggcacaccgtatgagtaacggacaagtcgagcgcgctaatggcatgatactgcaagggatcaaatcacgagtttttgaccgactacgtccctatgctggcaagtgggtagatcagctgccgtccgtactttggtctttacgcactactcctagtcgggctactggccagtcgccgttctttttggtttatggagcagaagcaatgttgccgagtgaagtggaatttgaatcactacgatttcggaacttcaacgaggagggctatgaagagggccgagtagacgacatcaaccgactagaagaagcccgagaagcagctttaattcagtcgactcgatatttgcaagggttgcgccgttatcataattggaatgttcgatcgcgagcctttttagtccgcgacctggttctgaggaaaattcaaacaacacaggatcggcataaattatctcccttatgggaaggactgttcataattgctgaagtcactcggccgggttcttatcgactcaagagcgaagatggtactatcatcaacaattcttggaatattgaacaccttcgtcgattttacgcttaggcatttcgtttgtatctttcctctttgactgctaagttcaagttttttcctcgaagttttcagtcagggggctactataataataatggagtgtgatttatatcaattcaatttgcttacttgatgtatcattgccctgtttgatttcttggcttagtcaatgaggactgaaagttttttaacaacttttgcgggttttaggctcaacaaggtttgacaaaaacttttatgaaatcaggagctaagttaagatatcaagcacaacataaattcatcagtattgtacaaattgtgcctccatcatcattaatcatcaaaattatcggtacattaatcagtattagtcttttcatcatcagaattatcaggaccagtcggtcgaagatcggtatcttggaatctctcaactacatcagcagcaattttgtcagccactttctgcgcatcactgatgaggtcaagagcagcttcttcgctcgtcccgtctgcaaagccatcaatggtgtcaatatcaactctaggataaagggatttagtcttcgccaacgccagacttgctcccatacttccagcttctttgatgttcttgaaatatgtatccggagcaactctcagcttgtcgaaaattttagaagcatcaagtgcactcgggccattgttattgaagaacatcgcttgaacgattggggcggcagcgttagcaacctcatcccgggctccttcaagttttttgatcttgccaaccaggacgtcgaattgagcttgagatttgatcttgcggtctgcatcaacaggttcacattaataagtcagtatatggaggataatggcttttgaggtattgattgttgataccttcaacttcctttaaagccaggtctctttgttttgccagttctgccttgtcattttccagaatttgaatctgcttctccaactgagatatcttggcagcttgtactacattgattacggttaatcaagatggcaaagataacagtatgagtcagttgagcagagtttgtgcgtaccttttgatgagccactcagttcaaaatttgattcctggagatcagcgatccgatccctcagatcatgttcattcttcctggcaagttctttcgcttcgtgcaattgattcctggtggctttgagggtcccgagatgaggaactaacctctctaaggttactgttttggcttcgttcctaagatgaatcctctgcaagacagtttaattagcgcatgaattaaatggcaaacaagatggttgagatcaggtaccagagaacttacatttacaatgcgggttgcctgaccaagtgccttcttcagtaggcataactcttcgtcctctttttgcttatttatcacgatcccttgaggctgcatgttgtcatcccaccacttgaccagaatcggagggcgtgaatcctcagctgcttgtatccggaggatctcttcttcatcaccaattattggccctagtgtatccatgaacgaagatgaagcagccaaataaagtttgttggatcaaaatgatttcagatggcatgtctaactgtgatgattcccggtcggggacgaatggatcttggtgccttcataggagatctggtttctgattcattgtcagcatccttcccgagaggactgttcgtttgagcttcaacctcgggaatcttttggcttggccctgcatccgactggtttccagtcgggggctcctggttagcaccgacttcagcttcgactgactggttcccagtcgggggctcgttgctgggttctacattataggttgccggctgattttcactcggatgatcctcagcagttggtccggtttctttggaagagcttgtgtccatgttagtcgggtcagagtctttcccagacgggtctatatcagatggtttcctgcaaatttgattatcagtattatcgccgcaatgggtgtgcatcaatacaagaggaatcgttacatgagttgcacctggaagacttcctgatctttggcgcagggcgactggatgttttcttccttggagtagcctgttttggtagtttcttggtcgtctctcagtcttcaggcctcctggtggtatcgtcggcttcgtcgtctcttagaaccagcttcctctttcgagaatctgactggccgactggatcagaagcacttggttgagtttcagaccgaattcttggtcctccgctcccttgcccagtttggtggcggggagatcggcgtggagcgattggtggattcgacttcatcagagcaaattcctgggtgtaatatctttcattgttaattgattcaacaggaagacaagatcatattttgaggaaggttgaagtatatgaatacgcaccggtggaggaggattgaatgcgttgaacggtacgactggcagcaagtgtgagtagctgacaacgatggcgtttgagaagatgttatacatcctttccttcatgaccttgaagtcaagagaatccggatcttcacggtttgggtcatgcttgccgtcaaattcgaaggctgtgcgagatctttctttgattggagctaaccgacacttgataaagtgccgggtgatctgttctccttgaaggccctgttctttcagctttatcatcctctccatcagttttactgcttgagcagcttcatctcccataggcaatgagttccatgtatcctggtaaaccggaggaagacagcagtactcggggagtgccgggctcaggattctgaacataaaactagttggcgtgccacctttatttgaggtcttgaagggcatggaaaagtatttttggcttagggttcccctgagttggaaaccaacacccccaacgacgtatggtttgctcttatttggctggggcttgaggaaaaaaatgcggcggaccaaggcgaaatgaggcctaatgcctaaaaaagcttcgcaggcttggataaaattggcaatatgcactatggagtttgggttcaaatgatgcaagctaatcccgtagaagtttaggatcccccggaaaaaccttgaggttggaaaagaaaatccgcattaaaggaaatgcgcaaataccacgatttcgtgtgtggcgggggtcgggaatgcctcgccgaacgccggtcgccacccgataatctcctttgtcgggagaacgccgtgcgcccccatctccttcagattatcttctgtcacatcggaggcgccactgactctcgaagctttctctttcttccgccatgaatgtgaactagatgatttgatttaattcgagatacggttgaaaagggatggggaatcggaccggtggatgcggggagaaatttcaggaagtttttgaggatggattggagcggattgatgaaccctagctttgttggcgcggttctgtactgtagcacggagtggggaatggcgagagtctcggcggggaagacgaagcgacgtttggacttcggtatttttagggtatcgggagtactaatgggcctaggcctgtacagtatttcagcccaattatgttttcagcgtggcccgttgtgatccctacggacttaggtgctttttgctttggcaatatgtgctcacaatggcgcagcccgatgctgttaaaatcctttttaacgtgattcaataattctttagaattattatgatgcacatgaaaaggtgcccgacagaaaggtgttataccatttttgtaagctttttaggctacaaaagctgttgggttcatttgagatgactggtttattaatggtcattcttttagcatgttatatgcttattttaattatggtaagagttatagcctaggctaatgaacttcttaattaccatgatctttatcatatttggtggatcattataagagtttcttactcggattcctaccaaatatatctatttttggaccttttgagtgtttatcactcggcccttctcgtattttttgtccttgatatattcagattgagaagcagttggctgggtatcttactaagtaccatgcgtgcttcgctataaaaccacttggttcttgactatctggttagtttttcaactaatcacatagtcggggggctacaccttattaggtgcatctactcgatgcaccatgttttcgcccttcacagttttttagtactcggcaagccggagcaagttgaattgaagcactcggattattgttttttgtttcgagaagattattttggtcaactgcgaaggtctcgggggcttatgtggagattatggttaccccatatttgcatgacggttatactttagtcggatatacggtactaaatatagatagaacatctttatgaggattcgggttggattctaaacttgtatatcaagaaaatacccgggatcctagtcggttacgattgtattctatctgtaatcccatgttccgttaggatatgggctgtactttgtaatacggatcccttcccctatataaggaggggtccgggttcctctcgggacgattcttttttctcccaatcatacaatcaataacacactcggcggaatcatccccggacaggagtagggtattacttcttgaataagaaggcctgaacctgtataaaatcccttgtctctaaacccatccactttcctaacttgatagccacccccttttattattgccaaaatcttgtttcgacaggctcgtattcgaaaatcgatttttttcatgtgggtctcaaccaaataacatcccaatcttttcacatgcagatgttttttttgcccacctataactaaagtggggtgcttcctagtagtgaacctctccgtcttcaggtgattttcccttcagcttcctaaataatcctgattatgatgtagattcaaaggcacataaattacagaattcatgaaaaaaaatcacgaatgcgcaaaaggattgtacatcaatatattagaagaaaaagaatttgttacataacgcaattagctagaccggcctatgccaagggaagggagaaaaagcaaaacaaaagctcaagctggaaaagactactacgacggctaaacacaactctaaacagcggaaaggggtagagccacgctaacgctacactcccgagaaatctccaaaaacggcaatgctagctaaagactacatatgaccttctgagaggaaggactctagaaccactccgacagaattcagaaaaatgaagcagtagctttcagattctcactagctaaagctgcttcttaaacctccagctctttaaacagagccattgacttggtgctccaagctagagctcagcatttcggtcttcagtcccatatgaccatcaaacaatcgatcgttgattcagcccaatcttttctgaccccgacggtcgaaaactatggccggagcacagaaagaagtgccattttggcacaattaatacaagtggaagaactaatattaccaataaatcaacggcaagcttgtgttacaattccttgttagaccgagccggcttctcgagtctctgtttgctagtggtggctggcacaccagctgctcgagtgatatcgtggacatgagttgaataggctaatgggtagtagaggtgatccatccacctgtgtaatactccctctatcccataatataagatgtgcacatattttaagattttactttaaaaacatttgaccaataattattataatataaattttattttatttgctaaaattaatatcattggattgacatttaaatttactttaagatgattataattttgttgcaataaactttataatatatgagaaattataggtcaaagattagttttgaagactgtgccaagtttgactatgccttgtattatgagatggagggagtattaattattaaaaccattggattgttacacatttaacattttatcctttacttaatgagaatgttcttgaccatttatgccaaaacgaagtccatgacgaacattatttaagaaaaagagattaattatgtggcatcacttgtagtgttgctgtctgtctcattgtttagtgagtggcaattcttgttaccatttcttcaaactagttttgatgtcacatggttggagacctatttctggacatcaccttaccgggggaatgagaatgatattgccaatttatttaagtttttttttactatcgtcttttgctaccaccatatagttgttttgtgatacatctcggtctcttaactcttagaggcatgtggcaacgtttcttgaatgtgatcgaaatagttgagaaaaacaaaagctgacaacgtagattaggtttctatcaataacaaaaaaaaaaaaaaaggtagaccataaaaagtacaattggatttggattcacgcactacaacagatctagacttccctaacggattccctttgacaaacagggaatccgtcttgatttgtgataaattcgcaaaaacaaatatcgttgtaaagttcaccttcaaccgatcctagcgacaactagaagtcttggtcctaagatatgttctccgcgacaaacaggattgtcaagaattatggggatttcatcgttagcagctaggttatcatacgtttagatttgttgggagtacctttgtttctctatctagacaaaaaaaaataacttgatctattttttcgctataggaaatagtaagttacgttatcaatcactttaaagagttttataacctgacaaaatttgctctaggtaactctataattatgacattcactctaagatatagttttgcggtttgccgtatgatggtacagttttgcttctctttgccaaaatacattttggccattgctttgacatatcctcttcaaatgagagattttctaaaagaagaaattgcccttcaacctaccaagtgagcctgagggcaattttgtcctttcaaaagttctctctttccaattgaagaggatagggaaaaataagggactacctatataactcctgacgaataatttttagcgtacttataaatgtcaccataactataatataaatatagtgtacttatattttaactatagtgtatattagatgcaactgctatgtaaattagaatttgctttgtaacacagtgggagatcagcacgttcccacactagcttcgcatcacgatttcgacacgacgacacctacccacagcgcacgctatcaactttttattcttgatcatgcgcacgaatctcctagccaatccaacgataaaaatccaaaagtttttcctccacttttctacagtagtaaaatagcaagtatgtaaagtaataggtcaagtgtcttttggcaaaagaccgcaatcctgtgataaaaccgtaaaactagagtgccttagaatattgagaaaattggaaccatgtcattataatttgcaaaatttgagatgtaccatcctgactcacatgtcattgactcatgtgggtcctacatgtcattgagataccgatggcatatctcaaattttgcaaaattataatggcatggttccaatttaccatagaatattttatcttaggttataggctaactataaacaaatgtagaaacgagataaaaaaaaatagcttggatacatgcattaattaaatatataagtgagataaagattgtggataagaaaagcatggacaatgaaatagcttgcttatttatatacattaggtctaatactatttttgggtggacttagggcctgtttgtttagttcgcgaaaagaaaatttttaggtgtcatatcaaatgtttaactggatgttggaagtggtttttggacacgaatgaaaaaattaatttcataaatcgtctggaaaccgcaagacgaatcttttgagcctaattaatctgtcattagcacatacgggttactatagcacttatggctaatgatggactaattaggctcaaaagatccgtctcgtgatttctcctcctaactgtgcaattaattttttttaatctatatttagtgctctattgtatgtaaagaattgatgtgatgtttttagaaaaaaaaaagaactaaacaaggccttagtttgcttacgagacgttgtatcataataaggacgaaacgagtatacgtactagctagtagcgtttagtatccacatcatctgcttacctgtgttttgtcgtactcttctttcgtcacttatttacaggctggcgcaagcgcggtccaaatccgtccagaggtaaggccctctttagttaccacataaaaaatttacgtcttattatatcgaacgtttaagtatccctgtataaaatattaaatatagaattaaaaaataactaattgcacagattgcgactaatttacgagacgaatcttttaagcctaattactacatgatttgacaatgtggtacttgctaatgatggattaattaggattaattaggcttaataaattcgtctcgcggtttagtgacggatgttgtagttagtgtttttatcagtgtccaaacaacccatgcgacaccctatataatacccaacgtggcacaccaaaattttacaccgctgatgagggctgaccggttaccttaaatctgcgggactcccgactgcattgtcacgtaggaaggctgtaagcattgtctttagtttctctccagctggtcaagccgatcgatcagtactggtagtatcgttgtcacccttgcgcgccgatcgattgatgccgggggcgatggttgatgtttctttgatcagttgcgctgtcggcatcatcttcttctccgccgtttgctacctgcttacggctcctgtcgccgccttgtccttcaactacaccaacttcaattcaaacaacccgagcatcgaatatgaaggcacgcctctttcagcgtcgggtatatcgacatcagcttgaacgaagccacggcatgggcaacaggcccggacgggtgtcctacaagcagccggtgcagctctgggagtgggacgccgccaccggcgaggtggccagcttcaccacaaccttctctttcgacatcacgccgagcgataggaacaacaggggcgcggggatggccttattcctcggcagctacccatcgaagttaccagaccgcgccggtggccacaacttcggcctaaccaaccaaacaatcggcaacgtctcgaccggtgacaagaggaagacaagaggaagcccagcccagacgatccatgcgagatcggcggcccacgagcaagtatgtgtcgagtgagtggacccggtagctgtcgaccgggccactgtcagagagggagcgagatcttttggcacatcgctatataagatcggcaaagtagagagagaaggaatcgaacattgtagaaacaactaaattcccaattcaattcaaatctctctctctctctctgttctattgcttcctctgttcttcctctgtttctcttctcaattcacgaattcctcttcgaattcccatggtttcgtcatcgtcttggcgtgaattccacaagtgccgtgacatttggtatcagagcagcgatcctggagaaaccaaggtacacttctcgtttgcaatcgcaggttgaggcaatggagaagcagaatctcgatttcggcaagttgctcggcgacatccaggagtcgctggtggcgttgaacaacaagcaggcggagatgcaggtggcggtggcgaagttggacgaaggggttagtggatggcgaccccaagttgaagccgcgatcaaggacttgcgtgctgaggtcgacgaacttcagcagcagcatgatgccgccaacaagggaaagcaagctccatcagcggcactttcccctcgggtcccgttgacgggcgaggaaaggaaggtgccattgttgccgactcctccaccatcatatcagttgggcgcggcggaaggcgggggcaaactggccggtggccacggcgttccacaacatcactggaggagggcatctggagtggttaccactctgatcccaactccgggcaagggtacgttcaatgtttctcctgtgcctttgcattcctgtgaaaattttgattcgggatttggggaatttgatggagaggttgaggaacgtcagtatagccatagagtgcctaagttagattttcccaaattcgatggtaccgactcacaggattggaggatgaagtgtgagcattatttcgatgtgaataacacgtacccggggttgtgggtgcgagtggctatcatctacttttctgggagggctgcatcttggttgagatccactagagctcatgttcggtttcctaactgggaggatttctgtgctgcgctatctgataagtttgatagggatcaacatgaactgttgattcggcagatggatggaattaaacagtcgggaacagtgtgggagtattacgaacagtttgatgaactcatgaataagttgcttgtgtatgatccagtagtgaatatgcgttatctgacacaccgtttcactgagggattatataggaaaattcgtaatgctgtttacttcagagaccccgagacctcgagtctgctttggctgttgctttgttacaggaggaagtgctggagacagctgatgaagtgcctggaaaagaagttaggaagagtgaaggaaattctctaggacgttcagttgcaaatcttaaaggggcatatcctttgccaactcctccaatgaggtctgggggcatcaacatgggcattaaatctgaagaaaggaaggagtctgaagtaaaacgttcatcaggaatgaatgagagattatcttctcttaaggctcaacgtcgtgctcaaggtctctgttacatctgtgcagagaaatggtcgcctacacataagtgttctaatactgtgcaactgcatgctgtccaagagttattcacagtgttgcatgaatcagcagaggacgggttgagcacaacagatcatgttgttgagcaaacgttaatggcagtttcactacaggctgtgcagggatctgaaactggtggttgtatgagaatgctggggcaaatccaaagcaaagaaatcttgattttagtcgactcaggcagctctgccagtttcatcagtaaaagggtggcaagcagttttataggggttctagagcagcctgtgcatgtgcaagttaaggtggctgggggagcaatgttacattgttgttctgagattctgaattgtgaatggaccactcaaggacatgtgttctttactaatctgaaggttctggaattgaacaactacgacatgattttgggcatggattggttgatgcagcacagtctaatgacagtggattggaccacaaaatctctgataattgcttgtgcaggaactcagattcagttacatggtgtaaggtctgatactgagcaatgtgcccacataagttccaggcaacttagggaacttaatgacagaacaacagtgtcttagtccaattttgttcagttttcgcgttggagcaccaagagcagattcctaatgtggtgcagacagtactgacagagttttcttcagtttttgatgaacccaaggggttaccaccaatcagacaatttgaccatactattcctttgctgccaggagctgggccagtcaatgtgagaccctatcgatatactcatgtccaaaagaatgagattgaaagtcaagtgcaagagatgttgagtaaagggataattcaaccatgttcaagtcctttttcatcacccgtattacttgttaaaaagaaggacggttcatggaggttttgtgtggattatagacatcttaatgccataacagtgaagaataagtatcctttgcctgtgatagatgaactattggatgaacttgcgggagctcaatggttttctaagttggacttgcgctccgaatatcaccaaatcagaatgcatccagatgatgtgcataaaactgcttttcaaacccatcacggtgactttgagttcagagtgcttccttttggtttgactagtgcaccggcaacttttcaaggagtcatgaacagtgtgcttgctaccttacttaggaggtgtgtgcttgtattcgtggatgacattttgatatacagcaaatctttagaagagcatgtgcagcatttgaaaacagtgtttcagattttgcttacacaccaattgaaggttaagaggactaagtgttcttttgcacaacaagaattagcatatcttggacatataattcaacctaatggtgtttccacagaccctgagaagattcaagttattcaacattggccagcacccacttctgtaaaagaattacgtagctttttaggtctctcaggatactacaggaaatttgtgcgcaattatggcattctcagtaaacctcttacaaatttgcttcgcaatggtcagctctatatttggattgctgaaactgaggatgcttttcaagctttgaaacaagcgctcatcacagctccagtccttgctatgccagatttccaaactccttttgtggttgagactgatgcatctgacaagggcattggtgcagtgttaatgcaaaataatcatcccctcgctttcttaagccgagctcttggactgcgacat

SEQ ID NO: 48404 - DNA, 1319 bp, Oryza sativa
caatgtagaagttcaacagaaaattcttgctaatcttcacacaacggcagttggaggccattcgggaatacaagtcacttatcagcgcgttaaacagctgtttgcttggcctcgccttcgtgccactgttgttcagtatgtgcaagcttgttctgtttgccaacaagcaaaatcggagcatgtgaagtatcctggaatgcttcaacctctcctgtacctgaccatgcgtggcaaattgtctctctggatttcgtggaaggccttcctaagtcggcttctttcaattgcattcttgtggtggtcgacaaattctctaaatacagtcattttgttccattgactcatcctttctctgccttggatgtggccgaagcatatatgcaacatatccatcgacttcacggcttgcctcagtctttgatttctgaccgtgatcgcattttcactagtacattgtggactactctattcaagttagccggcactcaactccgaatgagttcctcttaccatcctcagactgacggccagactgaacgtgtgaataaatgcctagagacattcctccgttgttttgtccatgcctgtccttcacagtggagtcgctggcttgcgttggcagaatattggtacaacacgtcctttcactctgctctgggcaccactccctttgaagtactgtatggacataagcctcgctactttggtctttcagcttctgctgcttgtcgatcagacgatcttgttgagtggctgcatgaacgtgagaagatgcaagctttgatcagagatcatcttttgcgtgctcagactcgcatgaagcaacaggctgatcagcaccgttcagaacgctcttttgcagtgggcgattgggtttatttgaagcttcagcccttcgttcagcagtcggtggttaccagggctaatcgtaaactttcgtttcgattctatggaccatttcaggtgcttgacaaggttggagcggtggcatatcgcttggatctgccaacttccagtttgatccacccaattgttcatgtttcccaactaaaaaaggccttggctccaacggaacaagttcattctccacttcctgtgctggatccgacaaatgttactcacgtttgtccagcgcagattttggatcatcgcttcatccgcaagggttccaagatggtggagcaagtacagattcgttggaccggcgatgcaccagcagcaaccacctgggagaatccgcgcgagctccgtcgccgttttcctgcggcaccagcttgggggcaagctggaactcaaggaggggggaatgtcatgccagc

SEQ ID NO: 48405 - DNA, 1813 bp, Oryza sativa
ggcgctggcatgacacagagttgtagccggagccaccgtcggcgcaacactgctcgtcgtgctgcttttcaccacggcaactatcatcgtacgacgacgtcggatcaagaagaggagggaggccgaggatgaggagaatgcgagcacggatagtgacaatggcaagcccatcacggagatcgaggtggggacggggccaaggcgattgccatactatgagctcgtcgaggcgaccaagaacttcgcggcggaggagaagcttgggcaagggggcttcggctcggtgtaccgaggctacctaagagagcagggcctcgtcgtcgccattaaacgcttcgccaaagattcttccaagcaagggaaggagtacaagtcagagatcaaggtgataaccgggttgcgcccccgcaatttcgtgcagctcgtcggctggtgccatggacgcaacgagctcctccttgtctatgagctcgtccccaaccgcagtcttgacgtccatctccatggcaatggcaccttccttacttggccaatgaggttattaattctcggcgttaactttctcatctcaactgtttcgatagtgtcaaatctaattctatttttatcttgcttaattggttgtttccacaggatcaagattgttctcgggcttggatcagcactactctacctccaccaagagtgggaacaatgtgtcgtgcaccgtgacatcaagccaagcaacgtcatgttggatgaatccttcaatgccaagctagatgacttcgggctcgcgaggctcatcgaccacaccatcggtataaagacgatgaccgccatgtcaggaacgctgggctaccttgaccctgaatgtgtgatcaccggtagagcgagtgccgagtccgacgtttacagttttggcattgtcctactggaggtggcatgcgggaggagactgatgagcctactagatagccataataatggcgtcttccgactggttgagtgggcctaggttttgtatggcaagggagatgttctcatggccgccgacgagcgtctcaatggcgactacgattctgcggagatggagcgtgtcatcactcttgggctctggtgcgcgcaccctgatccaagcgtgcgaccgtctatcagagatgccatgaccatactccaatcgagtggaggccagctgccggtgctaccggccaagatgcccgtgccaacgtacgcgccgccgatggcctcgtttcatgggctctttgcgtcatctacagggatgtcgtcgtcatcaggtgtgacgcagtcgtcgtccatatcgacgacgagtggccatgctactcacacctcgtggtcctcggttccctccgattcaaccagttcgaaggactcgtcttcattgctcaagcatcagtgctagtgtttagtgtttgttttttaatttgcttgttcttagtttagagttgatttggtctttggtgttgcctaattgccgatttgagtaatgtatgtgtacttatgccatgaatcttatggcactgtagtttctctagaaagatctgtccggccattttctgttccagcattagaataagtcgagtgagggagatgggcaacgataggtgctacgtactgcagcagcactacaattgaagcgaattaaacgatcggcccattacaattgaaggggtggccgccatcctcctcatgggccattgcctacagaacgaattgggttgggggacagccgctaggaaaagcctgatctacgtgcctatccccaatggattaaatcaactttacatcccttatgtttccaccgagtttaaat

SEQ ID NO: 48406 - DNA, 3759 bp, Oryza sativa
aagtacaactcagtattattaatttaaagcttcatattatttaataaaaaaattattttcagtaatttcgaagtgtgtattaaggccttgtttagttccaaaaactttttcccaaaaacatcacatcgaatctttggacacatgcataaaatattaaatataaataaagtaaaaaactaattgcacagttaggggggaaatcgcgagacgaatcttttgagcctaattagttcatgattagccataagtgctacagtaacctacatgtgctaatgacggattaattaggctcaaaagattcgtctcgtggtttccagacgagttatgaaattagttttttcattcgtgtccgaaagccccttccggcattcggtcaaacatccgatgtgacactcaaaaattttctttttgcgaactaaacatgccctaacttaaggaagtagcagaaaataagggattaaaagtattagattttattctatatacctatgatattgtaattaccaatttcaaaaattcaaaactatcggtttcattcttaagcacttaaaaacaaaatactactccctccattctctaatataaggaattttggcatttcgcttgcactgtttgaccattcattttattcaaaaaaatttaaaaatattatttattttatttgtgatttactttattattcaaagtactttaagcataactttttgttttttatatttacacaaatttttttaataagacgagtgatcaaacagtgcaagaaaaatgttaaaatcccttatatcagaggatagggggagtaacacttatgcagaacatacatataatactgttgcaaatactccctccatccctaaatgtttgacgttgttgacttttttaaacatgtttaaccgttcattttattcaaaaaaatttaagtaattattaattctttttctatcatttgattcattgttaaatatatttttatgtatacatatagttttacatatttcacaaaagcttttgaataagatgaatggtcaaacatgttaaaaaaaattaaacggcgtcaaatatttagaaaaggagagagtatatgagttactagtactaaccagtgggtttagttaatacatataatactgtcgcaaagttgtccgcacctctttcgataacactgacatccagaaagtaaggcaagtggggtaagcgtaagccaaaacaagtcacgtcgaagatgaagaaccaaagaagcacggcggtaccttcttctgttcatgcacatgcatttatgcatttccaactcgaatgtgtgccactgcccgactgccagtggcactagtatcaaatcaacatattggctcgtccctcgaattcgagacaatcattgtactccaaccgatagaaaacaactttaaacactattttatattataatatatataaaaacaatataacaaataaatgatattattaaagtatattttaaaacaactctatacatatagtccccatatttttaagataaatattttaaaaattattatagttgaagattttaaagtttgatcttattcctgtaaaaaacgacaagtattattagtccggtgagtagtataattacttttagagtttaaatttatcttaaaaaatatagttatttcttctttatcttctcatctcaacgaataataacagtctctcattgaatttgtgcacctactttctatttttaacaaatcataaacttccaaaaattgtacacctattttctatttttaaccaaaaaaaaacttccaataatttatttaaaagtatttaagaatacttatattttagtaccgagggagtactctggtactcatactacctgcctgaaaataataataaaaaaaaactgataccaccactaccaacatagcccccggttttgaccctcaaattgaaaaacgtggaaagcaaggagaatttggtatcattaaattaaggaacaacgtaatttactaatatctccaaacctggtatcgataaattaaaggaggaacattatttttccatgtatttaacccatatgttgaatagatggcacaatcaaatcaaatgtatccggtcagtaatccgatctaacacatgatcaattaggattactatccgagttaagatctaacacgaaataactaaagatcatttcctattttgtgagaaattcccaacacaatcttattcatactagcaacatatactacccgtatattgtaccctaaaagtccctttttttatacattgtttagttagtcctcttaggctgttctttttccaactttctcaacttctactctctcgttttttatgctcacgctttctaaactgctaaatggtgtgcgttttgtaaaagttttctatagaaaagttgcattaaaaaattatattaattcatttttcaagtttttaagactaatatttaattaatcacgtgttaatggaatacaaccccattttccgtggaactccacctcccgaacctagccctagtcaactatgcaaaataccatcaagattttagatcttctttctttggatatttgatcaagtaagggagcagctaaattttatacttactccgtttcacaatgtaagtcattctagcattttccacattcatatttatactaatgaatctaaatagataattagatatatatgtctagattcattagcatcaatatgaatgtgggaaatgctagaatgacttacattatgaaacagagggagtacatttttttataaaatttggtgaaaaaagacgaaaaaattgcaaacaatccgcaggcctaggccaatgacgtccaaagcttcaccttttatatatatatatatatataaaccagcttgatgtatatatataaaaaggattttatcattcttgaaaatgtatttgaagaaaaagggaagataccaacaagaaacggaacttacgcttaacttcgtcatctattagcaaaatagacaaaatatgatacatttcagcaccttccgaggagccagagctgtcagggtcatggtctcatggagcctagtgttgatttgccaaccaccaacttgttaaattagcagagtccttaagatctcgactggtctctctgagtggcgactggcgactggccacctgctgatttgagtactactagtagttttccgtttttggcattggcagtattgtccggccgctgattccgctcaaagaccggccatggccgccggcgtcctcatgacaaaaccgttcatggctgctctagcctgcttgctcgtcatgcctagcgtcgtcgctaccactactgtatctttcaactactccagcttcagcaacgcgagcaagaacatcaccctccagggcagcgcggcgctcgccggcgccgccgccgaatggatcgagctcaccaaaggcaaagggaacaacctgtcgagcggcggcaccatgggccggatggtgtacacgccgccggtgcagctctgggacgccgccaccggcgaggttgccagcttcaccacgcgcttctccttcaacatcaccccgaaaaacaagagcaacaagggcgacgggatgaccttgttggcgaagaacaccaatcgaacaccttgtgggcgtcctgtagctatccggcacagcagactgaaaaaactttcagggagacagagaattcagagaatgcagagaacaagaacaaaataacttgggagagtatttgggcaactttcggtgtttatttcgaactg

SEQ ID NO: 48407 - DNA, 8597 bp, Oryza sativa
  unsure (1)..(8597): unsure at all n locations
gaaaacgaacgaggttactccccgtcatgcactctgcttcatcgcgcttcctgcgctgcaagaactagtcgccaccgatctcctttgcccgggcatctcgccacaccgttacacaccgttgcattcccgcgtcgtccggatcagctcgggccacaccaggaataactgcaacatactcccccttagtcttggcgtggcctgagatcacgcacacccaacaggtgccgtgcagtcgccagcttcgccgccggcagtccctttgtcattgcatctgctcgctgctcctcagaacgaacgaactcaatcagaatctgcccactctcaacacattcacgaatgaaatggtagcgggtatcaatatgcttgctcctcccgtggaacacaggattcttcatcaaggcgatcgccgacttgttgtcaacaaaaagtttcacccgctttgcttcagtacccatcatctcgctcagcaacgccctaagccagagcgcgtgacatgctgctgcagtggccgccatgaactctgcctcgcaagacgagagcgccactgtcttctgcttttgagaacaccaagacaccaagctgctgttcacatagaacgccatgccgccggtgctccgacggtcatccatgtcacctgccaagtcactgtcagtgaaacccgtgatgtccaacgagccactgccgcttgcaaacaccagaccagagtccagcgtcccctttagatatctgagtatcatcttgaccgccttgagatgcatcgttgtcggccgctccatgaacctgctcgccacgccaacggcgtaggacagatccggcctggtgtgtaacaagtatcgcaggcacccgatgacacgccggtactcggtcgcatcaattggatttccatcagcatccttgtgcagcagcgaccgggctccatggggattgaggtgggattacatccctgcataccaaactgagacagaatcttcttcgcatacgcagcttgcttgatagcaatcccattctccccctgaattacttctatccccagatagtaagagagaagaccgagatcactcatctcaaattcccccatcatctgctgcttgaacatggctatctcatgtggattttctcctgtgacaatcaagtcatcaacatacacaccaacgattacaccagcttgcccctttcctctagtatacacggcctgctcctgcgtgcaccgtgcaaaaccgagttctttcaagcacttgtcgagacgcgtgttccacgcccgcggggcctggcgcaatccatagagcgccttgctcagcctgagcaccaagtgttcttctcctcgtttcacaaaaccctctggctgggctacgtacacttcttcttcaagatcgccattcaagaacgccgatttgacgtcgaggtggtgcacttcccaccgccgatcagctgcgatagccaggatgacacgaactgtgtcaagccgcgccactggcgcgaacacctcttcaaaatccaccccttgacgctgaacatagccctttgcaaccaaacgagccttgtgcttgattacttcgccggcagtgttctttttcagcttgtacacccacttgaggccaatgggtttgtgtcctgccggcaatgcagtgagagcccatgttgaattcttctcaatcgcctgcagctcctgtgccatggcgttctcccatgccggctggccagctgcctcgcggtagctcgatggctcctccatctctgcaagcagcgcgtccccatcgtgttcatcctccaccaggtccacgcggggtgcctcccgcatgatatcttcaagactcctgaaccggacgggaccctcatcgcttctaaggtcgccgccggaacctggtgacgccaccggcccggcagagccggtagcaggtgttgaaggcggtgtagagctcggtgatgactggggcgaagtcggcaatgacgatgacgcccctaccgggcttgccggaggcgattgcgggactgccggggatggcgcccggtaccgcggtactgggtaggcgggcgctcctgccggcggtgcatcaactccatcctcctccaccgtgaactcggtagagttttgctcccctgcgactacactccattgccaaggtacattttcttcaaaaatgacatcacgacttacatggatacgcccacaacgcgggtcgaacaggcggtgcgccttgctgccttcttccacgccgagatacacatacggcgcgctccggtcatcaagtttcttctggttgggcgtcgtgatcttggcgtgtgctatgcacccaaacacccgcaggtgtcccagctgcggcttgcgccccgtccatgcctcgaacggggtccgatcgcccatcgccttcgtcggtagccggttgaggagatacaccgcatggcgcaccgcctccccccaaaacctgcccggcactgacatccctttcatcagagatcgtgccatcgccattaccgaacgatttcggcgttccaccaccccgttttgctggggtgagtatggcgccgtcagatgccgctggatgcccgcctgctcgcacaactgcgcgaattcgcccgacaggaattcgccaccgcgatccgatctcagcgtcttgatgcgccgcccggccgtgttctcggccagcggcttgaacttggtgaaagcctctagtgcctggtccttcgttttgatcacgaacatccacatccaccgtgagaaatcatcaacaattagcataaagtaacgattaccggccatagttgtcggggtgatcggtccacataaatcaatgtggagcaactcgagcggctcctccgccctgaagttcgccgttgcgggaaacggctgccttatctgctttgcaaccagacatgcctgacagagctggtttggatgtgtgatcgccgggatgccaccagccatgcccttgtcagccaacagcttcatcgcctggaaattgacatgcccaagccgtgcatgccagagccatgctggctcatccatccttgtcagcaggcacaccggagtggctagcttcagctcgatccggtacagccgattaggggtgcgcctcacccgcataaccagccgcaggggacttttgtcgaacacctcgagcacatcttcatccatcaccactctgtgccccgtttctgtgagctggcccaagctcaccatgttgcaacacagactagggatataaaaaacatcctgcagcagccattgatccccattcttgcaggagaacaggatagaccctttcccctgaattttcacagttgaggcgtccccgaacttgacgctcccggtgattgatacgtctagatctctgaacttagcacgatcacccgtcatgtggttgcttgccccattgtccaggaaccagatgtccccggtggctgctccgctgtcagccaacagcagctgcggccacacacgctcctcgtgtacgaccagcccgctcgccggctcgtcttcggtcaccgccagtaacaatgcagggtttgcgtcgtcggtttgcgcgagatgggcctccaccttcttcttcttgggatgagggcactgggtggagtagtggccgaattcttcgcagttgtagcacttgatgtggctcttgtcacggccaccgccgccagagccaccagcgccactgttccgcggcgcgctgccgcgtccaccacctccaccgtgccctctgccgcgaccgcgtccgccctgggcacggtttcccctgtcgctgggaggtttgtttttctgcggcgaagacgactcgctgccgtccttcctgaaacgcgcctcccactccgcctgagtgagaagtacttgaccgtcggcggtgacaccaccagcggccgccttcttcttgcgaactcgttcttcgtaggccttgagacgacccaccgcctcctcaaatggcatattatcaatctcataaaactgctcaatacctgcgacgaggctgatgaatttctctggcaccgtgtcgaacagcttcttcactatcgcggaatcactcagtgtcgagcccaacaccgagtgacgcacgctcatcgcggtgatgcggcccgcgtactgatccagagtttcccccggctccatcaccatggcaccaaattcacccttcaacgtctgcaggcgcgcttcgcgaacgcggtccgcgcccacgaaccttgtcttcaagcaatcccacacttcctttgccgatctcttctttgccacctgcatcagcaagtcctccgggagggactgcagcagatgggacttcgacttcttgtcccttcttgggtcgacggccaccccggccgccggctcgatggcgtcccacacgccctggtcctccatcattgcctgaacgcgaatgcaccagctggtgtaattcgtcgccgtgagttgtgggtaggagaacgcactccctgagctccccctcgccggatccgctgcggctcccgccggaaccaacgccatggtgtcagatcagccctcaacctgagtgctctgataccacttgttggcgaagaacaccaatcgaacaccttgtgggcgtcctgtagctatccggcacagcagactgaagaaactttcagggagacagagaattcagagaatgcagagaacaagaacaaaataacttgggagagtatttgggcaactttcggtgtttatttcgaactgaaatgaaaactgaatgcgcgcgtacaaattctgttaccaccaactatttataggctaacaactttgatcctacaaatgtggaaacgacgaggttactccccgtcatgcactctgcttcatcgcgcttcctgcgctgcacgaactagtcgccaccgatctcctttgcccgggcatctcgccacaccgttacacaccgttgcattcccgcgtcgtccggatcagctcgggccacaccaggaataactgcaacagaccttcttcctcgtcagctacccgtcgaggatgccgtacatgggctacggcggcgccctcggcctcactagccagaccttcgacaacgccaccgccggcgaccggttcgtcgccgtcgagttcgacacctacaacaactccttcctagaccccgacgccacctacgaccacatcggcatcgacgtcaacgccctccggtcagtgaagaccgaatccctgcctagcttcatcctcatcggcaacatgaccgccatcgtcgactacaacagcaattcgagcatcatgtcggtgaagctatgggcaaatggctcaacgacgccttacaacctcagctccaagattgatctcaagagcgccttgccggagaaggtcgccgttggcttctcggcggcgacgggttcatcctttgagcagcatcagctgcgttcttggtacttcaacttgacgttggagcagaagcagccgacaggacaacattcgcgtggcggagttgtagcgggagccaccgtcggtgcaattctgttcatcgtgctcctcttcaccatggtagcaatcctcgtacgacgacgtcagagaaagaagatgagggaggaagaggaggacgactcggaaggcgatcccatcgtggagatcgagatggggacggggccgaggcggttcccataccacatacttgtcaacgcgacaaagagctttgcggcggaggagaagcttgggcaaggcggttttggcgcggtgtaccgtggcaatctgagagagctcggcatagacgttgccataaaaaggttcgccaaagactcctccaagcaagggaggaaggagtacaagtcggagatcaaggtgataagtcggctgcgccaccgcaatctcgtgcagctcatcggttggtgccacggtcgcaatgagctcctcctcgtgtacgagctcgttcccaaccgcagccttgatgtccatctccatggcaatggtaccttcctcacatggccaatgaggtaattaattaactctcattaatatttcagattttattttttttatttcttgcaatgtgcaatcaacaaatgtcaattgaaattcaactgatcaactaccttggatattgtcataggatcaacattgttcttgggcttgggaatgcactgctctacctccatgaggagtgggagcaatgcgttgtgccccgtgacatcaagccaagcaacgtcatgttggatgaatccttcaatacaaagctaggtgactttggcctcgcaaggctcattgaccatgctattggagcacaaacgatgacccacccctcaggtacaccgggctatgtcgaccctgaatgtgtgatcacaggcaaagcaagtgctgaattgatgtgtacagttttggcattgggtttctggaagtggcatggggaaggagaccaatgaacctcntggatgaccagaataatggcctctcccgactagtcgaatgggcatgggacctttacggccagggaaccgttctcaaaacggccgacgagcgcctcaacggtgattacgacgcgacaaacatggagtgtgttttggttgttgggctttggtgtgctcacccagaccgaagcggttgtccatttattagagttgccatggcagttttcccatccaatggacccctaccgatggtaccaaccaaaaagcccgtgccaacatatgggccgccggtggcctcatcagagggccagcactcgtcgtcgacaggaatatcatcctcaagtttgacacaaacatcaatcacacctcgttagggatgtacgcttgcccactcatggtacacattgatccacatcatttaattataagtgcactttttttctacttcgtgttcttatttcagattagatagaaaattgtggatacctagctatgggcagggatcctttctcaggagggcctgagatcttgctatcgtggtgaaatctagtttagggcttgttcggattatagcataggaaaaacgtaagataggagaaaaagattttgctccagtccaacaaaaagtacctcgagataccggtacctcatgctagcctgctgctccacgctggatgttggcctgctgctctcgatccccgtcatcatcgacctccgcacgtggcatccactccagtctccatgctagaagccggcctcgatctgtcgctgtcaacctccgcgcacggcatccactacacaccagaagccagcctcgatccgtcgccggcaactttcacgcgcggtatccatgaccgaagccaacctcaatccgtcaccggcgacctccgcacgccacgcgccgcattagctccacactggaagctgacctcgataccgttgccggtgacctctgcgcgtgacctctttgctcttgtttgctcttgggattctttgtcgtatgggctttgcttcctgtacggaacttatttaaagaaatcatatgggaaacatatcctatgcacaaaagctttccgtgcacactccgtgcaaaccaactagcaaatgtcacataaaattctagataaaattggacgcatacttccaatagtattacaccaacgtgtgaaatcttatcttcaaatttattatattttagccgtaacaaaaaaacaaaattctgacagatttttaccctaaaaactgtcagatttttcactttattgttacgactaaaatataatgaatttgaatatgagactttgcagatatgtgtaatactattatgagtatgtgtccaattttttctaaaattttctgtgacatctgctagttggtgtgcatggagtgtatacggaagcttgtgtgcatagatatgtttccaatcatgtgagatctgccttttctttctctgtcttcgctgattcttctttctctgttctttgcatttgttaatgcttgattgcctcgttccaacacgaagaaaatgaaaaaagagattagagtggatggatattttcaaatgtttctcccatggaagcaaaagtaaaggaaatttttcctgcgaccttcttatgattggtttttgtgatccgaatggtattaaaagggaaaaacaatcctatgaatagtattcctccaaaaatcccgtgataatccaccaatctaaacaaacccttagagatttaaattgcagcactcacgccgataatcgccaatattccaaaccaaattttcaaccaaaaaccattacatggtttccaattttctcaccaattttccatcacaaataaaaccaaaacacacttgttttttaaaaaaactaagttttaaaatttaaattttggtttacatacataatcataagtgaaaagatggtgctaaatgtttttttagttcatttgatttgctcttattttagagttgatcgttgaatggtatgtacagcacgtgaccccgttaatctgttctttagagctgcctagtgctgacgtgagtaatgtacgtacatgcatttacgtcatgcttttcaattttccaaccatttagtttcctgtcattttctctctacgctttattcattctttcagtggatgctgtcattctcaacatactttttttgtttttagtggatgtcctattccttagggcatgttcaactatattgagcttgactcgattcctaagtcatccacattacaccaagaaccattccacaaatatagccatca

SEQ ID NO: 48408 - DNA, 7594 bp, Oryza sativa
aaggtgtgttcgaggagaaggaaatcgaggagattgggaagatacgcaaaacgaggtaagctattagctcatgattaattgagtattaacaattttaaattttaaaaatagattaatatgattttttaaagcaacattcctatagatttttttttaaaaaaacgtaccatcgtgcggaaaacgatacgttttctccctcaaactcacccaaacgaacgctgtccaagtctccaaagctatagtatagatctaagcgtttcggtctttagcaggaccgggttaggattctaaggttaattgtttattcaaaatatgagggggtaattaaaataaacttgtaggcagaagcctaatataacatgtatatatccctgcaaaaaaaatataacatgtatacatatacatatatatatatatatatatatatattaaatttgtttggtgctccatggtgcccgggctccatgattcaaattgagtatatactcaattcaaatgagcatgaattttttttaaatgtttaggtattaacattaactactttactaactagttcaaacaagtttgaactgaatttaaacatgtaatatgttagattttgattctaggtatataacatccaaacatataattagttaggtatgtaatattggattatgaaataaagataaatttgagttgttttattgctaggtataggtatgaatcgaatacttataactagatatatactcacaatttgaaaattttgaaaaatttgggcgaatttgtgtatttcataccatggtgcctgggcaccatggagccccatatgagtgtcctatatatatatatatatatatatatcacatacgtattatgagtttaatataacctcttggattgaatacaacctttgttttggtacacatgcatcacatagtatatctatctacctattatttttaaatacaaaatcttgagtatttatctaaatacccttgacttaagctggacccactcccggtcttcagtttccagattgcaaacaacgcgcaaattagcggaagactattttcttcacacccaggggggcgcattcccacatcactcttgatccaatagtgtccttaggcgttgtttgattgagtgcaaaactttaatttgttacacttgtggtatacacatttaactaacttaacctagcgtttgttggttctactacattaataatatgtcatatatttttttgacaatcaggactgtcaatattacggatcaggtatacctcttgtattagatataatccatcgacacccacacctaaattgatcattttttagtcaaaattttccacaagtgtggcattgtcaaatttgctgatagaataaacagagtggcatccaaagaacccctttattcttgatttgtggtatcttcgtggaactgtagggagttgcaagcatacaactagtactattgttgtttgtatggctaattcttacgagtacgtgtcttggtgatacagtaatcagtttaattttcacttgtggcgtaatcaaaaccctatgttttcttggtctgctctctacatagacatcattaatttaagagaaatatccattttacatccctgaagaaaaatggacattcattagtttaacaccctaatatctctcgagttcgagtccgagcattacaaatgcatggacaaattacggtcgcgatcagctcgcggcattgttttttttttcaaaactgaggtggaactttgtgcccagcttgtatatttagaagaagagaattgacctaatttataagggaaaccgggcccaaaaaccatacaactacatggttaattatgggaaatcggctgaaacccaccgtagagaaaaaagcaagagacctagctacacaactaacaatgacggcagagcccaaacacaggacatcgctgccaagctaaacacaaaagcgataccacagctccgacattgcagaagaggtgttatcgttgccgagctagccgcccaagcgacccagcagcgccgacttcacaaccgcagcgacactgaaaccacgaaagtcgccaaagcgatcgaaaagcagctccgttatccaacaatggacatcagccaagccatcaaagagccacttccttcacacgactagcaccaactccttggaagagactgtaacatgtcaccgttgccaagcgtcaccgcacctcatcagcgagcagctccgacttcatcagtagaaacaaccgaagagagtgtcacccaccacaagaacgaagcggacctaagaaggcgaaggcctcgccgaacattaaagtatcaaagcttttgaaccgaaaaaggccatcaacaatcgtcgatgcataggaacttctccgaaacgatgcctccaaggaggacacgacgcgtaattccgccgccgctcgtccgaaatccggaacaattttttcacctgaagatttgtgagggatatgaaagaacgccatgacgacgcctccaagaagggaaacggcacccacgggcgtcgtcatcgtcgaactggccaaaggcacgacaaggctttcactagtgtcttcatatcacccacacaagcacccccacatcgacggccacagaaaagtccatggcgtctcacaagaagtcatactttgaccgtaaccaacggcaaggatgtgcccttggccaccctcgaaacgccatcaatccgctgcaaattcctacagcaagttggagcctccgccctccccctagcattccccacaaccagaacagggtctggccaaagaaggtggaaaccaaaaggagggagaacactcggccggcaacgaggaagacaccgccgtggatgtcaagccccattcctgcttcatgccaacgcaagccaacgtcccgccaactccacatccgcacatcgcgagcaagaggctcgtcgccagcgagcaaccccactggaacctgcctaggcgacgcagtgcagccatcgagctcatcggagctcacccgagccatgcaacgccaccacacgcaaccgccccgctggctggctgccctggccagatcaagcgcggaggcgacggattcggccacgaacgctcagatccatccagggtggagcaagccggcttcgacgtccgcgcgccacagccgtccatcgtcgccgcaaccaccacgccgccgtagcccctgcctgcgcagcgccacctctgtggacccgcgcagacgaacgccgacgccgacgctgcaacttcggcgcgagtggcctctgcccacccaccacgacgccacccgtgcctgccgccagtctccgcgccgtcactagccccggcgccaacccctcccccaccgccaaccgctagctcccggcgccccgctagatctggccagtgccggcccggatctggatgggaaagctaccgccgccgccacctccggaggctcccccggccgccacaagcgcgtggtgcgcgaagccccgctgccgccgtccttgcggtcacgcggagccactactatgaaaagcatttttccgtgcggtaaaaatgggttttttccgtacagaggttttgcccatctgcactcaggggtcttggaaaatcaatattttcacgtgcgggcggcccaaccgcacgggataatcattttcccgtgcggtcgggttaagtggaccgcacgggataatcgattatcccgtgcggtcaaattataccgcccgcacgcacaaaaaaaaaataaaaaaataaaaaatcctaaccctaaccctggaatcacccgccgccactcccggcgttgtcgctgtagtcgcgccgccggcgcacccagccgccggtgccgcaaccgtcatcgctatcgagcctgccaccgtcgaaaccgtcgtcaccgtcgagctcgcctgccgccgccaccgtcgcgccgactgccaccgctaccggatccgggcgggggacggccgccgcggccggatcctggtaggagccggttgccgtcgcccctcgccgctcgccggcgcgcccacccggtcgacgcgcctcgtcgccagccacggagaggagtggagtggagaagagaaagagatggagaaagagatagagaaggaaagtgagagacagagagagaggagtgaaaataaaaagtaaaggaagggagaggaggtgtgaaaaatttgaagtgagtgcgagggagaggtattttcgcgtgcggttcacttaatatgaccgcacgcgaaaatcgatttgtggaccgcatgcgaaaatcgatttttccgtacggtcctcttaaagagccgcacacgaaaattgaaattttcgcatgcgttccagttaagaggcctgcacacgaaaatcgatttttctgtgcagggggcgctgatgcagtggtcccacatgtcggagaggttgggcggtcggtggagcatcggtgcgtcagccgtggactcgcaggtggtgagcggtgggtgaaaacccagcatcagtgctcgagtgtcattctccctcctgagggcgttgtcgtgccgtctcacccctcaagggtggttgccgggcaaaagcccagtattggctcttttgagaccttgacggatggtggcgttggttttccatcgcttctctccttggagacgtcgtttaggtatccccttgccgaaatcactcgagcaattggtgcaagcacgctctagattctcatcctcttgcggcagcatcctagttcctacaagttggtcacgtcggaggccctagggggagaggtgttccttcttttctctcaccccctctccttaaatccggaagacgtgaatagagtcgggctttgtgttggttgtaagggcgtttttgggcgatctcgtctatgtcccgttgttggcctagcggtggtcggtcacgcttagcggtggccggtccggtgctagccttctcccggatctgtgtgttggcgctgtcggtgtgtgggtggtagtatattttttttcctttttcctggttacgaccttccaaggttgtaatcttgtaattttttcctgctctatcaatagaacttcgcaccgtctcgttaaaaaaaaagcggcagcaatctaaaacaaaccaaacgccaaaacattgcatggggctagcaagatcaatcaactcgtattctgttttgtcttagagcagctcctctctccttaaacctctttaccagcttctctagatcactcttcatctccagccgatgcaaaggactccactgcaataagaaagagacaatttggaaaggtagtattaggggtgagtaaacaagtttatccctgaacacgatgttgtttctcgttgtccatatatagagtccagcaaatggcagcaagcagggcaattttcacagctatatgtttaattcagctctaatgtcagcaaggataaagaagtcaccaaggttaagaggaacatgatcccagttcagcacatctctacagaaacaccaaacaaaatgcgccaaagggcagctaaagattatgtggtttgtagtttctagatggatagtggagaaaaaaaactaattttaaaacggatttgctgaaaaagtgacgccacattatgtggctgagtacagtcggattttaacggctggtatgcgctgcgctggacatcgtgtgcacgatgcacatccgtttctccacctgtttatccctttgcattttttttactttatttgttgatccggagttgctatgggtttgtagcagtcaattgactttattgttgtaattatatatttatacaaatttacatactagttacaccccacttacgcatcatttacatatggttaatatgtaattttaagatttacatatgtaattttaagacttacatatgcaattttagaacttaaattgtaaatacattaaaattacatatgtaatttagagacttacaatataaatacatatcgactattttttaatgaaaaatatgacgccataaatacagttagtccaatcagtaactagagggtgagcgtgtacggtacggggtcgaccgcgggccacggccggtggggagcacaacggctacagtctatatttattttagtgctagaggagacacagacagtaatatatgctagtatcaattatttgaagagttcagtgacattgtaccataagtacgaaacgaatactccactttagtggcatgtggtttgacttactcttgtttcgtcgtcacgcgccaggccgagaacgggtccaatggaggatacctcaaatacagactcagactggcagtataggaagttgtgtcgttgctcctccagctggagaagccgatcagtacacagtactagtatcacagtactgtatcagtatcaccttgcacacgatctatcgacgctggctcgccggcggcgatggccatcttttcgttgatcacttgtgctgccgacctcgtcatcttcttctccgtctgctacatgcagcctccggctcctgtcgccgccttgtccttcaactaccccaccttcgcctcctcacacaaccagtacatcgaaattgaaggcaatgcctctgtcagcgtcgggtatatcgacatcagtgcgaacagtgtgggcaacaacgtcggacgggtgttctacaaaccgccagtgcagctctgggacgccgccaccggcgaggtggccagcttcaccacgcgcttctccttcaacataatcgctccgagcgatagaagcaaaaagggcgacggtatggccttcttcctcaccagctatccatcgaggttaccagtgggccacgaaggtggcgaaaacctcggcctaacgaaccagacagtcggcaacgtctcgaccggccagaaccggttcgttgccgtcgagttcgacaccttcgtcaaccccttcgaccctaacacaaccaacgaccacatcggcatcgacgtcaactccgtcgtatctgtgacgaacgagtccctaccaaacttcagcctcatcgggaacatgaccgccaccgtcgactacaacaacaattcgagaatactgtcagttaagctatggataaatggctcgacgacgccttacacccttagctccatggttgatctcaagagagccttgccggagaacatcaccgtcggcttctcggcatcaattggctcagcctatgagcagcatcagctgacttcttggtacttcaagtcgagttcgtcgttcgagcagaagctggcagcaaaagtagcatctccgccgccgccgtcgtcaccgtcaccaccaccgccttccctgaccccgataacgtcgcattccagacgtggcggagttgtagcgggagccacagttggtgcggtaatgtttgtcattctcctcttcgccatggtagcagtccttgtacgacgacgtcagagcaagaaaaggagggaggcagaggatggaggctggcacggcagtgacgatgacgacgacggcgagcccatcgtggagattgagatggggatgggaccaaggcggttcccgtaccacgagctcgtcgacgctacgaagagcttcgcgacggaggagaaacttggacaaggcggcttcggggctgtgtaccgtggctacctgagagagcttggcctcgcggttgccataaa

SEQ ID NO: 48409 - DNA, 4624 bp, Oryza sativa
ccattatgtgcaatcaacacctttgaaattcaactgatcagctagcttggatgttgccacaggatcaacattgttcatggactcggttctgcactactctacctccatgaggagtgggatcaatgtgtcgtgcaccgtgacatcaagccaagcaacgtcatgctggatgaatccttcaatgcaaagctaggcgacttcggtcttgcaaggcttattgaccatgccgttggggtacaaacaatgacccacccctcagggacgccaggctatcttgatcctgaatgtgtgatcacaggtaaagcaagcgctgagtctgatgtctatagttttggcgttgttttattggaagtggcatgtgggaggagaccaatgagcctactggacaaccagaacaatagcctcttccgactggtggaatgggtctgggacctatatggccagggagtcgttctcaaggctgcagacgagcggctcaacaatgactatgacgcaaccagcatggagtgtgtcatggccgttgggctctggtgtgtgcatccggaccgatacgcgcgtccatctatcagagctgccatgacggtcctccaatccaatggaccactaccagtgttaccatccaagatgcccgtgccaacatatgcaccgcctatggcctcgtcggaggggcaactttcatcatcgacaggaatgtcatcctcaagtttgacactaacatcaatcacacctcgctagggtggcaagttttcgcactcataggataagtatagcaagacaacttttgtcatatctagattttgagtaaatttcacaaaactacagatactatgaccaaactatcacaaaactacagatttaaggagttgtatcataaaactacacatttagctccaaatttatcacaaaactacacatttaagatgaagtgtcacaaaactacacgtttagtaactaaattataataaaactacaggtttagaatcaatttaatcacaaagtaataatgtttatagctccaccataaccatagtgctagggatttaaactctaaaagttgtagttttgtgataagttcaatattaaatatgcatttttgtgatagttaacctaaaatttggagttttgtgataaatttgggggtaaatgggtagttttgggaatcagctttttaaatctgtagtttgtgataattggtcaaaatacctgtagttttgtgaaatttactcctagatttttatccataccaacaagtcgaactacttgcatccctacacctcagttcctttcgcatactttagccggtttgaagggctcatcttcgttaattgctccgtacagtagccatgtttagttcattttacatgttctatatttacaagttgccgcttgaataggatgtacagctcatgaggcaattggtttgctctttagagagctgcctaattggcaacatgagtaattgtgttcagtttacatcatgctttcagttttccaaccatttagttattttgtccagaaaacttttccttcaatttcctctccaacaatccaaccaaaccgtccatatctctgactgttattcactacatacttttcttgttttaagtggatatcctagtccttagagggtctggaattgttggagttgcatgaaattcagaaacataaacaaaaaaaaaatgattgaagacaccaatagaagagacctcttgcaggacatttgttcattgttgatagatctcatatgatattcagctaatgctggccaacgaccgcattgattatcacttaaacttttgttttgtcctaatgcattcccttctctggctaacacctagaatggtttcagtctagaagatctaaatgtatataacatgatcacaaaaatcatataggtatcacactactaaaattcagaacaatatatctcaatttgcagaatacttttgatacattatgtttcattcatgttgcttctatcgttggctctcatttcgtcaagcaaccagcgtaatagaaataggtgaattggaattttcagtgcagtttcgaactggtccctttctccaaatcttcattaccgtggaagaacaaagtctaaagtattgtttcaactttcaagacaaaatgagaaagctcaatccgaaaagtaaaggcacaagaaagaggaaaaacaacatgcaacacaatggcgttaacaagaggaaccaagataggtaacactaccatcacaggcttttcgtcgataaacaacaggaacctagatataattaataagctaaatttaataaaataaatagaatataggctctagctactgtaaacaagagcacaaagagcctccaatcattttctactgaagcagttcttatgcaatcgtctcaaattgtggatatttatgttcagtactccggtgttgattgaacgcggaatcgagaacatcgaagcaaaattgttaacacacaaaaataacagcagccaattgccagatttaagacataagagattcatgcagcaagcatatcgtccaagattgacatctctgctacttcacagagtgatcaagccaaaatttgaaagagaagagttggttctgatagggtcagcagtggctttactgctgcaatttcctcaacaaaatctgataggcttttttacggtgtttgcattccaaaaaaggtataagatccaacactcctcaatcataggtatcatgtaaaaggtatttaactattggtataggtacttaagtactaaggataaaaatataattttactattagagcaaaaagggtagaattgtctccaaaattagaatcggtaccgcgtaggtactcccgtacgaagttaacattaatttccccggtaccagctttacatgttattatttgcgtattttctcttttatgtggttttctctagatttgatttacgttgtgtttgagttaagtcgtttagtcggcactagcattacaggttcttaagttgcatcattttatctagagttacaccgttctttgatgttctcttttacgtgtttttctctagatttacgttgtgttcttataacctgcacatgtcaatcaggtcttgcctcctgtcaaatgctcgaccatgccagatttttttcctcgaccgtgtctcctcgtgagtgcacctgttcaaacactagaagaacaccataggcggagatctcatttactatcccacagaaattccagtaccttatataaggagtttataaactacataaataactaaacaactgtgtgaataagcataggataacttttagatgcgctagcttgcgcctagtcatcgaccgggctacctcatctcctcttcaaccctcaaccatgcagacgctttttcctctgtctccttccgttgaaccgttcaaaccctagaacaagaacgaagcgaagggagagaagaaaggagatgcgatctttctgtttattttggtacagatcgaattgatcgctgctaaatcaacggtgtatccgtgatttacttttttttcctcacgacataccaatctgcacaatgatatactgatcgatggatataggtattcaattcatgtataatgcccatgttttactagttaattactccattgccatcatgttacaataattttgtttcgtaccttgcccctctcttgattaagggtacacgttgttccacctccagatacctttaaatacctcgcaattgccgtaaaaggtctcgaaaagtaattgaaagctcatactgtcagtagagagttcactgtctttttcaacacggtgacggtcgtgtgcgtgtatgctgcaagctggaactcagcacttaattcggtcttcgatcggttgtactagatgacaacaaagctcaaatttgcggagactaaactccacggccaaaggggagtctttaaagtctttctgcgatccgcatcactctccatcgatcgatcagtggagttggcacaatatagtttcagataagctgggccattgactgaccgctgggctcttgttctgcgtcaaacgactgcatgaggcaaccctgaatatctctcaagtctgaacattacgatttacttacaattatgcatgtttctccgtctctccgatggatcatggagattgtagcagcatcgttgatttttggggtattgttcttttcagctcgacaaagacaattattgtagtccagcttccatagttccacattcacatagctccatcaaaaagaagggttttttttccagggagaaggggcaccattcactgccagtgcactacaagcagtgtacgcattgtgcatcgactcgttgctccaagtcaagccagccgatcaacccaccttgcggcttgcgcgccgacgctggctctggccggcggcgatggccggcttttcgttgatcacttgcgctgccggcctcgtcaccttcttctccctctgctacatgcagcctccggctcctgtcgcccccttgtccttcaactaccccaccttcgcctcctcagacaatcagaacatcgacattcaaggccaagcctctgtcagcgtcgggtatgtcgacataagcgcgaacagtgtgtcgggcatgggcaacagcgccggacgggtggtgtac

SEQ ID NO: 48410 - DNA, 8283 bp, Oryza sativa
taaactcttcctaattactagataaattgccatgccgcatcctcctcgaacttggtctcttctggataagtttccttaaatagattaatttccttaactgaatgctacaagaatccgactattggcgacatgataattctcggcaaaatctagatcaagaggcctctcttttagtgctaacgagagatcctatctagatgccttaactgtaggactagtccccatcaattaagtagaaaatatattcctatcacctatgtttcaaatgaaattttctcttaaactactcatccgatttatgatccaattacacggttgtgttcgtaagaattaaatctttacaacaagatctcacatgattatattttgatgaaaaattacaaattacttttatagtatatctaaattacttttagatttcactaaattacttcttagacatataaaagtaatttcagtaaagcttaaaaataatttattatagaagtaacttaagacaaaaaggaagtaactttgtcatgacattaaagtagatccgttatggaggtaaaaacgtgagtctatctaaaaattaaatttaatcagcacgaattatggaattgactaaaaaagataataaaataaacaactcacaacattatggttgtataataagtaatttaatcaaatcgaaaagtaatttatatatatgataaaagtaacttacatatataataaaagtaatttacaacatagatatttcttttatcaaaatatagtcatgtaagatattgttataaagatttaattgcaacgaacacaatggtgtaatcggatttgatgttaatgaatctagatagatatatatgtctatattcattaacatcaatatgaatgtgggaaatgctaaaatgacttacattgtgaaacggagggagtacttctctgtttatatttgaaaccgggcaatgaattgaaaagaaaagggaacagaacggccttgtgaacgcggccaccggagccgccagcgcccggcaggacgatttgccgaccagcaacggaaggcgatgtgccgtcgagtagccaagcgatagatctaaatgtacaaaaactttttttaatgaagagtggataatatcctaaataccaaccttacctctaatcactaagttagtaaagtactaaaatgtccttatgaatcaacggttcaaatcaattctactagttgtataatactacgagtagagagtaccgagcatcgctctttattttttgggaatgctatgaatctggaatcgcatattaggtttcatttatacatctatagtcaaattcatgtacacacaaaaaaagccgaccctaaaaaatatgattgaattcccagttagatttgtatttatctatctgtatagattttattttagtggaaaggtcgcaaggacccggcctatattgaaagccaaccacgagcagagtttttgctgcggttaccagctttacaaaatggagcacagaaagcactcggagatgattaagtaccaacagacaaggggtatattaagggggtgtttaggtgagagaaggactaaactttagtccggacttattttttttgtgagagggaccctctcacccaaacaccccctaaacctctaaagactagacggcagcaatctaaaacagaccgaacgccaaagcattgcacggggctagcaagatcaaccaactcctattctattttgtcttagagcagctcctccctccttaaacctctttaccagcttctctagatcactcttattcatctccagccgatgcagaggactacactgcaataagaaaagacaatttggaaaggtagtattaggggtgagtaaacaagtttatccctgaacatgatgttgtttctcgttgtccatatatagagtccggcaaatggcagcaagcagggcatttttcacaactatatgtttaattcagctctaatgtcagcaaggataaagtcatcaaggttaagaggaacatgatcccagttcagcacatctctacagaaacaccaaacaaaatgcgccaaagggcagctaaagattatgtggtttgtagtttctagatggatagtggagaaaaaaaactaattttaaaatcagtaactagagggtgagcgtgcatacggtacggggtcgaccacgggccacggccggcggggagcacaacggctacagtttatacttattttagtgctagaggagacacagacagtaatacacgctacttccttcgtttcataatgtaagtcattctaatattttccatattcatattgatgctaatgaatctagatagttatatatgtctagatttattaacataaatatgaatgtggaaaatgctagaatgacctacattgtgaaacggagggagtagtatcaattatttgaagagttcagtgacattgtaccataaggacgaaacgaatactccactttagtggcatgtggtttgacttactcttgtttgtcgtcacgcgccagcccgagaacgggtccaatggaggatacctcaaatacagactcagactggcagtataggaagttgtgtcgttgctcctccagcaggagaagccgatcagtacacagtactgatatcacagtactgtatcagtatcaccttgcacacgatcgatcgacgctggctcgccggcggcgatggccgtcttttcgttgatcacttgtgctgccgacctcgtcatcttcttctccgtctgctacattcagcctccggctcatttcgccgccttgtccttcaactaccccaccttcgcctcctcacacaaccagtacatcgaaattgaaggcaatgcctctgtcagcgtcgggtatatcgacatcagtgcgaacagtgtgggcaacaacgtcggacgggtgttccacaaaccgccagtgcagctctgggacgccgccaccggcgaggtggccagcttcaccacgcgcttctccttcaacatcatcccgggaaatagaagcaaaaagggcgatgggatgaccttcttcctcaccagctacccatcgaggttaccagagggcgacgccggtggccaaaacctcggcctaacgaaccagacggtcggcgtctcgaccggcgagaaccggttcgttgccgtcgagttcgacaccttcgtcaaccccttcgaccccaacgcaaccaacgaccacatcggcatcgacgtcaactccgtcgtatctgtgacgaacgagtccctaccaaacttcagcctcatcgggaacatgaccgccaccgtcgactacaacaacaattcgagaatactgtcagttaagctatggataaatggctcgacgacgccttacacccttagctccatggttgatctcaagagagccttgccggagaacgtcaccatcggcttctcggcatcaattggctcagcctatgagcagcatcagctgacttcttggtacttcaagtcgacttcgtcgttcgagcagaagctggcagcagaagtagcatctccaccgccgccgtcgtcaccgtcaccaccaccgacttccagacgtggcggagttgtagcgggagccacagttggcgtggtaatgttcgtcatactcctcttcaccatggtacaagtccttgtacgacggcgtcagagcaagaaaagaagggaggcacaggatggaagctggcacggcagtgacgacgacgacgacggcgagctcatcatggagatcgagatggggacgggaccaaggcggttcccgtaccacaagctcgtcgacgctacgaagagctttgcgccggaggagaagcttgggcaaggcggtttcggtgcagtgtatcggggctacctcagagagcttggcctcgccgtcgccataaagaggtttgccaaaaattcctctaagcaagggaggaaggagtacaagtcagagatcaaggtaataagccggctacgccaccgcaatctggtgcagctcattggctggtgccatggccgcaccgagctgctcctcgtctacgagctattccccaaccgtagcctcgacgtccatctccacggcaatggcaccttccttacatggccaatgaggtttattaattaactcattgatttagtaattttcgttatgtgcaatcgacacctttgaaattcaattcatctgctaacttggatgttgccacaggatcaacattgttcatggactcggatctgcactactctacctacatgaggagtgggatcaatgtgtagttcaccgtgacatcaagccgagcaacgtcatgctggatgaatccttcaatgcgaagctaggcgatttcggccttgcaaggcttattgaccatgccgttgggatacaaacaatgactcacccctcagggacaccaggctatcttgatcccgaatgcgtaatcacgggcaaagcaagcgctgagtccgatgtttatagttttggcattgttctattggaagtggcatgtgggaggagaccaattagcctgcaggacacccagaacaattgcctcttccgactggtggaatgggtgtgggacctgtacggccaaggagccgttctcaatgcagcagacgagcggctcaacaatgaatacgacacaactagcatggagtgtgtcatggctgttggactctggtgtgcacatccggaccgatgtgcacgtccatctatcagagctgccatggcagttctccaatccaatggaccactacccgtgttaccagctaagatgcccgtgccaacatatgcaccgccgatggcctcagcggaggggcagccgttgtcgtcctcaagtttgacactaacgtccatcacacctcgctaggtttgcaagttttctcactcataggatttgtatagcgagataatttttgtcatatttagatttttatccatacccacaagttggtttggaggactcatcttcgttaattgctccatacaggagtattagtcatgtttagttcattttacttgttctacatttacaagggatatgtacagctcgtgaggcaattggtttgctctttagagagctgcctaattggcaatgtgagcaatgtgtttagtttacatgatgctgtctattttccaagcatttatttattttgtccagaaaacttttcctacaatttcctctgtccaacaatccaatcaaacagtccatatatctaactgatatttgttacatacttttcttgttttcagtcgatatcctagtccttacagagggcctggaaatgttggagttgtaagaaactcagaaatattaacaaaacagaaatgatcgaaggcaccaacagaagagacctcttgcaagacatgtgttcattgttgatagatctcatatgatattcagctaatgctgtccaatgactgcatagattactaccgaaacattgttttgtcctaattcatccccatctctggctgagatctagaatggtcaggggcggatccagcaacagaaaattggggggcctcaagtacgttgtttctctaacctttagccatctaaagacctttagtttattatttatggtgaaaaaaattaaagaaggtgctctgggggtatccatgggtcttgtgggtgtaggggggactcgagtccccacgttggatccgcccctgagaatggttagttacttagttcagtctaaaagatctaaatgtgtataacatgatcacaataatcatataagtatactaaaattcagaacaatagatctcaatttgcagaatactttggatacactgctgctatgctctcgtttcgtcaagcaaccagcgtaacaaagataggtgaactggaacttttagtgcagtttcgaactggtcatcttctccaatcttcattaccccgtggaagaacaaagtcttaaagtgtagtttcaaagcaaaaaaaggaagggtacaataaagagattaggattctctgtacctaggtgtcatgacacccaacatttatgtgcgacttaaatagttattgaaaaaaaataaaaaaattagtaacatcaattgtgatgatataagtctgtacacaaacatgcaagtttctatttgatctacaactagaaaaataaaaataataaaatttgttaattttatttcttcatgtgtctgctagggaactcatctttagtcctttagtcctgcttcacagcccctttaatcccgggttacaacccgggactaaagatgcctattattagtcccgcttgaaataaccgggactaaagatctatcttttgtctcggttggtaatttttagttccgcaccaaccggactaaaaattgtagcgctaaaatttggactaaaaataaaataaaaatctgaaattagaaaaatatcaaagagagttcaagtagggttataattttgaaacaactaaaatcgaaacaataattaaggaatattaaaagaattatccatatagaacacaaaacgagattaattaaaattctaaataaaaataaaataaaatatgaaatttaaaaagaaaaataagagtttagttaggaatacaaattaaaaattcataataaaaaattaaatctattaaaagaagagaccatttaaaacacatgacgagatcaattaaaattttgaataacaaataaaataaattccgaaaatagaaaaatagttagatgaacattttttagatgtatttgtgaatttgcggtgtccatttgatatgtgatgttcaatatgtgaatttgagtatgttcattcgatctgtgaatttgtgacgttcattcaacctgtgaataacaatgaaaaaaaggccaatatgcaaacagcaaaagacaatgaaaaaagaaaaaaatgttcttacatggacttttctttcaatattacatattttaatttcgaattttagttattttttactttctagcccactaaccgccattacagtgttgcttaacgacttgcccgtagttcctcttcttaatcatcgttgggattctaaaaatcgaacctaatcatcttttcggttttgttaatagttttcatcagatgtcccattaaccgtcaccacactattgctttataggtctgttgttcctcttctctttattatcatttgctattattgtatttttttaatggactattgttttacaattttgtattttttcattccttttttatttgaaaattttatttctacgtgaactcttatttttatttttctattttttggagcttattttattttttctgaattttagttaacctcgtattctattctacatgtatgttcttgcaataatcatttttattttaaaggaaaaggatataattggagagaaaagtgaaaagaacagtagaggataaccagcaaaatatcaggttaggaaaggagaaggataaaattggagagaaaagggaaaagaacagtagaggataacatgtatgttcttgcaataatcatttttattttaaaggaaaaggataaaattagagagaaaagggaaaagaacagtagaggataaccagcaaaatatcaggttaggaaaggaattggataaaatggaaaaaacgaagagatcgatggaatcgaactcatgaactattggtcaaatgtttcagtctaaccaattgagaatcatcgacattgtgctacattgtgtagctacattttaaaaatatgggtaacgttagtgtgtccgcccctgcaccctatacatgttggagcgcggtaaagaaaaaaaattggtatggacccgcccacctatcgaaccttatctccttctctgaaatcctccacctccgcttctcagttctctctggtcgctttctccgtctcccgaatccccgtctctcctcctttgccaacagccgagagttagagagagcgccgcgccgccgcccccgtctcttctcccaccggtccctctctctccctctcgtctctcccttgccggtagcagaggaggtggcagcgatggcttcagctgctcccgcgggccggatccgggagtggcggtggagtcggcggctactattggcggatccggtgacggtggcggtggcggtgtttccggcaggcggatccggcgggcgattctctaccacctcctcctcaccctccacgcccaagcttgtcctgcggcagcggcggtgacatcggtgctcccgtgggcagatccagcagaagtggcggcggcgttctttttggtgggcggatctagtgtcacgcaatttctatccaaaattccaaacgcttacatgtgtgtgaaccctcgtccaggaatcagccgaggcaca

SEQ ID NO: 48411 - DNA, 3114 bp, Oryza sativa
  unsure (1)..(3114): unsure at all n locations
ttatagttttggccattgtctaatggaagtggcctgcgggagaagaccaattagcttacaggacacccaaaacaattgcctcttccgactggtggaatgggtgtgggatctgtacggccaaggagccgttctcaaggcagccgacgagcggctcaacaatgaatacgacacaactagcatggagtgtgtcatggccgttggactttggtgtgcacatccagaccgatgtgcacgtccgtctatcagagctgtcatggcagttctccaatccaatggaccactacccgtgttaccagctaagatgcccgtgccaacatatgcaccgccgatggcctcagcggaggggcagccctcatcatcgacacgaatgtcgtcctcaagtttgacactaacatccatcacacctcgctaggtttgcaagttttctcactcataggatttatatagcgagacaattattgtcatatatagatttttatccatacccacaagttggtttgaaggactcatcttcgttaattgctccatacaggagtattagtcatgtttagttcattttacttgttctacatttacaaattgacgcttgaatgggatatgtacagctcgtgaggcaattggtttgctctttagagagctgcctaattggcaatgtgagcaatgtgtttagtttacatgacgctttcagttttccaagcatttatttattttgtccagaaaacttttcctacacctctccaacaatccaatcaaacagtccatatctctaactgatatttgttacatacttttcttgttttcagtcgatatcctagtccttatagagggcctggaattgttggagttgtaagaaactcagaaatattaacaaaacagaaatgatcgaaggcaccaacagaagagacctcttgcatgacatgtgttcattgttgatagatctcatatgatattcagctaatgctgtccaatgactgcatagattactactgaaacattgttttgtcctaattcatccccatctctggctgagatctagaatggttagttcagtctagaagatctaaatgtgtataacatgatcacaataatcatataagtatactaaaattcagaacaatagatctcaatttgcagaatactttggatacattgctgctatgctctcgttttgtcaagcaaccagcgtaacaaagataggtgaatttgaactttcagtgcagtttcgaactggtccccttctccaatcttcattaccccgtggaagaacaaagtcttaaagtgtagttcaaagcaaaaaaggaaaggtacaagaaagcgactaggttctctacacctagtaggtgtcatgacacccaacatttacatgtgacttaaatagttattatagaaaaaattaaaaaaatttagtaacatcaattatgatgatataagtctatacacaaacatgcaagtttctatctaatctacaagtaaaaaaataaaaataataaaattggttaattttgtttcttcatgtgtctgctggggaactcatctttagtcctggtttacaacccctttaatcacaggttacaacccgggactaaggatgcccatcattagtcccgctggaaataacccgggactaaaaattggagcactaccattcttagtcccggttggtgttaccaaccgggaataaagttttttttcttttttttcagtgttttttgctgtttgcatatgggcctttttnttcattgttttttcacagatttaatgaacatcacaaatttatagatcgaatgaacatactcaaattcacatagtgaacatcacagatcaaatggacaccacaaattcacaaaaacatctgaaaaaatgttcatctaattatttttctattttcgaaatttattttatttgttattcgaaattttaattgatcccgtcatgtgttctaaatggtcttttcttttaaaagttttaattttttattatgaatttttaaattgttttcctaactgaactcttatttttcttttttttaattaaatattttattttattttttatttagaattttaattcatctcggttggtgttaccggactaaaaattgcagcgctatcccggttggtgttaccaaccgggactaaagttttttttcttttttttcattgttttttgctgtttgcatattggcctttttttcattagttttcacagattgaatgaacatcacagatcaaatggacatcacaaattcacaaaaacatctgaaaaaaatgttcatctaattatttttctattttcggaatttattttatttgttattcgaaattttaattgatctcgtcatgtgttctaaatggtctcttcttttaatagttttaattttttattactatttttaaattgtattcctaactgaactcttatttttctttttctaatttcatattttattttattttctatttagaattttaattaatctcgttttgtgttctatatggactattattttcatatctccctatttatttttttcaattttagttgtttcaaaattatatcctacttgaactctcttttttatttttctaatttcagattttattttatttttagtacaaattttaattaatcacaatgtgtttttatatggacttttctttcaatattacttattttaaattcaaatttcagttatttttacattctagcccactaactgccattaccgtgttgcttaacgacttgcccgttgttcctccccttaatcgtcgttgggattctaaaaattgaacctaatcatcttttcggttttgttaatagttttcaccagatgtcccgttaaccgtcaccaccctattgctttataggtctgttgttcctcttctctttattgtcatttgctattattgtattttttaatggactgttcttttaaaattttgtatttttttcattccttttttttgttatttgaaaattttatttctatctgaactcttatttttatttttttattctttggaacttattttattttttctgaattttagttaattaacctcatattctattctacatctactgttctctcaataatcatttttattttaaatt

SEQ ID NO: 48412 - DNA, 1316 bp, Oryza sativa
cctacatggactctctttttctttttttcgattaatgtgggaatttctagcacccacagcgaacttggtgcctcttttcaagactgttttaataatataactagttaggcggcccgcgcaattgcgtggctagcatcaatttaaaattatctattttttacacatgattttatttaaagttatcattcccgtgattctaataattttatagtttttaaaagccacaccagtctttatccattacttccttgtcacctttttatttgcttacttgatctaccactacctttactcatcttctttagaacttttaaaattagtccttatagtttttagagttcattgttttgttgggtttcgttttcataatttttagaagtatcttccaacatcgccagtttactactctacggcccgtccgctaccacctctctttattgttattgggattttaaaaatcgaacataattattgtttgtgttctttttttacattttataagtctcgccaaatcattagtgacttcgccactatactcctctacagctcacctgctccctcccatccttattgtcattgagatcttaaaaatcggatatgattattattggggtatattttcactctccttaagtcctgtcaaccgtcgtgaccatgctgcttaacggcatgcccatcgtcactcctcttaatcatcattgtgattctgtttgggattttgtttatagtttttagatatcccatcaaccgctagtactctacctattgcttctcccctttttattgtcatttgtcatcgttgtgttctagatggactttttttttaaattgcatatttttcattctgataatttttattcataaattatattcctacttgaactcttataattatttttctacttttgaaatttattttatttgttattttgaactttaattaatctcgtcatgtattctagattgtgtcttatttcaatagtatttatttttattacaaattttagtatttataaattgtattatagttgagatcttatttttctttttctatttttctgaatttattttattttttatttcgaattttaattattcttgtattgtgttatatatagactatctttttaatagttttattttccaatttcaattgtttcaaaattatattcctacttgaactctcttttttattttgatttttaattaatatcgtattggtttattatatggactcttctttcaatattgcttatttttaatttcgaatctcagttaattttaaagttttattcctacgtgaactcttcttttat

SEQ ID NO: 48413 - DNA, 997 bp, Oryza sativa
gaattcatgtttcgacaggtagaccatagattcaagatttgatctaatactaacaaaaacttgatcaatatttaatgagataattttagttattatcttttctcatctatgtacgtgcatggctaccaaaaattaggagcattcggtctgtttgtttcctagtcctttccttgcatatggccgtatacgtaagttggacatgatttttttggggcatttgcaaatttgccactggttttttcaatattgcaaggatgccactcgactgacagatctagtggcatttttgtaattttctagtagcagtcttacaataacgattcaaattagtagtaaatttgcaattgcccctttttttcctattacccgacaataatcaggccatgcaatccggttcatagagcacttggagtcatgttgatgtaaaaagaaaatacacactggcctaggagatctgtttagctctagtgcaggtccaagatgttgatgagatgcgggtgtgtcagtcagtttgatcctgcaactgacaagatatgtaaacaatatatcagatagccgatcgcctgacaagccgatggagtaattccagccgatagccgatactaaccgatgccgattccagccgatgtcaatagggttttgagcaatcggctatatgttcaatgtagataataatgcaaagataatcggctgatgataataaaatatagttataatataaaccaacaaaaaccaatgggctaataataatatgataggataaatactgatccgatggttaaagcatacatcggctggaggtctgatgctataaaatccacaagagtagattaaacaatgaaacctttgttgtcatcagctaaatccaatttatatatgcaaaccttataagttgatgcaacgtctagataactcatcgattgaaaccccgataaaacccttattggtagtcaataagcaggctagagattatggttctaagcacgccttaatagat

SEQ ID NO: 48414 - DNA, 1719 bp, Oryza sativa
ttgtgtgctgggccgttgttgcccgtgtaataattatatttacgcttccgcttggtaaactttgaattgtatcaacttttggtgtaccttgcctcttgggacaaggaataatacacgcacgtcaggaacgcctgttgggtgatttccggtcgtgacaattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggattgttgcaacctttgaagattcctgaatggaaatgggaagaaattggtatggattttattactggtttacccagaacgtcatcaggccatgactctatttgggtaatagttgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccttatgcagaattttcatacaacaacagttatcaagctagtcttcagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctttacgaggagttcatcgttttcataccaagggaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctaccgaagaagctaatattgagcggatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattgaagtcagctcatccgcacctgtttgccagttcttccgaatctcgaggacgagattctgtttaaggggggtaggtttgtcacaccctgaaaattcaaaatatataaattgttgtttaattggaatttttagaaataattttaaagtcttgaaaagaaaatctaagtttaattaataaattccaatataaaattgggccagataaaatttcattaaatactttgcttaattctataattcctagatttttctgggatttatttgagctaagaaagtatttgtaataaatggaattgcatttaagaaataatttaaattgaaaaggttttaaaaagtcttcttttggctttgggccgaaagtcgg

SEQ ID NO: 48415 - DNA, 5771 bp, Oryza sativa
cggcgcgcccgcgccccgatggtcaccgccggcgaccatcggcgcggcggagcggcgcccgagagagcggagagaagggggaaagcgaacggcggtcttcggctcaccccgggacaacgacgacgacgagaacggcggccggagcggaggaaagcggcggcgcggttcgggatgacgatgacgacggtgctccggcggtcggcgggcgaagcggagcggcggacggggtcggcaaccactcggcgaagccgatggaggtggcgccgagtcgggaggaggaccggagcgacgacggcggcgaaacggaggtcggcggcgacggcggagagagaggagcacggcgcgagcacggatccgacggcgagagcgagcggcgagcggcggaaacggaagagcggagctcggggagcaattatatagcaccgagagggggagaacgcggccggagaggaaggaaacgggcgcggggatctcgggctccatagatgtcgccggcgatgaatgcgggaaggaaatcggacgaatccgagggagagagagaggggaaaacgggggaaacgggagagggaatcgcggggaatgattcccccctcattaaggcgcgcggggaaggcgggatgcggcggaatccgcggcggcggcggcgctagggcacgggcgcggcggcgggcgcggcgggaggaaggcgatgacaggtgggccccacccgtcagcgagagtggcgggcgggcccgcctgtcagcggtgcgcgcgcgcggggaggccgatgggccgcgggggaggagagagagagagggagggagaagtgggccgagccggcccaagagggaaggggggggaaaaagaacttcttttagggttttctttttataaaacctttttaactttgtttattccttttcaattattatttgtgctctgaaaattccactaaaatttatttaagcattttaggcttttaggaaatatacaaaaatcctccaagcctcatttgacttttatctttgcccattttaattgttggaggctttcacatgaattttaattattctttgcacaatttcgaggatgaattttagagtcgatttgggacgcgacaaacctaccccccttaaacggaatctcgaccccgagattcggaagaactggcgaagagatcgggatgggctgccttcagttcgtcttcgcgctcccaagtagcttcttcttcggcgtggttgctccactggaccttgcaaaaacggattactcggttcctggtcctgcgctccatggtgtccaggattttcactggcctctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaagcaacttctccgcgtcgagcgatgatacggaagggacccacataccgaggtgcgagcttcccttttgtctgaaacctgtgcacacctcgcaatggcgtgacccgaagatacacaaagtcatccactgcgaattccagatcacggcgacggttatctgcataacttttctgccgagactgtgccacctttaggttatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttggtagctgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaattcaatcgagtacccagctcttcctggagcttcttccaaaagtgagaggtgaattggcttcccctatcagatacgattttcttgggaataccatggagactcacgatcctagcgaagtagagctccgctagtttattccctccataggtggtcttcacaggaatgaatcgagctaccttggttaatcgatccacaattactcatatagaatcatatccaccttgggtttttggaagtccggtgatgaaatccatcccaatttcatcccacttccattctggcacttagagaggctggagaagtccggccggtcgttggtgttctgccttgacacgctggcacacatcacatagagccacaaactctgcaatttcccgcttcatgctaacccaccagtatttctccttcaagtctaagtacatctttgtactgccagggtgaatggaataaggactttcgtgagcttcctgaagtatcagctgtttaagttctctgttatcgggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagccaagaatccgcgaccaactatgcttaggttcagggcttccatctgttgattaagctcgggtggaatgcctcggacgttgagagtgttgcagtggctctttcgacttagagcgtcggcaaccacgttggccttaccaggatgatagtgtattcccacatcataatccttgatgagttctaaccatctcctttgccgaagattcagatccgactgggtgaagatgtatttcaagctcttgtgatcagtatatatttcacagcggttcccaatgagatagtgccgccagatttttagagcatgaaccaccgctgctaactccaagtcatgtgtagggtagttgccttcatgaggtcgtagctggcgtgaggcataggctaccacatgaccgtcctgcatgagcacgcaccccaatccttggcgcgaagcatcacagtacaccatgaaatccttgcgagtatccggcaagattaacactggtgaggaaaccagcttttctttgagagtttggaacgccttctcgcattgcgggctccacacaaatttctcttctttcttcaacaactgtgtcatgggtcgagcgattttggagaagttctcgatgaatctccggtaatatcctgccaaacccaagaaactgcgaatctgagtgactgtcttgggttgcttccaatcggtgacggcggtcactgtttcggggtccacagcacctcctttagcaaattttacgtgccccaaagaatttgacttcggacaaccagaactcacacttgctgagcttggctacaattgatgttcccgcaactttcccaacaccagacggagatggtgctgatggtcttcctctgattgtgagtatatcagaatgtcatcgatgaaaaccacaacaaacttgtccaagtattccatgaacactttgttcattaagttcatgaagaaggcaggagcattggtcaagccgaacgacatcaccgtgaattcatacagcccgtatcgcgtggtgaatgcggtcttcggaatatcttcttcccgaatacgtaattggtgatatccggaacgaagatcaatcttggagaatacagtggcacctttaagctggtcgaacagatcatcgatccggggaagagggtacttgtttttgatggtgacttcattgagagctctgtagtcgacgcacatcctcttcgtcttgtctttcttctctacaaaaatcacaggagcaccccaaggggaagtactcggacgtatataccccttttctttcaactcttccaactgtttcttaacttcggccagttcatttgctgccatacggtagggtcgcttgtgcagaggagtggttcctggagcaagatctattcggaactcaatctctcgcttgggcggcataccaggtagttcttccggaaacacgtctccgaactctctgactatggggatttctgacagacctatctgatgcagttctgaacttctgacagaggttgggggtgcaaagaaaacaaccggttgttctggccctcggtacagagtgacagtgcgcctcgcgcaatccactactccttggaattgagccaaccaattcatcccaaggataacatccaaattcttggtgtctagcagaatcagatccgagggaaaaggaatcccctgaatttctataggaacggcagggctataatactttgctgtcataacccctccaggggtggtgatgagcagagggtttctaagcctttctacccccaactgatttttccccacgaatggcacagatataaacgagtgggaagctccagagtcgaacaaaattgtagcagggatggaatggacgaggaacgtaccgacgatgacgtctggagttgtcagcacgtcctcggccgtcacgtgattcacgtgaccccgaatgacatccttcccgccgttgttggagcggggaggcgcttggccttgctgacgccttggctttggacatttatccgcaaagtgtccgggctcgaagcagttgaagcacagacgctgctgaccttgagcgtccctgcggccttgaacgggctgcacagttggcgtaggaggacggggcgcacgagtcccttgctgattctgctgctgctgcggcggtgggacgcgcaccacgaattgaggtcgaggcgcggagcgaggttgctgctgctgctgctgctgctgcgaggaggatccccctgggtagggattggtgtagcggaccctctggttagcaccctgctgattgcggaagttcgccaagcggcgcttgtgcgattccagctccttgtgcttggcctccaagcggatgctcttgtccaccagacgttggaagtccgggtagtccccagagactagacgaacggacagctcagggtccattcctgccaagaacttctcttgcttctcctcatcttcccgcacatcctccggggcataacgggctagattgttgaactcatgcaaatactccatcacggagcggttgccttgcttcaactcccggaattcccttttcttaagagccacgactccagcgggcacatgggttctccggaaagcggcggtgaagcgggcccaagtaatcggctgcccctctggctgcgcagcctggaagtggtcccaccagagagatgcgggtccctgcagctgatgggcggcgaagacgactttctcctcatcactgcactgcaccgtgtctagcttcttccccacggcatgcaaccaatccaacgcatctacgggattgttggagctggagaaggtaggtgggcggatgcggaggaactcggcgagtttagagtgttggggaggtggtggtggagcattctgttgtggcggattttagaggtggtggaggaaagcattcatcatgttggcttgctgggcgaggatttgggtgagaatggcgttggtgtctggtggtggtggtggaggtggattgccttggtggttggggttgctgccctcgggttggttgccttcaccggtgttaacatttctcctggtcgtcaccatctgaaaaccccacacagaaccagcaaacagagaaggagagctgacgattaaaactaaccacccacgactactataattcttgaatttattactgctattaaattggttcattaatgttcaagttgcttaggcaaataaaataagacaggctccgaca

SEQ ID NO: 48416 - DNA, 2510 bp, Oryza sativa
agtcgatacgacccgcgtcgtacgcctccaccatgcgtgccagatgcacgacggtggcgtcatcctccgagctggcgtctcggaaggtggcgtagtcgcgggctcctccgcgacgagggtgatagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgcggataccccaagaccacgcacatgccccgcagctccaagacgaagccagtcatgtccaaaccacgacgggtaacgctgccggccatctacaaacaaaaacaaaaagagaaacaacattttaaaggacagattttgatgataagtgaagcagcaagacaaagagagaatagcgggttttcacaaataataaaggatttttatttttgaaaatattgctaaggcttgggatctacggctcgtcctagggtcaagggaggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaagactagggcgacgaccacaggcgcttgacggcaggcacgagctagacaccaaagccttcatcttcaaggaactcctcatctgggcttggggaaaattgagcaagactgagtacaaccaccgtactcaacaagacacacccacaaatgcagaataaatgcaagggagtacaagggaattataccataaaggggttagggttgcagtaaacagcatttaaagacatttagttgctcaaggctattttgtaaacacgaatctagaactatacaatattattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacgaaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaagcaatttaggggattttgaatagagggggcggtgtgaagccaattccacaataaaccaacaattccagagtatccaggtgatatgaatatttcccaaagtctatagttgtaaaacctcctaaggttacctaattaaattgcgaagcatctacctagaattaaactagtggtgtcatgagtagagagtccactagttgaggttttctttgcctagggtgaacaaggtaataataataacaataacaataataatatggtcataacaaaggtaagtaggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaggcttaaacactaaataactccacataacagcagaaacaaagcacaaaaatgggttctttacatcttaaggaaaaattagagacttgaacggtccaattccgagttcaaatggccaagatatggccatttgaagtctatatgctctttaaatggatatttacgaatttcttcatttaaattttaattaaaaatcggattattgcctcagccgagggggcgggcgtgcggaccgggtccacgggaggtggggc

SEQ ID NO: 48417 - DNA, 14620 bp, Oryza sativa
gggaagcccaatggcccgcggggaagaaaaaaaaaaaaggaaggaaaaattggcccaaccggcccaaaaaggaaaggggggggaaaaaaactttttttaagggtttttttttataaaacctttttaactttggttattccttttcaaatattatttgtgctctgaaaattccactaaaatttatttaagcattttaggcttttaggaaatatacaaaaatcctccaagcctcatttgacttttatctttgcccattttaattgttggaggctttcacatgaattttaattattctttgcacaatttcgaggatgaattttagagtcgatttgggacgcgacatgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaactgacggagctcgtggctcctcaccgggagaccgcacaggccccccctttgccggttcggccgggggcttagggtgagatctcaagctctcgctgtatgtggaaagatcgcgtgccaggaagaaacgcgagacacggacgatgtatacaggttcgggccgctgggaagcgtaataccctactcctgtgttttggtggatttgtgtgtggaggagctacaaagtgtgagccgatctatcccttgctctaggctctaaatctggaaaaaatccatcctcctctccctatgggcaaggtcctccttttatactttaaggggataccacatgcactcttccctttccaaactggacttttttctttacataaatggacggagatttgcacggttgccctccgaacgtccttctgatgggacggcccatacctacctccacttctgccgggggcaggcgcgtcgtgggaacgtggctatgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgaggcgtgcgccaggccgccagtcgccacctaaccgttgatctgaccggtctgtgactggtcacagaccggataaaagagtgcgctgcattgcgctgcatgctgcatgacacgcttgaccagatcgcaataaatgcggttaggtgagccctaccgtgttcacccaacctatgtacataatgcaaaccccacaaggggtcggggcacctcggccctcggagctggggcaggagcaacccgacccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagcaacgaaacctctaccgacaattcccaaatttaatctttcaaattccttgcataattccaatggcaactgtcgtccttctgtagcattgcaatagccttttctgctaagagcgtctgctacaacattagccttccccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttggaaacccttctttggatcaggcaaaatcaaaataggagctgatattaagcgacttttcaattcttgaaaactctgttcacattcttccgaccacttgtacttcacatctttctgaagcagtcgtgtcatgggcttagcaatcttggaaaaattctatataaacctccgataatatcctgcaaggcctaggaaactgcgaatctctgaaactgtctttggttgcttccaattggttacggattccacgttactaggatcgacggcaactcctccggctgagatgacgtgaccaagaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatgatctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgacagaggggctacgttgcaaagagagtgcttgattatttccttggttttgctgattctgaaattgctgcatcatcatgttcataagctgtgtctgttgagcaagaacttgggccagagtgggattctctccattgttgttgttattggggttgttgggaccattcccattgctacgagtgttcaccatctggcatggacagggcacaagaagagaaaccggggaaactacttaggacagagaattactttaacttttattgatcttaactgagtttcattattacaaactaaagactctcacaccactaaactcaccaacttcctaacactcaaaagcaaacaaacacatgcaattacatcccaccactgatgtaaatcacatgcgagccacacacaagcaaacttaaagcaaaccaactaacacaacgatctaagacaacgacttaacaagtcactctagttcttccaagcatcggaggtcgattgaaggctcgtttttatcatcttgagttgctacccactcaatcttggaattgttgtgcttagattcttcttcttcatcactacttatgatgatgaccgaaggatccgcttgagctggggcaacttccttctccaccacacgaacctttggcgccaattgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagctgctaatacagtctccgcacgactttcatccatagcccacaacatctcaaccaaatgtttcgtggtaacatcattctcaattccttcagtctcaaggtaactgccacggtccttccctggggttggcgaggatggtagcgatactcaatgtcggccaactgatcactgtagcgatcacggagctctcctatggcgatccttgccacctcctgacatgcatggatgtagtttcttcctccagcttcaaacatcactgaggggacctcttcactattactgttcaaagtgactttgactcggcacttctcttcatgacgatcatgaggaatctgggcataaaaaggggcagtcccaaatccaatgacaaaggacatcgtgcgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgagataagttaaaatagttggaaacgaggtcacaaattttgtaattttgaataactggtttcaaaagaaatgaaagaaaatgataaaatcaacatgataaatttattttattgcagcaagattaaataaaacagtattataaaacttttgctggtaaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaataattaaacaatattaatacaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaactgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataaatgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccagaaacgacggaatctaagcaaaaagaagcaaaatcaccaaaacagcacataaacaagcatgaacagtacatgtggatatttttaatgtgtaaatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcggctagggtttcggtggaccggcgcacgggcggcggttcacgcgaacggacggccgagatctaaccgatccaagatggacggccgagattgatcgagtccacggcggttcacggcggacgaccccgatggcgtcagcgatgacgtcaccgacggcggcggcggctcggcggagcggacggctcgggcggcgcacgctcaccggcgaacggcggcgctacggcacgaacggaggacaccaacgggaagcggacgacacggcgaacacaccgacgaccaaaacgacggcggagaagcaacggacggcgacggcgacgagaaggaagcggcggctaccttcgggttgtcgacggcgacgaagctccggcgggttccaacggctgcgaaggggcggacgaggacggcggcgacttggcgatgacgacggcggtcttcccgagcggcggcgacagctggagcgacggcggagcatggctgaagcggcggcggcgacggcgaagctagggcacacggcgctaaggctcttccggcgacgagaggcgaaggcgagggctgcgacgggtagaggagacaccgggggtccttttaaaggggctcggaggcgacggcgaaggcccacggcgacggcaacggcgaaggaaaccttcggcttggagagagggaaaaccgatccgaatcgaactcgattccaaagctttccaaagcgatttaaccaaagattccaaaggagaaaaggtagaggagatcccggagatcatttcccctctattgattcggccggagaaggaaagaggcggccggatttggaaaggaaacggcggcggcgcgaactagggtttcggcggcgacggccgaaggtagacgacgactccgacaggcgggacccacctgtcagcgacagcgaggccgcgcgcgcgcggctgactgggccggctgggccgaggagagagagaagagaggttttgggccgactttcggcccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccaattaaacaacaatttatatattttgaattttcagggtgtgacatctagcgatcccctaccccctccccctccgccccaagcttctcccttggatccggcggtggcgacgtcggcggcacccgcggacggatctaactgagaggatctgcccgacatcgccgccgtcccctcgcggccggatctgccggtgttgttggttgtgtatgggttgtttctatttttttttatgtgatgatgatgtcgttgccgtgattgattttggggtttttatgagaggagacctctcattgattacgatttggatttggattgaaattgagattttgtttttgggtaggattgtgatgatgtgggatttgaagaggaggtgcgcgacggaagaaaaatcgcggtatggacgaaaaatcgttgtgacgtcgtcatcttattttggatttttttttatgattccgatttagatttggattggaattttgaaaagtttttatttggattgggatggtttgagattttagagagaaggtgtgctcaatgtgggtctatttgtgtgatacggaatttcgactgggatttgggggggggggctgacgggacgaaaaatcaccgcatgcacgaggtgacgaaaggaaaaatacgaatatttatattagttaagatacagtagataggtagtgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttaggaaaccgataccgtattggttaaggtttctatcttgtaatcctgccccccatcctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctctgcatccatccactttaggtctcgtccgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgagtggtgcccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattacgccgccgctgttgggggtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacatcctcaccgccggcttgcctccgtcgccgccgagtggtgcctccgcctacacggctggcctattatgccgccgctgttgggcgtctacgacttcaccgccggcctgcctccgtcgccgccgagtggagcctccgcctacacggctggtctattatgccgccgctgttgggcgtctacgacttcaccgccggcctgcctccgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatgtttataaatattttaaaatacttgattttttctcgagtattatatttatatcagatactactcatcctatatgtttgttctgcaggatccagatccagatatgcataaaagggattcatggctttaggcttatctcttacgctccaggaatggatcagtcagaacatcaccgactggcttgccttcgccgctgccgactggtgtttccgcctgcacggctggcctttatgccgccattgttgggcgtctacgtcttcaccgaccggcttgccttcgaccgccgccgactggtgtttccgcctgcacggctggcctttatgccgccgttgttgggcgtctacgtcttcaccaccggccgcctcgtccgtcgccgactggtgtttccgcctgcacgctggcctattatgccatcgttgatgggcgtctacgtcttcaccgaccggcttgccttcgccgccgccgactggtgtctccgtctgcacggctggcctattatgctgtcgttgttgggcgtctacgactccaccaccggcctgcctccatcgccgccgactggtgtttccgtctgcacggctggcctattatgccgccgttgttgggcgtctacgtcttcatcggccggccgcctcgtccgtcaccgactgatgtttccgcctgcacggctggcctattatgccgccgttgttgggcatctacatcttaatcgccggtcgtctcgtctgttgctgactagtgcccttacctctacgtctggtttatacagctaccactactgatggacatcatcatcttccgtcgccgactgattatgccgccgccgactggtgcttttatcttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaatgactacttgacgacaagaagctataattctcgactctatgttcagttgtttcccaactaaccaaagagtcgggggctacacaaatacaaggctcaaaatttgacaaattttatgtcaagctgaagaaatcaattcatcaaccaacgagtcaacttcaggagtcattatcttcatctttgattcagagcagacattctacttcaacaacttcaaatatttcggtttagacgagttgggcaacaacatcaactctcctccaattatttgtcttcacggttggcctactacgcaaccgccgatagaggatctcatcgttatcatcggctgctacatcgctattgactggatcaccgacatcgccatcttcatcaacatcttgtcaagcctcatcaacatagcctactctgctgccgttgatgggaaacttcatcatcatagtcggctatctctattgccgctaatcatcattaccgtcggatgcgtttgtcgccgccgattattttcttcatcttcatgattggtggatttcgccatcaccgttgatgcgtgtctacgtcttcatcgtcggtttgcttttgtcactaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggagctcatcaactcaagcgtgaggattatatctctaatttggacttgttccggatacatgcaacatgaatttatgatcatgggtctattttctatgctcaaagactggactatttattattccccgtaagggttatcaaccgaatacttgcgccagtcgggattcaatttttatatctattttggagtatcccataagggataatcactcagatcacatggtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaacttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttctaggcggttggtaaatcctttatgagtttatttactcggattttacaccacatatgccatatatttccaggtgtggtgaaaccatgtgtcttttagggactaaagcacgtctgttaaagcagtgtgcgcatggcgtatgcccaatactttggaaatttctttattcacaacatccaagcttctttatagctattttgctatgtgaattttcaatgatgtagccaactttaggttacactcatcatattttacaaagcagtcggtatatcacttggatcatattattcggggattcacaccgcatatgctatatattggtatcaagtcacttggttgactacgattatcaaaaccactcagttggtgcatctattagatacatctattcgatgcacctgactttatttttcagccctccacagtcttcatatttggtaaaagtactcgggagatcatggtgaggatgattgaagcactcggctttggagtaatctagttcgagaaaagattatctttccgactgtgaaggtctcaggggctactgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttagggaaaccgataccgtattgggttaaggtttctatcttgtaatcctgccccccatcctttataagggggccagaaggccttttagggggcatgagacaccttgatggtcagatcaatacacactc

SEQ ID NO: 48418 - DNA, 1348 bp, Oryza sativa
  unsure (1)..(1348): unsure at all n locations
tattggtattagtacggcaatgaaaaataaagcaatatagagttaaatctactcggatcggcggtagacatcaacgatatataatcattttctcaaaatatatttaaaccgagtgattgggatagatcgaacagcaagtcaagacagtataaatcacttatgtttaaagatactttaagataacgattatatatatgtttatagcatagccgatcaaatagatctaacatatatcggctaatactccgataccactccatattaagatattaaatcagacaaaatatatcaaataacaagcctaatatactttaatgcaacaatatcttaatataaagggcagatttagcatatcaagtaagcatacaaagtataaaatagctaaatcaggtaagatcggctgaaaccccgatactacctctattggtggtcataaaacaagctagatattgcaattatgaatattacttaatagatcgaactcaaccgatgcagcattaattaagcataagaataaatacaagatctagacaagatgatgaaaacctctaaaagatggtagatatgctatacaatctagattaacaataaaatctaactctatcggctactctctagtaatagatgttagccgactgaaggttagattatgatagtaataaagattacaaggcatatatgataactcgacgatttacataaacaagattagagtgttataaagatggaagcactaatccgagacgcaagccgtcatgacaaattntacctcttgttgaagatcgaaatcgatgcagttcaacccgaaagcaagaacttgtcgaaacaatgaaagtagaaaaagggcggcgatacaccgaaagtgttattgaactatcgttgtaaattacatgggatcgggttatatttatacctgggatacatggctagtccttgccggacaagactcttatctctaacaaactctaagatacgaacaagtctttacagcagactcttaccgaaatatatctctaaagaaactatttaaaatatcctaattaatagatataattgcctatcggtgagcttatctccatcatggcaatccttgtgtagcacgttgatcgatcccaaagacggttatacaaccatctcaacgaaatcggctacatcggctaaatcggctatcttctatccgatccatctcatccgatgcagtctttagccgacacccttaactaatgcgcactgttcttggaatatgattccctgccaaatccgctttgattccaatgttgaacgtattcatggcttaccaaatttggtcattaacccaaatatatgatccaaaccaaaccaatccaaa

SEQ ID NO: 48419 - DNA, 1315 bp, Oryza sativa
ctgatctgctgtgttcatcacattgttttgctttataagcttctatatgcacataggagtaatcttgagccaccattctgagttgtttattttctatctcaggagctgaagtagcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatatcattgttcctgtgtaatttctgcagcatggatgaggacctgcaactgtccgatgcttggagggagttagttattcctcgtaataatggatggatgtattttatcaaggctggtgtctgtgctaacctttcgcctttcccgcaggtagtgatcctttaacccctaaacatcttataatatccatatgttgaagaagttactcaaaactgtatttgttggacagtgcttattgtatctatgaaaaaggaaatggaagaatgtgtgtgatatcgagactattgttctttcttgagatgtactttggagttggaagagatatgtttaaccctaacctcaactaattgcgcctgtaaaaaaaggtccagttagttacttatcagttgcctggtttggtgagttggacgcctgacaggttattaagttcttattgcaccttggttcttgtcatagtatggcactaccctaaactgaggtattgtttgcggcatctcttctatggttatctctttcatatacactggtttggctttcagaaatgcttttctttgtctggttgcttttgtgagctatttcttggttaacctgtatctctactatgttggaattctctattatgtcctttagtttctttcttctttttccaggcaacatatactgcgccatcatatgaagggagcacagcatgtgtggttgtcatcagaggtgaccaattgattgttgggcatgctggtgattctcgttgtgtactctcaagaaatggtcaggtatagtgactatttccttatcgaatttcttgttggtacctaatttgcatgctcacttattttcgtgcctaacatttgtgcttgtttctgttgtgtcaaaaggccagtgcattatccgtcgatcataaaccagacagtgagtctgaaagagagagagttcagaatgcaggaggagtagctgttgggtatagttatcgtaaaataatggggaggtgggtaaccaagaaacaatggggcttcactgatttaagggaagagtatcaatctcaagatcaat

SEQ ID NO: 48420 - DNA, 841 bp, Oryza sativa
cacagagactagaagaatgaagaaaactttggtcaaaaggaaactgggaaaaatactactagtagttcataaaccactaccatgcacagagattcaaaatgaagatcaacaaaagcatcactagatcaatcaccttcagaactaaaaaggctagagatgattcgaacaattaattcaaggtgtctcagtctagcaaagtagcacaaccaaactatactatcaacgggtcggtgctattactcgtctaccactaacaggatcagaattcagaatatataagttcccaatcggaaagaccggaactggcagtggcgtcgaccttgacctcgtcgccggtgttgctgtcgtcagacccggcattggcagtgggatcaacctcctcgctggtgttaatgaagaagtagttgtccacaatggtgatggttgcagtcgacaacgacaccacggtggcttcgtcggcagccacggcggtggtactgctgctgccgacggcagtggcagtggcgtcgaccttgacctcatcgctggtgttgctgtcatcagacccggcattggcagtgggatcaacctcgttggcggggtcgttgttgtcgacatcatcgccggtgtggctgtcagtgtcagtgtcggtgtcgaccggcggaacagcagggtaggcgccgggcttgaacagaaccaggatgacggtcgtgttgtcgcccgatggcaagccaaactgaacaagctcctcacagatgacacgcgcttctgcaccctcctgcatagcgatattaattggtcacagcaagtcagcaatatttggccacagcaaaaggaacaacagttttaacaacgaaacaat

SEQ ID NO: 48421 - DNA, 1267 bp, Oryza sativa
ttttttaaaaaaatcagtgggacccaactattaaagagggaggggtgtgagagggaagctgatcaaattatcacaaaactatatattcgttgatcaaattatcatacattgatcgaatttatatttctaatccagtacattgatcatcaagttcgcgaatgtatgatggtatcaaagcttacaaggcagagacctgctgctgctgctgctggcctggccttggtatgaattgtgatccaccgattccagtgctcgtgatttctgaagatctcggaatagagctgcaaactggtcatgttggcctgcaaagagacaaacaagccaatggaggagttagattgaattgtgagaggttactgaatttccagcttactgaaatgggctctctttatgagtaaaaaaggagcttactgaaatgggctctctttatgagtaaaaaaggaatgatagagtaagtacgttacaggaaactaagggcccctttgcctttgatttgtaggaaaagtgttcaaaatttgaaagatttcaaccctttggaaaaaattcctatgaaagcctttgaaacaaaggattgaatcctatactatccttcaaaattcctatggaatggctaatcctatagagattttgaaggaaagttagcaagaggtccaacctcttggaaaaatttctttgagtctatctctctcatccgattcttgcgtttttcctgtggtccaatcaaacggttattcctgtgtttttcctgtattttccaatcctctgttttacacctgcattcctgtcagaatcctacgtttttcctattcctccgtttttccattcctgcgatacaaaggggccaaacataatgtgggagttatttgctctttattttcagatagtgaaatcatctcgcagtaaaattgctcttctttcaggctaaaatcaaagtagatgaaaatgagatattgtataacgtttacgctgaacacctgtatttctttgttggttgaaaaatgaccctattaatattgtgcgctcagccaataccataattgctctctacgttgacgaacaaaatacaaactagtgatccataacagatatatccccccatagtgaccagaatacttactgatatgcattatgtatcaggatcagcttctgcaacatgaagagcccatatgcatatcaattccaaaccagttggaatgtcctgatttctttctataagaactgatgagacatacatcaggtgcagcgctatcaatctgcaagaagttgc

SEQ ID NO: 48422 - DNA, 5194 bp, Oryza sativa
caggaaatgtctgtttaagggcttggagtacccagctcttattgtatcaagaatagctgtggcaacagctgatgcttccggatgcattgtcatgcacttcatacagacgccaagcatgcatacaatttacctaggacaacaaagtagcgactgagcaaatcgataccatattaccatgtgatcttttatcatatcattgcatgagtgggagcataaaagcagcagcataaaccaaaagcatacaaaggaaatctattttttgaccactccgactgcaaatctttagcttttccaagaccccatttacgagattttcctgatttaagtatttaacttgacatgatctagatggaacctcctctttcataccagtgtgaacaattcagaagtgtcctgattctaagacttccctccaaggacctgcaacaggacaggaggtcccctgtccctgaagtagctaaatttcgagcatgtactatgtcaaccagaccacagggtaaagtatagaaaaatacagatttataccttctgcctgacacttatgaagtacaaggattcagctagatgggcctcacgcacttcaatcccacccaaattctcttcagcgtcagcaatccttgatacatgaaaaaaaattactttcagaggaagcaatgattcttgtcaaacttgctagtaactgaaacattagatacagaacaaatgcggagagcagaacggaagatatatgtgaccagctaaaaggggatgtgttgatgactggaaccacaattatactatttatgctctagtgaagttatatatcttgattttccttcacattagtttacattgggtttttttccttggtgaggagggtgcataaattacttttatattggttgggaagttgtgaattgtgatccttaggaatctatattgcttttctacaagcccaattacatcttgtaacaatgaaccaaagcatgcattgatgcacatctgtgagcctggaatcaagatacacgaacactggcaatatactgaagacagaattaggcacttggtatgcaaactctctcaagaggaacctcatacaatacataccgaccccattctgaaacataattcataaattacatatatccagtcaaatgcaagtgatcgacaagttccccaaagtaacctaattacctaacctaaggttcgttgaggaaaacgtatcgtagcaaagacttgagttgtcacaaaatttatccccacatagagagtgctacagcctacagctataagaacagcaacgggcaaacctaattttctgggcaataccgcaataagagtaacatgatgccaaaattgaggggaggaagaacccactcacttcccgtcgagcttgcggacctcctcgtcgatccgcgcgcgcgtagtccggcggccagcgactcgaccgcggcgtgcaggcggggagccggccgatggatagatggagagagacggcggatttgacggcgtggaggacgtcggagcggagggcgaccatggccggcgaggtcgtcgtcggcgtcgggatgggagaggaggaagagcttgcgggccggcacgagcaaccaggtggcgctcctgcttcgcctcctcgccgccggcgtccatgtcgtgccggtcactgacgagtctctcacttttttcagaacattttttttttttgagaacaacgagtctctcactctcttgctgttgccgactgccgagccgaactgaaagaggccatgggccggtttcagccacgaaatgcttttcagttcgaaaaagttctctccacgtcccttatgtacgaggtagagtttcaatcgcgtcgcccaattctaaaaccaggtataagcagggtttcttttcggaaagcaaaaaaaattcggtaggcaccattccgaacaaaatattttgaaattttaacacattttttttactaaatttgaataaataaacaccaaattcacaaatatttggaaaaagcaaaaattcaaaattaattttaatattttataacttattttgtcaaagaaattttaccaaatcattctcttaatgcaacgcgagaaggtttcataaagtttcaaagaaaaagtgctcccaatcacatagtagagaacaaaacttaatgaaattaatagacatgatatagccgagctatcattactgcaaattctgaaagaatgagttaattaaaaagccctcattgagttggcataaaaattcaagttcgatcctccatgtagtgcgctcctacttcttcatacctagaagacgtttgagcggctccaagggaaagccacaaccatggtatgagttcttcgtttcagggctgcttgccccttcgcctcgataaggaggtcttccagccgtagaccgcttactcttcttctgatttattaacttatctttctgctttgtcactctcgtattctgaataggaatcggcaaacaggtacaaccatcctcgaaaaatcgaacaaccctcttcaccttactcaccttagtgtcttttacctcataagcattttccataattgttggccctacctgatagatattttcaacacttcgagttgttccgccatgatatccagaaaatgttggcatcaatacttgaggcgactggtgatacggaagatttgtgccgggatcgattacaaccgtagttcctcgttccatgtcgtatacacacaacactttcccattgaaccccgagtagtagacgcagttccctctcaagcccgttccctccgtatcaagtgacgctccaaaactgcctatcttaacgaagaacgctctgccacctagcgaatccaccttcacccacgctgctgatctttgcccctgcgttgtcgtcagattaatgctcaacctgtaaacgcctacacgcgcgacaatccggtcacatccgatcgggtgagagaagacaacggagtgcagctccccgtttgattccacgaagcaagtggtgcgtttcttgtacaccgttggtctcctgtcgtcgtcgacgccgtgtacggcgatcttggtgagcgtcagctccggcgagaactcgaggacgccgacaagcccgtcatcgccgatgaggagttcgctgtagaacttgccgtcgatcgccgtaaactggcgtaaaaacctgatgatgacgtcacggtgctcagtgttgctgtgctggtacggatgctgatggagcctcacccagtggttgtcgccggggcggcaataccagagctccgtgtcggcgaggtcgatgacgaccacgacacagctggtcgggtccatgggaccgcagcatgagaggaggcacctccggagatggctgccttcggcggcgaggacggtgccgtcgtggtcggggggcagcccgacacggcggccggtgaaagggtcccataggaaagtgcacggcgagccgcggtgcgccatgagcaaccagccctgcgccgtggcccaccagcggtggcctctcatcatgtcgtcgacgccgccgtcgcccaccctcgttggcgttggcgttggcgccagcagcgctctcttcggcacgctgtagaggaacgtggcgtcgccgtggccgccgaacagcagcagaggagcaagcttgggatccagagcggcagatgcgtcgactgcctcctccatgatttcaacggacggctggccgatcgatctttcggtaattaatccttcgtaggagacggccggtcaatctgtgctatgctttataaacgaggagagtttgtggcagcccgatttaagtgttgtctcgtgatttctgttcgaaatcatccgagaggctttgagaactagtatatatatatattggcatataggaaagagaaacgaagaaatctgcacgcctaaatctgcagcgcccatgtaagtaaatcaggaaaaggaaacatgaattcctacacgtacggcatcaaaattcaaaccaattataatctgcaccgccggtaaatcagttttttggcacggcatagagacggatcctccacattactagcaaccgacaaaaaccaaccgggtggggtacaaactattacaagcggaagctgacctatatgtgatgcgagtccggtggaaacacgtttccgaagaagcagtgcagcacagaacgcagcacgccatgcaggtcacacgcgtgcccgaactctcgagattctccaatctccaatcacagaggcggccgctgcgacgacggcggcgcagctgggacaactgccggactggtcgtctctcccgttggacatgctcgtgctcgtcctgggtcgagccacccgagcttcgtgtatgatcagtatcatccgtcgcatgcagatgcagtgcatcatcacacatcatctccgtcttggacatcaaaattgagtggaactgtagtgaaccggtgacctcctcctgaatcatgaatcatgcatctacgggctgtcgtcaggagccgtgccctcgtcatcagctaaacttagtcatcagctgagtgactaagtttgcatgtttccgctgacagagatcgattcagcgcggctaaggattcaagatgccgttcctatcaatcaaggcggcggcggcggcacagagagagcaagcgagcgacaagctacggcaggaaggagagaagaattctagcacccggtgttagtatgagtggaagagggaaggacatggcttaacgatgccaaggggcgccgtggcgagatgacggtcgttcggcctcggcgtgaaccaaggagtggcgccacgggcaccggggtcggagaagaggaaggcaaaagcggcgagcttgctctggtttggcggcaaaacggtcgcggcggacagaggggtgacgcgcgcgcgggggaaacggcgagcggcgcggcggtggagcgggagcgccgtccccgtccgcaccggcacatgcgcgacgcgtgcggttgctgggccgtgaccgagcgctgggctgggtcgacatagaaaggaaaaagtacaccgaaggtccctcaacttgtcatccagttacaaaatcatccaccaaccgaaaaaccagatataacacaccccctaacttataaaccagtaaaaactagatccgacgtggcgactgagtcagtgtgggccttatatgtcagaatgccacgtcagcaagccacatcagcaggccggcctgtcccttcctcctctctctctctctctctcactcactctt

SEQ ID NO: 48423 - DNA, 3826 bp, Oryza sativa
ccccccacccccccccccccccgggcgccggcgcgcccaccgggcgcggccctcctcccctgtcggctatgctcctcgacaggacgactagagaagagagaggaagagacgtggtgactgggaggctcttccccgtgtgcaattaagaaagatagtatgggcttgtttggtttgaaaccctaccaaaatattggtagtaccaaaccttaggcacattttggcactaacaaattttttatagtacagatttggctccactctattgatttggcaaaatttggctcccaatccaaaatgctaacatgtactattcaaaactaccaaagaattggtagggcaagaattggcatcaaaccaaaatggccctatatgtccctgtgccactaaaatatttgagccctccctttataccattgtcgaattttatcgcgccctccacaccgttccgttgctattccgtttagatttaactatttggcagctctgacatatgggcccgggtagaaaaaatgtcgctcttgccctttcactcagtcttctccctcgattcccctcttctccctcaggcggtcaggccgccgcccagctggggcaccgcgccgccgtcgcctcggcccggtcgtcgtcgtcctgatcctcgtcgtcggtgcgctgttcctcaacctcggtccaaccggctcctccagcttcaccatgccgtggatccgcatggagttcaacgaaccagtccacgttgcggtggcggctccgcctccgccgctgacgcagatgcaagccggcgtcaacacgagcggcgaggacctccggccgacaacctccgcctccgccctgacggcgcgctcgtcgtgctccacgtccagccgccgccgagcatcgccgccgggctcaaccccggacccatccccttcggcggcccgagtaagcaatctctcgcactcgtcttcgcggaaattaggacggacacttggtcctgtggctgtgagctgtggttcttgcgaattttttcggtcgagctgggtgggtctgatggcttcctggatgtgccgcgcggctgatcaggcgaggtcgctggcatcactagtagcaagcatcaatagtcctcgccgccgtcggccgtcgttgtgctggtcctggcatcactagtagcaagcattactagtagcaagcatcaacagtcatgaacaccagtagcaagtatcaatagtcctcgcagccatagttgtgttggtcgtcgtcgttgttgtcgcagcgctgccgcccccgtcgtcgcgcagcactgccgccgccgctgtcgtcgcagcgccgcccccgtcttcgtcgtcgtcgtcgtcgcagcgttgttgccgccgtcttcgtcgcgcagcgatgccgccaccgtcgtcgtcgcagcaatgccgccgccgccgccgtcgcagcgctgcccccgtcgtcatcgtcgtcgtcgcagcgccccgtcgctgtcgcagtgccgccgtcttctcccctccgctccttggctgctgctgctgcatctgaggggagagaggagagtgctaggagagagcatattggaccaaagggcaactaagtcattttactgcgccattacccaccgttacaacaaaaacagacggaatagtgtggagggcacgataaagtttaacgatggcagagagggaggcttaaactttttagtggcacagaagcaggcaccatctttcttaatggcatataggaaaaaacctcgttgactggtgaggaagagacgtggcatccagaaatgtggggctcacgtgggtcccacgctgactcagccgccatgtcaaataaaaccagaacaaaactactaaaggatctaaaatgaacgattttgtaagttgaaggatgtcatatatctgattttacgggtgagggatgattttgtaactcgatgacaagtcgagggaccttcaatgtactttttccacatagaaaggagaggctagctaatcgagtggaacgatttgatcctcaggctagctaatataactctgtcaaatgaaaaggactgctttgtatggtcgctctataagaatggtcaattttccgtcaaatctatgtatgtcgcgatcatgaactgtaatgttcggatcaaaaagagaattctgtgggacttgaaaattccactggagatcaaggtctttatgtagtttcttcacaagaaagtatttctaacgaaagataacctgggtaaaagaaaattggagggggcggagacaaacattgttctttctgctatacacaagagacaatccaacatcttttctttgagtgtcatgttgctcagtttgtttttggagatgtgtgttttttgtttttaatatccccccaccccgtaacgccaaaaacattttcgataattggcttagaggggtatctaggtccattaagaagatgattctaattggagctagcgctgtatgttggtcaatttggcgttgtcgcaatgataaagtttttaatggtaaacaattatctaaccctatgcaggttatcttcatgtcttcctactggctccacttatggtctacaatgctaccacaagaggagcaggatactatgcgcaatggtgctacactcttggaatcggtagccaagggtctcttattccactatgggtggcgtagtttcataagaattgctagctaaaatattttatgtggtttaacattagtcaataataaaggggagttggggatttgtcccatcaccttatttctcattttgatttacttttatcttacatttttattactattaaatttatggctgtgtgtcttatgacagaagccggagatgcaatccatttccattatctaaaaagaaaggagaggcagcccaccagaggggaaaatgtttgaccattttccaggaaattatttgaagaaatttggggtctggtttgatttggacttgaattcaaattggatatttgaactcaagggttcaacaaggagtcaagaaggtaaactgaggtccccatcggttggcttttttcctacggcttattaggaaataaaaatgaatttatagataaaacttttatatacgtgtttttatgacttaaaaaccaatggtgaaaaagaaactacgttgaaaatatcttaaaattaagtttgaaaatttaacatttggctttttctttgactgattaggccatccgatgggagcgtgaatatgaattcgatatttttggaattgggagaagtagatggcaaggattcataggaagggatatttaattggaaacctgaattttgagattcaattttggaatcaaattcaacagtacccaatacatagaactccctcctgcatcgctgttgcctgttggtttcccgcacgatcaagcggacgggtgggcaagtgaacgcggggaacggaaatgctactgagcgatcgcccagggcgattagatttccccctcctctccctccctccctccacctaatttattttttttttcaccatattactttcctattttagtaaatttatacacctaaagtttatacacctcaagtttacatatctaaagttttttttgctaaaagtttatatatccgattcaaatttgaatttgaattcaaatatttttatatatagtatttctatacatctaaagtttatacacctaaagttcatagacctaaagttcatatatccgattcaaatttaaatttgaattagatcctgatttaaatttgaatttaaattcaaatatttttcatatatagtatttctatacatctaaagtttatagacctaaagtttatatacccgattcaaatttgaatttgaattcaaa

SEQ ID NO: 48424 - DNA, 788 bp, Oryza sativa
tcgtcagcgcctgcccacgcctgtcgcccgtgtcgccgctcactccaaaccgccccgccgtcatcgccgtcgtatcgcctcggccccgccactccgcgcgcaagccgccaaggaacggaggcagagccctcctccctctgccgcgacgcccccgctcccctcctccttttcccaaagaagaaaggggcgagccccccctttctctccctcctttttccccttttcctcccgccggcgtcatcctccctccgccctgtcgccgattggacgcgagtgccgagcgccagctcgcgccttgaccgcccaagtcggtttccaaaccgacattgccgccctttaaggccccgggcgccctccctctcttctcctcccatcgcctccactccattgttgctgcccctctgtttcgctgtcgccgttcgtcgttgcgcgcgtcggaggaaccggcacaagcgaggacgcggaaggggactccgggcgctcgtcttcctcctcttccccggcccgaggccggagagattactctcgcgccgtcggcctctcgtcacagcgcccctcctcatctcggtagtgcctccctccgttcttcctcctcgctccatctcccccccttagttttcggtagtagctcgagtagcctccccgtagctagccggcgccgccccgaccgttgccgtcgctcgctgtgtgctggccgccgtcgccgcccgagctccgtagcacccgctcgtcgccggcctcgctcggcgtagctccgcccaatccgacgctagcaacggattcccggg

SEQ ID NO: 48425 - DNA, 2086 bp, Oryza sativa
gcctgataagtaccagccgatacccctagtacatataggataccagagtctgatactttatagatatcatcctgtctgaacaagatccatggtatagtagcccctataatatagttgcttgtggcaaactcataacaggtccaactctaaccacaacatgtgtaacttgcttacttgcagcatatatagtcttctttttattccaagatcaccaacattacagtgttctagacaggcgaagtagtaggagttcttttaaaaaaaatattacaaagctcctgataaaccggcatctagacagagcctgcattggtacatagcggctagaattttgaaagggttggaggtatccaaacgtagccatgggtctgcacgtagcccatcctcttgctcagctcgtcggcctctgggggtccccgggttcccggcttgtacggcagggccttcaccttgccgtcgtcgatgtcgtgcagcagcggagtgaagatctcccacgcagcctgaaaaccaacacggcgtcaggtattcattcagtcacaagcgagccgattgcaagtcacacagcgtcaattacacaaagcacaaacctcagttcgtctcggcgaacaaagtgctgctgatcccctcttatcctgtcaaaaaaatggaagatgatatcatggttcatcctttatatatatataatggattaaaaacccggcctctacatccaacacggatagttcatcttggatatggcatgtgttgggaacaaggcgcaatgcaagtgaagaagttattagtgtagcagaaagaaatgggggaagaaggatggaacaggacgtacgtatccaggatgaggcgttcatacgcttctgggatcttcacgtcttggtagcgtagcccatatgacagatccagctcgctttgttcggttgccatttctagtccgggtttcttgacctgcaacagttcatgcactttgttcagacaacacttgtttttttggagttctcttcaggcaaagatgaatagacaattctgacatatcttcagataaatgggtttacagaagttgtacatacagttaatttcatatacatggcttccgatggctgcaaccgtataacgaattcattccttccttgcttcttgcctttatcagggtgaaataaaaacagagttttagacaccattggcagaagcaaaacaatagcagacagaactgtattgattcaaataggttacggatgtttaactacattcacagttatgtgaaatttctctagtctgctcatgagacaaaaatacgttttgttatcatgtaaaggtaccacacacgcacacattttaacttactgccagattcttgcgcctatagaaaacaataattagttatctgaaggagttaaacagaacaagtttttacttcataccaggtcttttggacagtattattaccaataagaaaatgacagctcacttccaaatctattaaacacaaacaggctgacaagcagggtcaacataagtcatagaaacagtgactcaaccaattagtaaggtgacccggcaaaaaccaatagtaaggtactcaggtcaaattgaaagtagggagcttatagcaattttagatactaaaatgtagcaaagtagcaaaccgtctcatgcttattcttgtctattttctaaaggaagtgttgcttatactaaggtgtcacatcataacccattataagaagtaactttttcataccaaagcactagcacatttttacattatttctcagtattatcaagaaggaatgtttagtactctctttagtgcttgcataatgcaacatcttatatttccaatagagttgtctgccgttatccattaactcttgacagagatattcagatttttcagtttgttttggactagcattcagatattctaaatcaaataacttagtttcttaaaataggttgtgacttttgcaagatcagacttgatgacaagtttcacagcacatttggatacgagaaggtgtttagcgcatacatttaaaaaatgtcaccaggagcatccttgaactgtacacgtatctttggtttcctattg

SEQ ID NO: 48426 - DNA, 10462 bp, Oryza sativa
  unsure (1)..(10462): unsure at all n locations
aatcatgaagactatcacaatgatctcaccaacgcactggacaatgtgttttttaggttattttagcctactttatcattttgtttatagctgcacttggaaatgtgggatatcattgttcttgtgtaaatgctgcagcatggatgagaacctgcaacaatccgatgcttggagagagttagttattcctcgtgataatggatggatgtattttctcaaggctggtgtctgtgctaacttttggcctttcccgcaggtagtaatcttttatcccctagtgtcctcgaatatccatatcttgaagaagttactcaaaattgtatttgttggacagtgtgcatattgtatctatgaaaaaggaaatggaagaatgtgtttgatatcgagactgttgttctttcttgagatgtactttggagttggaggagatatgtttaaccctaacctcgactaattgctcctattaaaaaaggttcaattagttacatatcaattgctggtttacagagttggaggccaacaggttattaagttctcattgcaccttggttcttatcatactatgctacccaaatgaggtattttttgcaacatcccttcgatggctatttctttcgtacactggtttggttttcagaaatgtttttctttacctgttggctttcttgagctattttttggtagccttttccttctatgttgtggttctgtgttttacacttcagttttgttcttgtttttccaggcgtatactgggccagcatatgaagggagcacagcatgtgtggttgtcatcagaggtgaccaaatgattgttggacatgctggtgattctcgttgcgtactctcaagacaaggtggtctggtatagtgattgtttccctattgaatttctggtcgttacctaatttgcatgctcgtttcttgtggtgcctaacatttgtgcttgtttctgttctgtcaaaaggctattgatttatcctccgatcataaaccaagaacaagcgagtctgaaagagagagagttcaaaatgcaggaggaatatctcttggagttgattgtgaaaaagtaatggagaattatgtaatcaaggaacaatggatcctcggttactttggggaaagtgtaacaatctcaagatcaattggtatagttttgcctgagcctatttttcattgattgcatgtaataaaaaaaaccacataacactgtgattggcgttttacctacttacatttcaggtgactttgctttcaagcagaacaaagatttaaatcgtgaagaacaaatgttgatatgtgatcctgacatccacactgtaagtgtaaatatgttcgtttggtagaatataaagtttgttttgccggggtgggatctgatggaaaatggccctttctacgtcagcatgacataactggtgacatggaatttcttgttatagcaagtcaaggcctctggtaagtggtaactcttcagcaaaaaagaactgtcagtaactatttgatcattttgatgtcaccagtactcattggcatgattctttttctcctttttgatgcatatatagtttcattcataatttcatactaaccgcattacgtactgtatattttttccctgcaggtcttgcatggaaagtgcggatgtggttgcttacatacatgtccgtttattggtgagtctttttttttttcctcagtttgtcttcttggcaggacaatatatcttattggtattaattatgctatctgttctaggaagtgacttcaaccaagaaatataaataacctggtttctcttttttatagaataacagtgcttatcccctaaacccccgaaaaccagtactttgtttcgcgctgaatatacatgcctgactgacaaactgccatctgctttgagtttggattctttccctgttaaaactgctgttaccaatattgctgtgaccaattaatattgctatgcaggagggtgtagagctgcgtgtcatctgtgaggagcttgttcagtccggcttggcatcgggcgagaacacgaccgtcatcctggttcagttcaagcccggcgccttccagttccagtatgagctagtcgatcccgctgcctttgacactgccgcctctaacgttgccagcaccagtgccggcccggctggtggcagcgacagcgacacgagcgccacgagcgacgagggcgtcgacgacactgccactgccgggaccaccaccacgggctatgaggccggctccagcaccggccccggcagcggcggcggcagcgccaatgccgcgttcgacagcggcggcgacctcgccgctaacttggacatcgccactaacttcggcagcgacgacctcgccgctaacttggacatcgccacggacatcgacaccgaggacgtcttcaccttcatcaacagcgacgacacgttcggcatcaacagcgacgaggtggagctcgatcccaacttcaggcccaagcctcaggtccgcagggcccacgacggcccctctcccactcccagcgaaatcgaggccgacctcaatgccagccccacgaggtacaatatgagggatatcttcgaggccttcgacaaagtcgaggccgagttgggcggcttcccgttacagggccacgatgtctccagcaccagcaccaaccccaacaccgcgactgacactggcagtggcagccgcaccggcgacgatgacgtcgacggcgccattgccagagccatggccgtggctagcagcgtcatgacgggcgcgggctacgaggtcgactccaccaccaccaatcccagcgctgcggctgacactggcagctacaccggcgacgagatcaaggtcgacgacagcaccagcggcagtgccaggggtgacagcggcgagctcgtcaacaacgacaccaccgttgctgacaacaatgccagtggcgttgctgacagcaccaccgtcggcgacgaggtcgatcccactgccactgtcgcggccgacgacagcaacaccggcgacaaggtcgatccccctgccatcaccaaagccacggccgacagcaacaccagcggcgaggtcgacgtcgacgccactgccactgccactgccagcgccagcgccgccgtggctgatgacgagggcacggctcctgatgacagcgagggcagcccgtagatgcatgattcagaagaaagaggtcaccggttcattacagcttccactcaattttgtccaagacggagatgatgtgtgatgatgcatgcaccactgcattcgagggatgttactgatcataggtagtagtagtagaactaatgcattgataggatcggagtagttggtttctgctaccttgtttttggtttatgactcctggttggctgggtacgtttggggtaggagattttgcttgctagacttggttactgagaacacttgtctggtttttgagtttttatcaaagtacttaatctagtgatgcttttgttgatcttcattttgaatctattacacatgctgagagctgagtatgtactacttgctctgttcccgaattaatgttctcttggatacgtaatcagtaatgcgcttggtttggctgattacctctcttctcttgtctgaactgaagagaattgcgtgctgaaaccggctctgaaaatctgaagccggcctatggcatactccagcaccgcaacagcaacggactcgtcactatcaatataaggaaatcgggacatttctactagttctgcacatgggttcttcatgctgcagaagctgatcctgatacaaaatgtacgtcagtaagtgttctggtcattatggatcactagtttgcatttcgttcgtcaacatagagagcaagtatggtattggctgagcgcataatattaatagcgtcattgttcaacgccaaacaaagaaatacagttgtgcagggtaaatgttataccaaaattcatttgcgtcgattttgattttagcccgaaagaagagtaacttcattatgagctaacaactgcaatttgggtcaattagtactaaaatcaacccaaatactataatctactctctccgatccccaaaactctcttgcttcgtgctgcccaaactcgcaggaccaaatatttatgtccgaggtgatctcccttgtggcagacgaactgtatgacttgggaacaaatgctatttcgctgtcacgtataacaaggtcgacatggatggtctcgggccagtcgtacagcctcgggaggaacaccttgttgtgcatcaacctaagcttagtcttcctcaacatcgtcgtgtatgtcccggtgaacaacgcatgtccttccaatgaccgcatcttctcccactccatcgtctcttcattgagcttgacgacatggacaggcgcaccactgtagccaacgaggacagccatgagcgcgccagcttggtcggactcaaacaggtggctatcgacttggtgttcgattccaaagctcccaggcttatcaagaaccttaaaactatcgccatggttgcacggatcgtacaccgcgagctccccgtcttcgccaagaacgtacagcaagccaccgtggagcaccgggttgctggtcggtgccgccagaatttgcggtccgaagcccgtcaattcccagggcccccattggccatcgtcttgttggatcgcacgggcgagccgtagcgcggacgtcgtgttgacgcaatacatccttcgcgcgcggtcgtcgtagacgatgaaatcgggcgacgagtcgaaaggcggtgtcggcttcggcagctcatggatggtgctgccggcgagtagtacgagatcggcttggaggatcgatttangtgagcacagcgtgaggcgtcgtccggtggagcagcagatcctagcgttaggcaccttgacgagcgtgtcggcgatctggaaacacttgtggtagtaggggctgtagtacctggcgctcgtgacgccgacgtcggcggcgctcaggaggagaggcgtgatccacgccgggtagaagggcgacacggcggagcgccagtgccggcacgtcgacgcgaagctggggtgggtcgaccacccgagccgatattccaggacgagcacgagcatgtccaacgggagagacgaccagtcccgtcgtccttgcgccgccgtcgcggcggccgcctccatctgtcgatctctgcttgcgcttctttttgcggtgctcctcacgcgagtcgcgagagttcgtgcctgcatggcgagctgcgttttgtgctgctacggagctctactttcatggcgtgtttcctccggactcgtattataggtcggcttcagctcggagattgtataccgccccagcgccccggttggtttttgttggtttgctacccactctccatatatgcaaagtatttagattttgcttttgaattgggttgatagtttgaattttgatatcgtgtaggaactcatgtttccttttcctgatctacgggcggtgcagatgataattggtaggagtactaattgtaggtagtggacgtgcatacctctttcctatgccaatagttatttataaggactagcaaatatacccgttcgttgcaccgggtgaatatcaaacaaatatggatggttaagattgcttgtgtacttataatacatgtgcacaaaaatattgaatttgtacataccttgcaaatatctccaagttttatacaggaaaatatcaaaacatatctcatactgtatacatattcagattcaggtcgtatctcaaactatattccaaattttctacacattcagacaatattccaactttcacaaattttcataaacgggggcagttacagctctgaattcaccatgctctacaaaagaaaaatggtaaaggcatctgcaatgggaaagaaacacacactttgtagtatcgaaataaaattcactcaaaaatctttagtggaatatgtttgaattctagaaataatttaatatttaaggaaataatggggcgttttggtttgataccaaaatattgccatatcaattttttggtagtttaaatagtaaatatgatgatttggtttgaagccaaatgtttggtaatgcctatactcaatttggcacaattctagaatattcttcatcacaatttaaaatttggctctcaattggcataaatccaaagacactcatttataattctaccctaccaaaatattggtagtgtcaaaacttgcctagagtttggcactaccaacataggataataaaccaaacaagcccaataattattttgacatgaaaccatattaacttggtcaaatacaatatcatatgattaatactttctagataaattttttgttggtttcatttatctaaaaataatctatgagtgattaaataattaatcgtaatttcccaacaattttaaatggcttaaaatagtaccaaacaaatttctgtaaatataaaaataattaaatcagttgcttagaaaaataaactgattttggcctagcattgtggtttagggatgaagatttggggacaacttgagggaccaaatctgaacttatccgtgcgaagcatacacgtggcccaattgtgtggcggcctgggaacggcaacccgacgcgggagaagccacactcgtctgatctgatcaacggtcccgattgatccgaacatatataaaaagtcggcagcccaaaccctaaccctaaaatcacttcccctcccttctctctctctcaaacctacggcgtcagcggcgcctctccccttccgccgcttcccctctccctccccaccggcggcgccgctccccttccccctccctccatcagcaacgccgctccccttcccctcccccatcggcagcaccgttccatctccccctctccctcccgtctcgctagcatggcacagtgttgggggacgacggcgacgacgaccatccttccatttcccctctccccgtaggcctcgatggtggggctacaagcctatgacacggagacggcggcgacgacagtccttctctctttctctcctctgtctccgagcaagaagagagcgccggaaggtaggtcgccggggtagagggagggggtgtgtaagttcaagtgccttaatttggtttcggtgattaatgacaaatctaattatatgagactaacgtttttatgagtctttctttgactagtctcatttggatatgaaagtaaaaatgatgagaggtatgtattaaacttcacatattctaacttggtctctcttgtggatccaaaatatagtgtgagcttcctatttgatctttattgattatgtgcatatgcgttccttcatatgcatatgtatgcacatcttgagggggagcttattctattttttttattataagatttctatcttgatttgaaattattttttatctcatctctctatattgtttatatcgggttattatccatcaccaaagagagaaaagattgaaagatcttggattaaacaatttgtgtaattgttactttggtgatagatgataaaccgatgtttatgggattaacttctcttttgtataagttgtctactaggttatttcccgataatgagatgtggaagacatgcatttttttgtgatggaccttaatcatgacaagaatgaaatgcatggagataaaacgatatataccacttcttatctcctacgttttgatatgttcatatatatgatttccatgttattgatatataagtgtgagactaatgtttactcgaatgttatcttatttagtctcatttacattgagaacatggagatcatgaaggtatatgttttatgttagtctacatcattactacatatgtcttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatatttcatatgcacccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcatcatgttggcaagaatgaagtcaagcttgtgatgagaataaagtcctgacaaaagatggacaagacctcggcataaacatggttcaaccggatggttacaagtgttgatctcggctcaagcttgaccccaagatggatggcgcaaggcaaaggtataatgtagctaagaatgttttcttagtcttttcccggtcttggtgtttggtgtagaccggatttgctagataggcgccgtactatcaagaggggtctatgaagcgagcttgtggatgatcttgtgccatattagttcctatgcatgtaggtgcattttgtgggcttgtctaaccaagtgtgatgagttttctcaagtcctaaaccaagagagaagtgggcatgtcaaataggagtgagtgacatcttgtgggtatgtccggtggatatcctttggagtgtgagcccctttatccttgacttaagttgtgtttcttggatggatttttcatgggttggatggccctttgaataagctttccatatattccaagaacgccaaattccgagacccgagtcaagagatatcgccgttttactaacggtcggttgagctgaaaagtgacctgcggtctgaccgtgggccttaggccggtctgaccgggtctgttagccagtctgactggcgtggtaaggccggtctgaccggccccattggtctgttgcactagtctggtttttggtggcgatacagagccgccagagccgcaaccggtcagaccgagccgacagcagtctgaccgagccgtggacggtctaaccggcactacactgcggtcagaccggccaggttgagtgggctcaatgattgccctgtaacggctagttttctagccgttacaaagtagtccggtctgaccggcatcacaacggcggtctgaccggcagaacacaaagttggggattttggttccaacggctagttttgatggttgggggtatatatacccactccccagcagcaagggtaaggttttggcactccattgcattatcttgaacccttgcaagagctctcacacccttgtgcacttagtttatctagtgaggtgttaaaaagtgagttaagtcaatccaagtgcattgcttcattgttaaaactaggggggcacctgatattcctcggcaaccttctaaaattggtacctctggaaggttgccgctctaaaccggttggggaggggttgccccgggaacttttccaagaaaatgtggaagaaggcccgcccccgttgtgagtggtttggaattcaccaccttccgagcgaaagaagaactacccctagtgatcgaggcttgggtagtcctcttccgtggcccggctctcaccttgcccaccccttgacgaagggggcgtgccgtggcttcgtggttgagcggtggagttgggctcccctcaacggggattaggaaaccggcgagtttcgaacctcggtgaaaaattccttgtctcttgtctcatttattttctgcatttacatttgtgcaatttgcattcatagagacatatttgagcccatatcacctaggtttgcaaaatttaacttagttgcttagttaaccttgcacctcaccttgcctagcaacttaggttagttttgtttaagtgccattaagttttaagaccgcctattcaccccccctctagtcggcctccttgatcctacagggtgccgtgcgcggttggggatgtggtgagtgtggccgtgcccggcgggcgaggccatgacaggagcgcggtcaatggcaatggtgactgtcacaccctgaagttctttcccaagcctaaattgaagttataaatggtctcaagaaaataccagtgtaaagcaagagtaaaccttaataaattaatgcaaataataatcagatttggcatgtgggattttttttgagtcctaaatgtcgaaatacgctaacaagatttttaggggaattttcagagctctagaaataattttaaccaattaaaattgagcacaagcaatatttaatcccagaaaaatccattcccttcctttcttttttcttttcccctttttttctttcaaatgggccgccggcccgttttttttccttcttttcttggtgggcccggccaaaggccaaggcccacccaactggaccagcccgccggcttccttttccgggggtgccgacagg

SEQ ID NO: 48427 - DNA, 3201 bp, Oryza sativa
tggtgcgccgctccttccccggtccgtggacttggtccaccatgaaccgccctccccgaggcactgccatgtggggcccgcatgtaggcgccgcccctctctctctcccgtgatttatttattgcgcaataattcaattaaggatttttctgtttatagtaaaaacacagtgaatcttctaaaatttatatctaattcatccaagctccgtttaagcccattgaagtctcagtaaatcaataaaaatgtgtagaatccattaaaaatggttttgttctctgtttcagtagtttatagcctgtttgtattgtttgctttgtatgtcgcttagattccggctctccccacgctccggtgtactttgaaatagtcgccgaggttcctccagcagtagagcaaggcaagtcatgcttgtcacttgaacatgttgatcctatattgcaaatgctccattgttttccttcaaatactgcattgatttataatattaccatgggaagtttacctactgttataccatgctattttgtaccatgttcctttgttagcttgggatataacatgactagagattggactagggatttcttagccttgcttagttcaactagcacacaatgggggacaacattaatgcatagatatcagattctaggaatgatgttggttaatgctcaccgctccagtgttggttaattaaaatatattaaatggtgggctgtgggtgcatggttttgatggtcgcgcccatggcaattaaggaccggttcgcgggaaatcctggaagaattcctcgtacttaccacaagccagcgtgggcaacggctgagcttgtagtgtagcttttctctagccgacacatccaggcaagggtgggcgtgatggagtttggatgggccttacgacggcctatgcggcttccggattcacctaggcacgagaggggactgcccgctgccttgcgaaaagtgggagtgaaacctgaggtgtggtgtgcttggttagaggtggttatgcgaagggtcctgtcatggcctctttccggtatgtcgtggtggcatgtcggcgcacggaaacgtgtcgtggggctgtgtcttgtgggtacagttgtacacctctgatcagagtaaaactattcaaatagccgtgcccgcggttatgggcggtcaaccagattcaccgtgattagtctcaccctagggtagtctgatggaactgattagttcaggtggatggttgggcctgttgcaacgtggtgtagcgttggacagtggatggttaatattgattaattactataatggttttacttcttccaactactgtttataaatgctcgctttatgcaaatgaaccactctagctatcctttgattaccctgcatcatacccctatcccggtatgacttgctgagtacagtgggtagtacttagtcttgctctatttttcccaaaccccagagtttgagtatgcgtcagatggtggcttttccgaggagtaggtttcgtccgtgccatcgaggatgcctgtggagtggtgttcccgctgcagtccaagtcaaggctaagctccagatatcttttaagttttccgctgcatttatgtaagacttttataatatttgtaagacgtggatctgtatgtcaactttgtcgtttgtgtaccccggccggtcctggacggggattttaatgcacattctgcttggaattctattcgggaatttctaggcgtgacagtgacgagctcagaacaaccggatccgatggcaaactcgctcatttgtgtgatttttttcctctctttttttccttttttctagggttctcaatctgtgtaactatccgattggatgattcttttagattctccgtgtagttctgtttgataggatgacttttttcaggttctctcagtccgtgtagatctttgatttgattttgtgctttatccatcgtacatgattggtatatagagtgattaataagaacaaaaaaaattctaccttttttatcacggacggtgggtcttcttttctccgtgtcattgatgaatcggacttttcttttttttttctttttatatgatgagggcatcatcaccatggataaaccataatgatgttttacctaatcgaacataaggtgcaagcttcttatgaatcggagaggtgtatcgatcgctaagggcgcaacgcaatgccttgtacggttgtagtcggatcatcaacgtttcttccaaatcgtagttatctcaactcaccgaaagatcggtccaaacaacagctttgagcatcttgagtggagctcagggtttatcattatatatttgttcgcctttttttttatcacgatgacgaaaacaccttcaattttttaagtatttttttaagtagtagagatagagataatagaaagattaaacaagattcgatagacgcatgtgatgatatctctaatctaaaaaatataccaacttagtcttggagattctcatagagatatgttgtgcgtgtgtgctttcatatggatcaatgtgcacgtgtttatatgaatgcatgtatctatactgtgtttcgaaaaaaaatacaacctgttctcaacgctatattgacgtgaaagtaaagtgaaagtcttttttactttcacgtagaataattgattttgtatttttcttatttacttaaagttgtctttataaattttagcaaatgagatattttcaatagactttcatgtctaaccggaggaccgtagcgtttaaaaaggaaagaaaataaataaagaaaatgggaaccgttttctcgctccccttcccaggcgctatctcctcccaccactcgaaccttatcccctccaggcgcctcactcgaaccttaatttcgtgttctagttagaaatttggaatttagaaacacagctggattggggttctcctatggatcatgcttcagattttatttaggtggattagagtcttattcctttcgattttggaacgacctgggctacggactacacacgttaggatttttatcgatctctttttctttctttggccgctgtaaaatagcgaagatagagggccactcagtcggaatcgacggacgaatcggtcggaattgacgcacgaaaattttgtgacgaaaggaaaattttgccaaaggaaaattacgattctttatattagttaaaatttat

SEQ ID NO: 48428 - DNA, 10552 bp, Oryza sativa
ttggattccttccatatatgtaattcttccttatgttctccccatgtactcctatatatatcggcccccctgaggctcaatacaatgtgtccaatattccagtatcctctctccctatactatctaacactgccgcgcctgtgccgtctgtgcccgcgctgccaccctgtagccgctccgctccacaccgcccctagccgacatcgccggcgtcatccactccggccccgccctccgtgcgcgtgcgtccaagggatggaggtagagccctgcctcatccctccttctccctccttcctttcccgttttggcaaggagtgccccccctttctttcttcttttccctccctttcctcccctcaccggcgtcatcctctgtcgccgatttggccgcgtgcgccgagcgccagccgagccatttgactgcccaaggtcggttctcccctcccaaaccgacatcgccatcccaatctctcttgttttcactctccaccgctgtcgcacaccattgtcgtctcgctgtcgccgtccgtcgctgagcgtgccggaggagctggcgcgttcttggacgcgtgacgtgaactccgcgctcccgcttcatccccttcctcggccaatacgatcacgtttcgcgccgtgtactctcttcacggcaccctgtcccgtcgaggtatcccctcggttccccctcctcgctctccctcctccccgtagcacacccgatagctagtaggcgccaccccaagccccgccgccgctcggcatggtctcgccgccattgccgcccgtcgcttgccctcctcggctctgcttcgtccaatccgacgctaggaacgagtcccggtggtcgtgtgtctgctctagcttcaagaaatcgaaccctcgtcgtcacgtcgtgctttccctcttttgccgccgccgacgaacaccgccgcaatccgccgccgtcggaagggcgacacggcggagcgccagtgccggcacgtcgacgcgaagctcgggtggctcgaccacccgagcctatctaggacgagcacgagcatgtccaacgggagagacgaccagtccatctgcttccgcttctttttcgccggcctggctggtgttccacacgcgagagttcgtgcgtgcgtgcgtgcgtgtccgcgatggcctgcacggcgtaatataggtcggcttccgcttgtagtttttgttagtttgctatccaatctccaaatagatgcatactggagtactagtacaattaattttgatgtcgtgtaggaattcatgtttccttttcctgatctacaggccggtgcagattataattggtaggagttactgattgtaggtcttaggtgtgcatacttcttcgcttctttatctcttgtagacttgtactactattaaatcgcttctttatctcggatgatttggaacagaaatcacgagacaacacttgtaggatttctaaaacactgcacaaattcgtataccgaaagatcgatcggccagtcgtccgtcgaaatcatggaggaggcagtcaacgcatctgccgctctggatcccaagcttgctcctctgctgctgttcggccacggcgacgccacgttcctgtacagcgtgccgaagagagcgctgctgccaatgccaacgccaacgagggtgggcgacggcggcgtcgacgacatgatgagaggccaccgctggtggaccacggcgcagggctggttgctcatggcgcgccccggctcgccgtgcactttcttatgggaccctttcaccggccgccgtgtcaggctgccccccgaccacgacggcaccgtcctcaccgccgaaggcagccatcgccggaggtgcctcctgtcatgctgtggtcccatggacccgaccagctgcaccgatctcgtcatcgacctcgccgacccggagctctggtattgccgtcccggcgacaaccactgggtgaagctccatcagcaaccgtaccagtaccgcaaccctgcccaccgtgacgccatcatcagttttttacgcaagtttacggcgatcgacggcaagttctacaccgaactacacaccggcaatgtcggcgtcctcgagttctcgccggaggttgccgaggggaactaattcccctcggcccaccggcacccgttgtcaagcgttatcaaatccatgcaggctcttaagtcgtgtagttatacaaagtcacaaacctgtattatcgacgaaaatctcgttccttgtagattgagatgcatggcctctctgtttactttaaacatcattcaagcggacaacaggtggatgttaatttgcctaaaaccgacatttttcatcttcactaatagctgatccattttgctgtgctacttatttactgttctctgcaatgactgtttggagatgctgctccacaaaattcagtggtgaatagatgtgtcttgtgtatttatcatacatctgttcactttaagccaatattcgagccttttgccctgttacatcaaattgcattattcacttaaataaataggtatgaataaggttactcaaaaaaatgctttcgcagcaacaaatctgacaaaactgcaaaagttcacccttaagaagagggatatatatatatagcattggttctgcacttctgcatgctaaagtactccacatgatacagcaggctggctttccatccataaggttacaaatgggcaggattgccgtttctgtttgagataaaccaaaggagttgcaagttagaataaagcatttatagtcacatcatgcatacagtttcagtactacctccgtcccaaaataagtgcagtcgtggaaattcgtgtctaacgtttgaccgtccgtcttatttgaaaactttatgatttttttaaaaaaaattagtcagacataaagtactatttatgttctatcatttaatagcaataaaaatagtaatcataaaaaaatttcaaataaaacgaatggtcaaacgttggagatgaatagtgcaaaactgcacttattttgggacggagggagtacaagatacaacacacagcgaactggcaatagattgcttttttgtaaatcttaccactccaatgcagcttgagcttgattagttccaggtgttgacagacggccctgtgactggttgctcatctagggcacggcgcaactcctcaaagaagttcatctgtactaccaatgaccacagaaaaggaatcagagtacagaaactaagacgtaggagaacagtatgacaaaatcgcaggttcaatatacctgatgaggaagtttcatgtgaccatgaccccatgatgatccactagatccagagtacatcaccggcttatctggcaaaacatcaacagcatttaataggttactttggtttagtgcttcccgttggtacaactgacatgaaaattcacttgagtgcacagggtacttgatggtgttcatagtaacatattaacatcacgaattgctatacaatactataattgctagcaccataattgtgcggcgtcactactgttgccaacactttatattcacctccatatttctatcataacttatgaaacggtaatctaaattaaacataggtctaggatagtatgccaggtcttgtagaaattgatcctaaaatatctaaagattcctctaccatgattcatgacatagtaaatctcccatcatgcggcctgaatttgcttaaggactcaccaggggaatcatatgactgatcattgtacaagttcattgctgcagcccaacctacaggggaaaagcagcaaaggtttattatcacataagaagaatggttgtaaataaagttggttcaaaattagtacagcaactgtaggaatacatctttgttatatatgcctagaccatccttgattaaaagttgcctaacttccggtaaattaccggtggcatatgcacaattgcacataaagagaacagttgatggtatgattaatgaacaaaaaagataggataagcagtaggtacacagtttgaatattcttccatgttactaacatgcagagaaccccaaaataaatcacaacaggtgctccacgtatttttctttacaacttacagtatctgaatattggattatcagcctgtgtaaacttattaaagcaatgggcggttctgtaatatactgcatgtgcttttactacttactccctccgtcccaaaatataagcatttttagaccacgacatagtattcgagatgctactttgaccacaatatctataaaaataaaatggtttaaataaaaagagttgcatataataatagtttgattaatgataaatttagtaacatcaatttcacattattgattttttttatttttttgctattaatagttaaagttaaaaatggttgacttagcactatgctaaaaatgcttatattttgggacaaaatgagtaatatcttattactgtagacataatgtatcactaccacaataacatgcaacaattcccagaaagtcaaaaagataagaacttatatcatagaacttctacaagcatttaaaagggcagcttggtctctgagaaacatacggtcattgagaagctgggcagcctcactggcacaacatccctccaagggtattaatcttgtttgactgtaatcattctgaggattgctgaaaaaagtctcatgagggataattggtggaaggttctttaatgaaggagcatggctcttctctccatcattattgtacaaataactagccttctcagccctatctgtttggtataacaaaagtgttacagtgtcagccaaaaaaaatcacctcataaattaaattgttatgcttaaacatacagataaatcattaaaaaaacacatggataaggaaaagatagcccataaaaaaattattggaaatatgaataatcaaataaagacatgtcaaggttagaagattctggacagctattggacataataagtaaactctgagtaaaaaacacatttgacttgtaaatgactgattgtggggattatgattgcaggtagcttgcattagatgcatgaagttgcatgttgtacagagtattggcatcattaatacaatggagtagaggggctcatacaaggatgtttgcttgcaaggatttccttatagatatagagtagttatcaacatggtcggtgtaaggcacatatttttcagcccatttgtggaaaagaaacatggcagtttcactgcatagaaatctactagaggaataatgaattaagtttgataccataacaaccaacaactggataagaccttatcaactaatttggagaccttatatagcagtcaagccaaaataataataaaggaaaatataataaatccccaaaacatcatgaaatccaactgattcaataataattgcgtcgattgttagcacggttcctgaagcatattcagtaaagatagccatcagaaagcatatctatgcatgatatgtagcaagattattaaaactaaataataactaacattagactgcagacaacagaatatttcaagaaataactgatggtttcaaacaaaataaatatttagctcataaatacaaagatggaacaaagaagccatatcaagttatcaactaatcaaatcaacaaggtgatagactgattgaacaatatgtcttaagcaaatctacttcttcattgtgaactccacttataattgtgaaattgtgattacgcgatcacctatcaaagggcaattttcaatatctggcagtacagtaactaaagtatgatagtctttatgcagtcattatatgccctgtgttgaagtcatgcgttaaacttatacaagctgaccgactggcagagttttgctaggcaaggttagcttaatccgctaacccaaattcgaaacatgggcaatccttcacttgctaaaacaggtagttaggtcagcattaaacatgccctgaaataagccattagccatgtagcttgaacaaagatttttctaaaataaataaaagttagttgctaaggttgttcattctcaaaaagctaaaaagagagaccagcgagccaataagccttataggtcggcttccgcttggagattgtataccgccccggcgccccggttggtttttgttggtttgctatccaatctccatatatgcaaagtatttagattttgctttagaattgggtagtggtttgaattttgatatcgtgtaggaattcatgtttccttttcctgatcaacgggtggtgcagatgattggtaggagtactaattgtaggtcgtagatgtgcatacctctttcctatgccaatagttatttataaggatttatgaatttgatcggccagtcgtccgtcgaaatcatggaggaggcaggcgatgcatctgcagcactggatcccaagtttgctcctctgctgctgttcggcggccacggcgacgccacgttcctgtacagcgtgccgacgagggcgctgctgccaatgccaacgccaacgagggtgggcgacggcggcgtcgacgacatgatgagatgccaccgctggtggaccacggcgcagggctggttgctcatggcgcgccgcggctcgccgtgcacttttttatgggaccctttcaccggccgccgtgtcgggctgcctcccgaccacgacggcaccgtcctcgccgccgaaggcagccatcgccggaggtgcctcctgtcatgctgcggtcccatggacccgaccagctgcaccgtgctcgtcatcgacctcgcctacccggagctctggtattgccgccccggcgacaaccactgggtgaagctccatcagcaaccgtaccagtaccgcaaccctgcccaccgtgacgccatcatcaggtttttacgcaagtttacggcgatcgacggcaagttctacactgaactacacaccggcaatgtcggcgtcctcgagttcttgccggaggtggcgttcaccaagatcgctgtacacgacgacgataggagaccggcggtgtacaagaaacgtactacttgcttcgtggaatcaaacggggagctgcactccgttgtcttctctcacccgatcggatgtgaccggattgtcgcgcgtgtaggcgtttacaggttgagcattaatgcggcggcaacgcaggagcaaagatcagcagcatgggtgaaggtggattcgctaggtggcagagcgttcttcgttaagataggcagttttggagcgtcacttgatgcggagggaacaggcttgagagggaactgcgtctactactcggtgttcaatgggaaagtgttgtgtgtatacgacatggaacgaggaactacggctgtaatcgatcccggcacacatcttccgtatcaccagtcaccccaagtattgatgccaacatttcctagatatcatggcggagcaactcgaagtgttgaaagcatctatcaggttgggccaacaattcaggaaaatgcttatgaggtaaaagacactaaggtaagtaaggtgaagagggatgttcgatttttcgagggtggttgtacttgtttgccgattcctattcaaaataagttaataaatcagaagaagagtaagaggtctatggctgaaagatttccttgtcaaggggaaggtgcaagcagtcccgaaacgaagaactcataccgcggttgtggctttcctttggagccgctcaaatgtcttctgcgtatgaagaaataggagtgcactacatagaggatccaacttaccttttatgccaactcgatgagtgtttttttagttaactcattcattcaaaatatgcactaatgttagctcggctatgtcacgtctattaatttcattaagttttggtctctactatgtgattgggagctctttttctctgaaattttatgaaaccatcttcttttttcttttaggtgtttaacagctccccaatctgctttcttcctgagaaagcctcgttgtgtagtgcccgttccgtcgtagcgcctagctaacatcgtcagatcccaatcccccaatccatcgtcaagttcgaattccaacttcaagtcccctccaaatcaaatctctcgacagaagtctatttcgcctccctaaagttttgtgggccgagctccctccctcggcacatcttctccctcagcccatcccctcctctcgcacatgccgtgcgagtgcgctgagccgagccgagagagagccctctctctcattttcttgctctctctttgttctctctctccccgatttcccgccaacgacacccaagttgccgcgccgcctgttgccgcgcgtgcactgtggtggccgaccggccggtcgccgccgccgtcagccctgcctgttagagtatatggtagttagagtcatattaggatagaattggtttgtttggattccttccatatctgtaatccttccttatcttctccccatgtactcctgtatatattggctccctgagactcaatacaatatgtccaatattcacagtatcctctctccctatattatctaacatggtatcagagcagacgatctagtcgcctctctctcacgcttccgctcgtcgccctcgggagggtttcaatctcctggggcggccaccgtttttttttcttcgcgtcgtcaagtcgatgtcccgagagagatcgatctctcggacgcttgcgtcgtcatcaagcggcagtagcagagtctccggtcatcatcagtctgcacttcgtcctccacatccggtccgccgcgtccaccgcccctacctcggatggccaccgtcggcttatcgacctccgccgggctccgcggccgacggacgaccttgtctccgcctcgaccgctgtcttcatcaagctccgccggggggatggaccgacgtcttcaccgcctctccgcctgccttctgcctcgtcgccggcaagacgctgctggtccggcgtctctggcacgggcgcgcggcccgacacctcgccgccaggatctgcaccattgtcgccgcttgcggcctcgacgcctccggactcagctccctcgtcgttgccgccggtcagcccctacgcgtccgcgtctatcttgcctctcgctccctgtattgtttggttgtccgtcactttgctgtgatcttacacgtgattagcaagggagaggagagagagagaagatggttgcagagagcttgttggctggctggctggctgtggagggaaccgattgtgcatgtgtcgctgctgctggtacagttgaggcagagaggttgctggacgtggacttggtctacggaccatttgagcacgtagggctggttgtactgtgctgcttgctgctgcatgtatctttttttttcccgatcagagatcgggtttgcgtcgtccaccgcctcgtcgatatctacgcgtctctgacatcggcatcgacttcgtcgtcctgccccgcgcatcttcggcttgatcacccgttcaagcgtccgactacaacgacttctgtaaccgatcgtcatcgagcatgcgtctacgccatcaagctctgggttgccgctgtgtcgcctccttgggccgcagtgccgctgcctatggtccacacctccattggctattgcaacgctgagaggcgcccttctcagcgtggcctcaccgccggtggacttctcgccgctgcatcgacatggagctgcagctgtgctgtcctctcggaccatagctttgccactttcgtcgtcttcatcgccgttcgcgcatcgacaacctcgtcgtccgcactggtcatagtcagccgctcggggtctccttcctctacttcaagcatcgccgccgcatctccaagctgccactgtcgccactctaggccggtggtgcagctacctctacatggctaccgatgtcgccgtccaggccgttggtcccgctatttcgccttctactttgtccagcatgactcatcgccagcgtcgccgtatcttcctcgactacacttcgctcttctccggcaactgcgtgctgctccggcaattctccctctacgccgttctcgcgctgcgactgtcccagaggccttctctgctagtctcctccgacattggcgtatgattcatggtggtctcctgtctcgcccgcgcggtattggcaacaccggcgcgcgcgtttgtcccgagttgtcccggggtctggcaagccctgtgtaacgtctcgtcctttacggttcgactacattggctcttcggcgtcatcttcctcaacgaccgccgcgattgtatcaccgtcttcgtctccagcgcgtcctcacgcaccattggtccacgatgccctcccgtccatccacgaccactctacgacgccccctgcgccttacggctcgactacctcgacatcatcgacttcccgacttcggctacatcgaccacggctactctacgcacggcttcatcaaccacggctctctcggctccttcgctttggttacatcgactatggcacaaagggctatcatctgtgttgagtactctttccggttttttttccagtccaag

SEQ ID NO: 48429 - DNA, 797 bp, Oryza sativa
ctctggtattgcggccccggcgacaaccagtgggtgaagctccatcaacatccgtaccagtaccgcaaccctgcccaccgtgacgccatcatctggggattacgccagcttacggcgatcgacggcaagttctacaccgaagaactctctggcattgtcggcgtcctcgagttctcgccggaggtggcgttcaccaagatcgccgtacacgacgtcgataggagaccggcggtgtacaagaaacgtactactagcttcgtggaatcaaacggggagctgcactccgttgtcttctctcacccgatcggatgtgaccggattgtcgcgcgtgtaggcgtttacaggttgagcattaatccgacgacaacgcaggagcaaagatcagcagcgtgggtgaaggtggattcgctaggtggtagagcgttcttcgttgagattggcagttttggagcgtcatttgatgcagagggaacatgcttgagagggaattgtgtctactactcggggttcaatggaaaagtattgtgtgtatacgacatggaacgaggaactacggctgtaatcaatcccggcgcacatcttccgtatcaccagttgtagcgcccgttccgtcgtggcgcctagcgggaaaattatctcttaaaaaccctaattgcgaaatttgtttccttgctcgttgtgtagtgtccgtgccatctcagatctcaaatccccgatctatcatcgagttcaattccgaatccaaatccttccaaatcaaattcctccgcaaaagtctagtttgcctcccccggggt

SEQ ID NO: 48430 - DNA, 6508 bp, Oryza sativa
cttcctcccgccagcccacgtggcagccacgtaggcgccacgtcggcgccagctcgaccgaggtcgggtcgggccgaccccggtcagcccctcccgtgcgcacgttctaccgcgagccgtgaggctgcgcgtgggcccgccgcatccgttcctccgcgaaccgcgcgcgtgcaccgcgtcccagccccgcccgcgcgcgcgcgccgcgtgctcgctccgcacggtgaacggagtcaccgacaagtgggtcccacccgggaccacgcgcggtgagcccggtccaccggctctctctctctcctccctcccgcgcgagcgcgcgccttgggccggccggcccatttagctcggccagaccgccccaattctctcgggccgcgccctagccgcccgagaaaagtctatattccctccctcttttcttttcttttattttcttttcaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggaccgcacttaatctgtttgtcccgtctgcaaggcagattggcggacctacctagtttgttgcatttgatccttcctttgttaattgttatatcatgtccccttgtatccatctagttgtgtctcgatattcgtgcaccctgtgcgagtatcgacggacgccttcaaacttaaaatttgaataacaacttgggtaaaacttgggttttacaaaagacttggaaaacccggcacctgggtcggtgcttgcgaactaaatgaatttccaaaaccgcggaccggggaacgtaccgggagtacggtttcccgctcttgcacttaaggaccgtttccttggaatttcatccaaacataagacaagtacgaccatatgggtggaatgggacacccctagctgagtaactagcttatcaggggagccttgatgccgagagacatgtggattccccgaggtggtgtcggggaggactctgggcttcctggcacagtatggtctgggacctaacctgttgttggtctgggacccctctcgtcggcatatggtaaacctgtgtcggctttggaaatgccttgttatgaaagcttggaggtctcccgatgtggctgattcccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattacggttgtggaaaggggttcgatgtttgaaaaatctgcagctgatgggatcagctaggcccgggtggccgtttgaaagttgttggcccgggtggccgtttgaaaaactgttggccgggtgccaaccttgattcaattctaaagactgatacattgcacatactccgagcggacgagacgcactgtctcatccgtgtcgtttgagaagcactcacttagttgtttttagaaaagagttcaaataaaatcaattgcaaaaacaacagcctttcctcgaagcctgcattaaacacttatttcccatggcttgttgagtactcccgtactcacccttgctctatataaataatcctccccccccagttgctgaagaagatgaagcggaagctgctgatgagtagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgaataacaggttaatttggagcgtcacgggctagttccggtcgggactagttcggggcgtgacaccagtcgcctcaagtattgatgccaacatttcctgcaggatgttacggcagaccaactcgaagtgttgaaagcatctatcaggtagggacaataattctgaaaaatgctaatgaggtaaaagacactaaggtaaataaggtaaagagggatgttcaatttttcgagggtggttgtacctatttgccgatttttattcagaatacgagagtgacaaagcagaaagataagttaataaatcagaagaagagtaagaggtccatggctggaatacctccttgtcgaggcgaaggggcaagcagccccaaaacgaaaaactcataccgtggttgtggctttcccttggaggcgctcaaacgtctcctgggtacgaagaagtaggagtgcactacatggaggatccaacttacctttttatgccaactcgatgagtgtgtttttagttaactcattcatttagaatatgcagtaatgttagctcggctatatgacgtctattaatttcattaagttttggccactactaagtgattgggagctctttttctctgtaactttatgaaaccaaaccttctcgttgcattaagagaatgatttggtaaattttctttgataaaataagttagaaaatattaaaattaattatgaccttttgtttttccaaatatttgttaatttggcaataatttattcaaattcagtaaaagaatgtgttaaaatttcaaaaattttcgtttggagtggtgcctaccgaaattttctagctttttagaaagaaaaaatcctgcttatacccggttttagaattgagggccgcaattgaaactcgacctcctccataagagacggaagtggacttttccaactgaaaagcatttcctgcctgaaaccggagagtgagagtcagagactcgttgttctaaaaaaaagttctgaaaaaaaagtgagagaccctcaatccctccccaaccggaacacccactccgacgagaacgacatggacgccggcggcgaggaggagaagcaggagcgccaccgggttgatggtgcttcgccttccatggtcgccctccgctccgacgtcctccacgccgtacggcaccgcaccgccgtctctctccctctctctctctccatccatcggccggctccccgcctgcacgccggtagctgacgtgtttggtttttcttttcttttctttttttatgcggggttggctgccggacgacgcgctgctggccgagacgcgcgccgcggatcgacgggtcgtgttactcttattgctcagaaaattaggtttgcccgttgctgttcttatggctgtaggcaactcaagtctatgtggggataaattttgtgacaactcaagtctttgctacgattcgtttgcctaaacgaacaggtgtaattgggcttgtagaaaagcaatatgccaatatagattcctaaggatcacaattcacaacttcccaaccaatataaaaatttctgcaccctcgtcaccaaggataaaacccaatgtgaactaatgtgaaggaaagtcgagatatagaacttcattagagcgtaaatagtatcctttggttccagacatcaacacatgcccttttagctggtcgcatatatcttccgtgctgctctccgcatttgttctgtatctaatgtttcagttactagcaagtttgataagaatcattgcttcctctgaaagtaattatttttcatgtatcaagaattgctgacgctgaagagaatttgggtgaggttgaagtgcgtgaggcccatatagccaaatccttgtacttcataagggttggggagaaggtataaatctgtatatctctatactttaccctgtgacctggttgacaaagtacatgctcgaaatttagctacttcagtgacaggggacctcctgttgcaggtccttggagggaagtttcataatcaggacacttctgaattggtcacactggtatgaaagagtttcatctatcatgtcaagttaaatcagggaaatcttgtaaatcgcgtcttggaaaaactaaagatttgcagtcggagtggtccaaaaacaaatttcctttgtatgcttatgctgctgcttttatgttcctagtcatgcaagaatatgataaaagatcacatggtattgacttcctcaatcgggactttgttgtccgaggtaaattgatatacatgctcggtgtctgtatgaagtgcatggcaatgcatccggaagcatcagctgttgccccaggtcttcttgatatgatcagatctaggtatgccaagcctaaacaaacatttccctgttaaggaattttattggtaagttaccattttgacatcaaattttgttctacagagctgtttgacaacatcctgaagcatatgtcagaaggtctgtgttgtttgcagcttcttgcatattgatagcgctgcacctgttgtatgtctcatcagctcttatagaaggaaatcaggacattctacatacacatatgggttcttcatgttgcagaagctgatctgatacagaatgcacatatcagtatgtattttggtcactattggggggggggggggggaattatagtacaataggctcagcacataatactaacagggttatttttcaacccacaaagtacaggttttcagggtaaactttatatcaaattcatttgcgtcgcctttaattttatcctgaaggaagagtgctttcaccctgagatgattcaccatctgaaaaataaaaagctaataactcccaccttatgctttagtttcctgtgacatacttctttctatcattcctttaagtcttctacttcaaccagtgatccagctcttttcagtaatgtgtagagaaaattcggactcttttttttcaaaaaaaaaacgtataatgagaaaccatttcagtacgctggaactcagtaacttctcacaatgtcatctaactcctccattggcatgtctgtctccttgcaggccattatgacctgtttgcaacttcgttctgagatcttcagacatcacaagcactgaatcggtggatcacagcatggccagcagctgcaggtctctgccttttaagcttgataccatcaatgtactggattagaaatataatcgatcaatgtatttgggattcagagtgctacatttttcgtcatttatacatagaacatgaattcccaacatgaattgatttatgtgaaacgtctgttccagattactactatgtttgaaaactttgaactgattagttgagcaaaagaaaattactacatgtgaacgggtcttgcagggcgagaggaggaggaggaaggtgcatgctccatggtgaccaccagccacaggacagggcactcccggagcgttggattagccgcgagggacgatccaacggccgagatgcgtctggtgcaggtatttaagcgcaatgctgcttttccttgcgcttggctggctgcacaaccacttttctgcttctccctctctcacacattctcatctcaagagcagtagcggcgaaagatgaaggacaaatgttatatcgaattccgtctgcattgcctttgattttagtttgaaagaatggataatttcactgtgatatgattcacaatctgaaaaataaagagctaatgtcactcatcatatgctttagttttcagtaacctactccttcctctcattcctttagtctaatattatactcattcagtgatccagatcttttcagcaatttgtaaagaaaaacaggacttctttttatcgtataaagagaaaccaatcaagctggaaactcaataacattttacagtgtcatctgactcttccattggcatgtttgtcttgtagatgggtatgtgctgcctgcggctccattctgagatggcccttcagacatcacgagcactggaatcggcggatcacagcaaagccagcggaagcaggtctctctaccttctaagcttgataatatcatcataccattttgcgaacatgatgtgaatcgatgtactagattaagttgtaaataaacatatacttatcttgccatgtaaattcctgctcagctagttctgcttaggcttgatcatatcgtattacaggcaggggcggatccaggaacaaaagattgggggagttcaattacacagtttcttcaaccttgagccatttagggactttttagtttatcatttaaggtaaaaaatcgaacggggtactccggagggtatcca

SEQ ID NO: 48431 - DNA, 15547 bp, Oryza sativa
aatgtgcataacggacaccacagctatagttgcaaatgcaatgtgggtcatgcagggcgagaggaggagggcgcgtgctccgtggggaccaccagacacgggcggtgcactcctcgagcgttggatcagccgcgagagacgatccgacagccgagatgcgtccggttcaggtatttaagcgcgatgctttcttctccgtgcgcttcgctgcacaaccacttttccgcatctctctcctctctctctctctctctctgtctctctcgcaacgtactcatctcaagagcagtagcggcgaaaggtgcgaggtgagttgtgagattctcctcctcctccatccctaaaccctacgtcctcccaaagcgccgtgagattcttctccctttccttcgatctcgctcttctggtggtgttctccctctcctcctggtggtgtggtttctgcgtgcttgggtgtttgggggcgtcgcggttttttctggttcgatcatgtctttcgctgttgtggcatttgatcgagcagcaaccgcgtcttgacctctctttgaatcttgaggcgtttcgtcatccgaaacttggggcaaggatcacagctgtttgatctttttttccctctcttgtaggcttcccgtaccgtgcttttgttgcttcgatggttttgaagtttgaggtggagtgtggttttctgagttggaggaggaggctgatgagcaccgaagcttcatggtgtattgatcttgctgtgtgtgtctcaaagtctctaccagtgcgtgcgcaaaaaattagaccacgtcaattcgtttctcttgtctgcttgtattttccagtttgttcagttaattttggtgtgttgcgggagttcagtttctgaaaatttattaaccagatgccgccttcggccttcttgttcttttcgctgttcctgatgcaggatgcttcttctctatgtgtctctctgacgtgttctcttggtttagtttctgtttggaaagaactccatgttctctctgacgtgttatcttggtttagtttctgtttggaaagaactccatgttctgttcatacaatgatttctgcatgtgtagcttggttaaactgcttgtttttttttccctttttgatgagaaatcttctgattctttgcatatcaaagaagctttcatctcttgaatcttagatttgggatccttctaagcccaacggttttggttctgcaagattgtacaatttcttcatgtttgttacctatattttacttctcagtgacgctgtcatgttgtattctccttgctgaattctactataagtgcacgctgctgtctctgtttttcttcttctgttcacttcatactctgtttcgaattattgaagttttaatacaccaaagaggtggccatatcgggaggaaatttattgtccttgtacaatacgccttttctgtttgtttcctcttcatttcactttggaatttggtgttatgatttgtgtcagaaaagcttatatggcgttcttacaaaaccttgtatgcattttgttcacagtaatattttattttaattcttccttgcttgattcttgtataagatataagattaatgtgtataattactgcagcattgcaactgaagattgatgatctcatgttatatgtctcaaaaatgcatttaggggccctgataaatagtgtcatatcatgttatgtctagttgactccttttcgtgtttttacgaaagctcttatgtatttaattgatctgtagtgttttgtaattgtattcactttactctttctccatatttgtcaataaagttattgtatatttgtattcatgttataaattttcagcaaaacaaaggtctgctatgggtaacagccttcctgtagaatcaaagttcactgatgaaaaagagaatgacagaattaagtatgttgtgtcgtctatgcaaggatggggtgagaaaatggaagatgctgtgagtaaacttgcagccttttgtatgacaaaaaaaaggatagttctgcaaaaatttcttactgatctgtaagtaattgtgtaaaatactgtgactgacatatgccctctatattctctagcatgcagctattctaaatcttgatgataccatgacgtcattctttggtgtttatgatggccatggaggtttgatcttcattcttttttttttttggtttcaaatcctccatattgtcggcataactgtttacatcatgctttgtttgtctttgtgtgtcatgtgtttatctatgtgcatgtttcgagaactttactgtttatgctgaaacttttacctgtcaattttcaaataaatattaagctacagttctggataatgagccaagtttgctaattagtactaatcacctatgtgcggtgtgctttctaggataacatgaactgcgtaaacagaatattaatttacgagggataaaacactgcatgggtgtgagttaatattaacagtcatgataattaaaaggatagccactgatgaacatgttggttaatttatgtgtggtgctatttttcttatgatacctatgaagtgctgatctgctgtgttcatcacattgttttgctttataagcttctatatgcacataggagtaatcttgagccaccattctgagttgtttattttctatctcaggagctgaagtagcatcatattgtgcaaaacgatttcatattgagctttgcaatcatgaagactacgacagcaatctaagtaatgcgatgaggagtgcgttttacaggttattttcgcctagtctatatcattttgttgcactgaatgatgctgcacttgcaaatttggaatttcattgttcctgtgtaatttctgcagcatggatgaggacctgcaactgtccgatgcttggagggagttagttattcctcgtaataatggatggatgtattttctcaaggctgcagcttgtacaagcatttgcaaggtatcttttaaaccctgaacgtcttttaatatccatatattgaaggtactcaaaactgtatttgttggacagtgcatattgtatctatgaaaaaggaaatggaagaatgtgtgtgatatcgagactattgttctttcttgagatgtactttggagttggaagagatatgtttaaccctaaccttgactaattgctcctattaaaaaaggttcagttagttacatatcaattgtctggtttactgcgttggaggccaacaggttcttaagttcacattgcaccttggttcttatcatactgtggtactaccctaaattgaggtattgtttgcggcatctcttctatggtaatctctttcatacactggtttggctttcagaaatgtttttctttgtctggtggctttggtgagctatttcttgcttgacttgtatttctaactatgttgggattccctattatgtcctccaattcatttcttctttttccaggcaacttatactgagccagcatatgaagggagcacagcatgtgtggttgtcatcagaggtaaccaattgattgttggacatgctggtgattctcgttgtgtactctcaagaaatggtcaggtatagtgactatttccttttcgaatttcttgttggtacctaatttgcatgttctcttattttggtgcctaacatttgtgcttgtttctgttgtgtcaaaaggccagtgcattatccgtcgatcataaaccagacagtgagtctgaaagagagagagttcagaatgcaggaggagtagctgttgggcatagttatcgtaaaataatggggaggtgggtaaccaagaaacaatggggctttactgattttaagggaagagtatcaatctcaagatcaattggtatagtcttgcctggatctgtttttcgtttattgcagataatagcaccgaaaaaaaacatattatgttgtgatttgctgatgtgttttacccacttacatttcaggggactttgcttgcaagaagaacgaacgtttacctcctgaagatcaaatgctgacatgtaatccggacatcctgactgtaagtgccactatgtttgtttagtatttggttgaatatgaagtttgtgctgctttgtggggtctgatggaaaatccccctttctgcgtcagatggacataactgatgacatggagtttcttgtgatagcaactgaaggcctctggtaaattttgaacaaaaaataactgacaataattattatttgatcattttgatgtcactagtactctttgtgatgctgttttctttctcctgctgatgcatatatagtttcatttatagttgcatacctactgtactatgttttttccatgcaggtgcaacatgacaaatcaaaatgtggttgatcacacacatgaccgtcttttggtgagtccttttcttttgctcagtttgtcttcttggcaggacaagagatctcctactgtaatagcaaaaatattttgtgtcaaattctaggaaatgacttcactcaggcaatataaagcatccgattttttaaaaaagaaaaaaacaagtgctaataagtacactgtcatctgctttgtgattgttcgattcttttgttgttaaaactgctgttccttttgccttgatcaatattgctgtgactaatatcttgcatgtttacgtcaaaaaaatatcttgcatgctcgattgtttcgttgttaaaactgttgttccttttgctgtggccaaatattgctgacttgctgtgaccaattaatatcgctatgcaggagggtgcagaagcgcgtgtcatctgtgaggagcttgttcagtttggcttgccatcgggcgacaacacgaccgtcatcctggttctgttcaagcccggcgccttccctgctgttccgccggtcgacaccgacactgacactgacagccacattgacgatgatgtcgaccccaccggcagcaacaatgccaccgcgtccgacaacaacgaccccgccaacgaggttgatcccactgccaatgccgggtctgacgacagcaacaccggcgacgaggtcaaggtcgacgccactgccactgccgtcggcagcagcagtaccactgccgtggctgctgacgagggcactggcaatcctcctcatggcgcactagttgacaccgacgacgaggacgggctgacctactcccaggacatggacttacccccggcgtcgacgtcccccccaaccttcccggacgaggacgacctcccccggtctaacccggacaagtcccccccgcacgtatcaatcttattcagagtttgagtccagatcaggaaaggccagaagctatagctatgattcggaaggagtagttcgtttccacttgatttttgtctagcaagtcgaagatgatgtgtgatgatgcatgcaggatgatacttatcgtaggtggtagtagcactgtgcattgataggagtagtttgtttctgctaccttgatgatgtgtgatgatgcatgcaggatgatacttatcataggtggtagtagcactgtgcattgataggagtagtttgtttctgctacctttggtttgtggtttttgcctgctgctttgcataggagattaagattttgcttgtcagactcagataacttcaattaactgtctacgaaatctcgctcactggtttttgagttgtgaaggtgattgatctagtgatgctttttgttgttgttcattttgaatatctgtacatactgctgggttatgacttgccccgtttctgaatacttagcttttaaccaaattttctcttcattcttctagttatcttgaatatgtaatcagtaatgtgcttggtttagcggggaagtctatttgtccctgaaggacaattccttctgctgcatgccacccaaaaactcatcaaaaagtttgaaaaaaagaaaaggacgagatagatcgaataaataatatcactccacaaatatgcaagcttaaatttgacacatataagtagaattagaactaagtaatttgattgtgaataatacgaaaaacttttttttatgtcaaagacaaaaagctagggcgaattctcattgaatctcggttgttcatgatagtgatgaccatccattcaaatcttcaggtagcacccccaaatcttcaacaaggcggaaagttcgtgtgttaaaattgttgttttttgttttgtatatgttgaatttgaacttacatgtctgttgagtaatatattactcctacatgttaatttatctttaaaatctttaatgaattttcggatgacatacatacataaataaaaccggagacaaatccacctctttggttaagttagctctgttgcctgctgagaccggctctgaatccggcccatggggaccgtatctgaatccggcccatgggctgttaggccgtagcgggccgcactcctctttcatcagttcggcaacagcaacagactcggcatcactcacccacccaacccagtacccaagccccaacctcgcctcgcctcgtctcgagccgacctaaccgcgaacccccaactccgacgagaacgacatggacgccggcggcgaggaggcgaagcaggagcgccacctggtgctggcccacaagcttttcctcctctcccaccccgacctcgacgacctcgccaaggtcgccctccgctccgacgccctcgacgccgtcaagtccgatggcatggcgccgctgttcgagtcgctggccgccgcgggcgtcctggagccggacgacgcgctgctcgccgagatgcgcgcgcggatcgacgaggaggtccgcaagctcgacgagaagtgagtggattcttcctctcttctgattttattttactagcaaatatgcccgtgcgttgcaacgggtgaaaaaacataatgataatatacatttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcatggtttttttattttttttaccgcgtcacatataattcctttttctttatcggaaagttttttttcgcctttttttaccgcgtcgatggagtcagattcttttcagctttttccttttcttttatcggacaaattttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcccttttttgctttcttttttgtcggacagatttgttttttttccacccggtttttttccgcccaggtttttttatcggacttttcttttttttttttgctccacgatacatataattcatttttctttggaataggacagttttctttttatttttttaaactctttttaccgcgtcgatgtagtcggattcgtttcggtattttttccttttttttcctttttttttgtcggacatatttgtttttttttcgcccggttttttttcgccaggtttttttatcggacttttctttttttttttcgctcggtttttttctcccgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttttccctttttaagggatcgggtgtttttttgccagggaatcggacatctttttttttcctgtttttttcgctgtttttatttatttgtgacggacgatggaagcacctcttattttttaagtagtagtagatttttagccccccaaaaattaggccgccccttgctgtgttgcgtatgcgataagttttgcgataactcaggtgttgatatggtccgtttgccttagctaacctagcttactctgtgttgcgagatgtagatgctaaaactggtagatagcttgcatttgattcggtagttgtaatttatgaattatgtttagggccaattaattcacctctatgcaaatctatactacataataataaactttttccacatttttgttttagattcatgtacatattcatgattttgtacattttctctgcaatgtgtaatttagcatgtagagaagtaattgagattgctaaggatcacaatacgcaacttctcgagacaaaataccagtgtaaactaatgtgaaggaagaacggcatgttgaaatttgttagaaatagtttccttgagaagttgaggttccagtcaagatatgtccttttggtgatttgcatgtttcattgtttctactttctgatcttgctcttcgcatctgtatctaatatttcagttactagaagtttgataagaatcatttggttcctctggaagtaactaagtaattatgtttcatgtatgaagaattgctgatgctgaagagaatttgggtgagagcgaagtgcgtgaggcccatctggcgaaatccttgtacttcatgagggttggagagaaggtataaacttgtgtgcttctatactttacattaagtgtgtgcttgagatttagctatttgcattctttgaaatcaatattgcaggaaaaagcactggagcagcttaaagttactgaagggaaaactgtagctgttggccagaaaatggatcttgtgttctacactttgcaaataggccttttccacatggactttgatctcatctcaaaatccattgacaaggcaaagaagtaagttatagctttgattgtgcctttgtgaagttccattctgccatctatactggagcaatgacatctgactatttattgtgttgattgaagcctgtttgaggaaggaggcgactgggagagaaagaaccgattgaaagtatatgaaggcctatacttcatggcaacgagaaacttcaagaaagctgccagcttatttttagattccatctcaactttcacaacttacgagttgtttccatatgatacttttgtcttctatacagtcatcacaagcataatcacattggatcgtgtatctctaaaacaaaaggtaatttcacttcttacactctcttttctttttcttaattgactcactaacaagaaatatggcaggtggtagatgcaccagaaattttggcagtgattggcaaagtacctcatctatctgagtttctgaactccctttacaattgccagtacaagtcattttttgttgcattctgtaagtgtaaagtatcttgataagctgtctatagttttactgttacagtctgtacggctgggctatatgaatatatggtctaaacttcttttcagctggcatgacggagcagattaagttggatcgctatcttcagcctcatttccgctactatatgagggaagtgcggaccgttgtctattcacagtttttggagtcatacaagagtgtgacaatggaagcgatggccgcagcatttggtgtgactgttgatttcatagaccagtaagtgctgtcacccatccgcattagttttatgtttgtgattcctgtgtaggacaaaacattcttttctgttcctgtgctgtggagataatatctccctttcatttgttccagggaattgtcgcggttcattgcagctgggaagcttcactgcaagatcgataaggttgctggtgttctggagacaaaccgacctgacgctaggaatgccttctaccaagcgaccatcaagcaaggggacttcttgctgaaccgcatccagaaactgtcacgagtcattgacttgtaaattcaatggtctacgttggacgttggaggtgtgatccttctagatccctgcaaagctccccatggacataaaccgtactgaaattgctgttctacttgtactcctaggctcatgagaacatgatctttatctcggtttgattttattgcggacagcaaaaaggttttaaagagaacctccgtgtgcaatttcagtaagtgtgctttagatttgtagaacgagaagagtgcatgtctttctgagatgaatctgttcgttcatttcaagtcttgtggcgatgtctttttggggttccgcactgtttgatcttatgggtctctatatgcttgaaatagcctgacatgctagtctcaaaagagaactgcaaaatagaaccaagcgtaattccttttgttctgagcctgttttcagatgcaacatttcagaaaacagataaacagcattcggtcatacgcaatcgcgcgcacacactgtacagccactgtaactcatcagaaacgaggtcaatatacaacagtaattttcgccgttccataagtccataaaataccgatttctaatatcccaggagactctagctgcagatttagtaaggaagaacaaagcaagttactcagagtcacaggcaagctacacattgtttgttgcaaaaaaactcgaagtattgaggaactacacagagctaatctgggacagggaaatgagcacactggaaaattacagccggctgttcacttgacgatctctggtatgctgcgctttacaatcagctctccgtttctgcagatcagaaatggtaaccatgcaggcaggtcagaacgtctgtgtttgatggctatacaaaggcctagagattcacacaagcaaaatcacaggaagcagtaatgtagtttagtgtaggagcattgtctctctttacttactgatcccctgcttctggttctgcttctccttctgtttccgcttcctctcgtttcgcctcttcacccagggcttctcttcctccactggcgcttctgcctctgcgctgacagatcctgtaatctgcgcaaacgactctttggcgccagaggttacgtcgccgaagaagtccttcaccttgtcaaccacagttttgagctcttctttctttgggagctgggataatcaaaacattttactgttagtgacttgctacctttgctcaagacatgcttactgaaaacatggtcatttgtacatttactataagaaatgcctaccatcctcacttaactgcatagaagttcttttccaggacaacattttctgagctactatctagtactaggccaaaataatttgaaggttgtgctctagaaaatgtcagcctaggataaagcaagatacaagtctgaaatgtacattttcagagatttcagctctaatgttcatgagaaattgctactcctacataacttgcagagaattcgacagggagaggagataaaaggcgctagcgaaacgtacttcgatcacattacttgtcgtcagcgcagacctcaggttcccattctcctgctcacccaaatgagacaggtaaattgcaattctcaattttttcgagtgcaacaacatacaatcacgcacagaagatgaggactgagaaaattaccacaactttgtagccatatcgaaactcattgtcggtcttcagcaccctgtactgctcttttgctgtgtctattatgtcatcctcatccttcagaaatcaaatcatgaaacacgcacatttaaatcttctcttttctacaactcttcaaacacgattgtgtgacaatttgtgtaagcaaacagattgtgctgttaattactttgtagatgacagcggcaaggttcctggcgagcgtgtccttgtagatgtactttccgaggaagttgtccttcgccgcgagcatgatcttcgccgtcgtgccgccggtgacgatgttgagcgggtaccagaagtacacctgcagaaaccagaaaaaaaaacccacacaaatcttgatcacacgcacgcgaagcattgggatcaggaatggagaagaagaagaagaagaagaacaagaatcagggcagcacggacattggcggtgcggatgaagatgacgaagcgcgggttgccgtcgtcctcgatcttgggcagctgcggcatgcgctgctgctgggaccgccggtccgaccaccccctccccctcgcctccaccaccagcgccgcccgcctcgccggcctcgccgccgcctgcagcctgctcctcggcgccgtcctcatcagcaggaagctccccccgccgctcgcctcgccgggcgacagctgccgcagccgcgcccgcgccggcgccggcgaagacgcgctcagcgacgacacgccgcccaccacctccattgaaacctcctattccggtctcgcgccgctgtgtggtgtacgtgttgtggccgccgacgaggacttgggagaagaagcagtggaggggaagaggagggaagataaagccgtggaggggagcttatctggtggtggtgagatggctgtggggtcgctgatgtgtgggcccgggtgggggttctggacccacttgtcagtgtgccagtgagtggaccgggattatgcggatagtttttgagatggtttcgtgctctcggcatacgtggcgtggttacggacagctgaaataaaggcacagtagcagtcgcgtggcttctcccggggacgccacgttgcacatggaacggcctcccagtttatatgttggaacacatcaaatttacaaaattcttgcaaaagataagtttacagattactcgttggattattgttactgccgattatatatttgatttatgaatgaattaatgttttaaaagtaaactttataaatggcttcgaacaagtgatctatagaaaacatatttaagagacctagagtaaataatctgtgacaataatccaataaagtagctaaaaagcccgtttaatccctaaaatttacttatatgaaaactatctgttctaaaaggaggcctaaaaggctaaaacggagtgtaaacaaagctagaaagatgtaattattatgtttaaatttaaatggtattatttgtagacaatgaaaagcatttttttccgaaataaaattttagaagtaagcaaatacacgtcatcgagaaattgaacttacgacgtttccaaacatctcatttcacatttcaattaaaaaaaacttacgtacagatgctaagctacaattacatgcaccaccttttttacgggcgaacaaggcgttcgtcggccaagagaaatttactaagatcaaattaatggttacaaagaggtttaccacaatcaacaacatcgttgatgaaacctcacacgtttgcaacggacttctgcttgtagcatcgaaatgccggcaattttttccccttccagatcaaccccttcttttttctgctacctgattctcttgactctcctagctaatcgtcgatcccctatatactatgaattaattaaaccccttacgatgatcacattaagactaagggcaccacaagtctgcaaggaagcaacaggtagtcaatggcgaatctgctcttcatctcgtcgtaacccggccacaatgacgccatctcatgcacgtcgtacatctcctccatgcagcgtgccaggtacacgacgctgtatcccgtcaccgcctccagcccgtcgtcctcccacggcagcggcggcggcagcccggcatctgccagggtggtggccgcgtaccgcgcgaggtacaccgccgacgccgccacgacggacggcgggatcctcaggctccggcggtcgagcagcgtgaggtcggcgaggtggtgcgccacggcgtgcacggcgtcgccgccggagtagccgtacctggcgaggaagtggtcggcgaaggtgtgcgcggtggggcggcccagcctgtacccgagcgcgtcgagcaggtcgagctccctgtcgagcacctcgctcctggcgatggcgagcccgccggcgccggcgccggcggcggcgtcgccggcgctcagcctctcctcggggaggtcgccctcgtacttggccgcgacgaagacggccgtggcgccgagcagcgcgagcaggcggtggctcaccgcctccaggggcctcaccgactggtagcggtcgacgtaggcgacggcgcggtggagcgtgccggcggcgaggccggcgtgcccccgggtgatcccctccatccacgccacgagcgacgcgcgcgtccacgggtcgacccggccgcgctgcaccgcggtcatgtagtccggcgacgaccgctcgccggcggccatctccatggcccggaggctggcgtacaggtcggcgtcgtacgtccacgccgcgcaggcgcatctctcgccggcgcagtagctcccgtccgtctcgtcgccagcagccgctccgccgggaccattggcggcgacggcggccgcgatctcccggagcatagcctcgacgtcggcgtcggcatcatccagatagagataatccatggcgcgctctgggcgcggagctaggccgcgagctcggtgatggattcttggaagatgggaagagagggagacgacgtgctcgctgcaaatttatagcgccacggatatgatgatgaacccgttgactccgacatgatcactgcgatgcgacgagctcaagagtccgaattggagttgacctggcccgcaagtccgacttgatcccgtactgggccgagggatacggcctgtgggccggcctgctccggccttgggctgcagctagctgggccggcgactccgtggagaccatctccgggcaaggaatttttttcatttttaatttttttcttttaatatttacagaaataatctatcggcgcaaaaaattacaaaaatagaccctgccgccctttactaaggcggcaa

SEQ ID NO: 48432 - DNA, 4171 bp, Oryza sativa
ggttcatgcactaatcggagtacataatacattagtacatgaatggtgattattcggtataatttactgttatatacagcgtagtactccgtactagccagccggatattgagttcttgtttatggttcgttgagacctcagcgagattaggacgaagacgtttagtttatcataagaccatttaggtcatagaggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagtttgggtcatcatgccccctagagggcctcctgcccaccttatatagggtggggggcaggattaccagatagaaaccctaacccataccgtatcggttttctaaatctactctacaatattatcaaaccaggactttaggccgctccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtataacatccgagtaagtaaactcataaaggatttaccaaccgcctgacaaatgaccataatatataatcagcctaagccataatattggtcaataaaaatgcacacttacgtggcaaaaagcaatgatattgtatccaatcaattgcttgataaacccaaacagcaccttgactatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacgcatgtaacatgctcccgggtaacaaatcttctgggtaatatagaccaagtgtagctcatatgaatagcttctgatctgaatgattatcccttatgggatactccaaaataaatataataattgaatcccgactggcgcaagtattcggttgatagcctttacggggaataataattggtccagtctttgagcatagaagatagactcatgactatgaatccatgtggaatgtatccggaacaagtcccaattggagatataatcctcacgcttgagttgatgagcccctgagcatatagcttgtcattttgtcatagtcaaaattgtctattggcaatagctgacgcagtcggcatggagatgaaatgaccaacatgaagacgaaattgctcatcagaagtaacggaagatgtcagtggtagtaaaaaacagtgacaccaatcaaaggtaatgaagttgcataaccatggaggcgaagaaacagtcggtgttgacaaaagcaaaccgacgatgaagacgtagacgcgcatcaacagtgatggcgaaatccactaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgttagtgacaataatccatcaaattaatgttatagctgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgaaaactgtagcctcttgtcgtcgaatagttattgcttgattgaagatatgtgttgaagatttccaagtagaaatcatgaatgttggagagcctcttattgtagtaaaataacatggcatcgcatgccgagatgtcgaggcatgatgacaaagacgtcgtggttggtgaagtagtaaaacttgcgaagtagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtagctgtataaaccagacgtagaggcgagggcactagtcagcagcagacgagacgaaaggcgatgaagatggtaaggccaatcaacactggcagaatcatgcagccatggaagtgaagaaaccagtcggcagccatggcaaacgtaggcagcttgtgttgaagatactgatgcctataagtagtgacagcgatgtagccagccgtgaagaagatagcatcagttggcgttataacaggccagccgtgcaagcgatgacaccagtcagcggcggatgcggcggccggtcggtgaagacgtagacgcccaacaacggcagcataaaggccagccgtgcaagcggaagtaccagtcggcggcggcgaaggcaagccggtcggtgaagacgtagacgcccaacaacggcagcatataggccagccgtgcaggcggggacaccagtcggcggcggacgaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggggacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcgaggacaccggtcggcggcaacggaggcaggccggcggtgaagacgtaggcgcccaacagcggcggcataataggccagccgtgtaggcggaggcaccactcggcggccacggaggcaggccggcggtgaagtcgtagacccccatgaacgggggtgtgaccaacccacccgtataggcggggacaccagtcggcggcgacggaggcaggccggcggtgtagatgacgatgcccatcaacggtggtgtggccaaccgaccgtataggcgaggacaccagtcggcggcgacggaggcaggccggcggt

SEQ ID NO: 48433 - DNA, 4360 bp, Oryza sativa
gcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactattcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcacccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtaggcatccaacaacggcagcataataggccagccgtgtaggcggaggcaccactcggcggcgacggaggcaggccggcgatgaagtcgtagacgcccaacagcggcggcataataggccagccgtgcaggcagggacaccagtcggcggcggacgaggcgggccggcggtgaagtcgtagacgcccaacagcggcggcataataggccagccgtgtaggcggaggcaccactctgcggcgacggaggcaggccggcggtgaagtcgtggacgcccatgaacggcggtgtaacaaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgtagatgacgatgcccatcaacggtggtgtgaccaaccgaccgtataggcggggacaccagtcggcggcgacggaggcagaccggcggcgtagatgacgatgcccatcaacggtggtggccgacggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaacaatgataaaaatcagattgagtttccccctgactgatttggatcaagtcagagaagaggaggttgaagaagtggtcgacggaaaggaagtgaaaactcccaaagcgaaaacgaagtcggcgacccatgaaattgattccatcgcgcttgttgatgggaaactcgacgcaacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagtttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacaagaggattaaaacgtggtgctttttagcgtattttgtgacgtcgctgatgaccattgttaaatcatcgaaacagaaaaaaaaaaagaacaaagagatggggatgatagatataccaccggccgcgccgttcgactcgtgaattgattttccagacgatgctcgatttgcggcgccatttggttgatgtcatgtcatggcctcatgggttggaaaaagtgaaaaactttgtcaccaacactaggtgtgtttaattcacacaaaaattaaaaatttggttgaaatttaaaccatgtgatgaaaaagtttaaagtttgaagaaaaaaattacaactaaacacggccacgtagagtactagagtaccagagtgaggatactcgggaaaactacaatccatagaaaaaactacaatccatcggcattccacagattgctttggtctcatctcagacttatcgcctgcatcttcaactcccttcaatccatagaaaaaaaaacaatatttagttatggatgttcaacttctaactatgtatctaagtatattttttttacgggacgggagtgtaaatctcagtatatcagcttcagcaaaaatataaaatttgaaatttatagagttcattttgaggattttttatttgtcgcagttttattttctattaacttatataaagcgagtaaatgttactgatgcactatttctatcgctaaaacaagtgatacaaatattaaatgttaatgataaactatttctaccggttcattcatattttatttgaaacacagtatatattgatgaagttgccacgtagtccttgacaaaaatacattacaaattgataaagtcagtattgataaatacgagcatccatgttactccggataatatttatcgttttggacaaaggcatagtcttaaaaaaataattttgaccattatttttcattataatgtgtataaaaatattaacaaatatataattttattaaactactttttaagactaatttatacatatagtagccatatttgaaagataaatattttaaaaatgattcataataaaagatttgatctcaccctggtctaaaacgacaagtattatcaatccgaagggagtaaatatagagcttgaacctgacttggttctaccacagcgttacgcttcacggttcacattttttatatacttcctccgtttcacaatgtaagtcattctagcactctccacattgtgaaacggatggattatattagtagttcaatcaatcggattgacgctattttttttaaaaaaaataacttataagattggtgatttatactatgttggtagggtaacagtaagcgagcagggttggtgggtgtgggcgtgtggcaaagcagagaggcggctaagcgcgggtcaaagctgagaacaacgccgacgagagacgagtcgtccgcgagtataaaagcggcgggggaggagagtggaggggtggatggaaagcgggtgtgagtgaggaagatccccctataaatcgcacccggaaaagatcaccatccattgcccaattcgccgtcgtcgtcttcttcttccacctcgggaagtcaaatctcgtcgccactgctggttagtctccctcctcctcctcatccacactgcttagattcctctttggtggttgatcggttccgtagcagagttctgcgcgatcggtttttccattgctgatttcatttgccgtggaagggattgtgttacgctgcggccttaggatctcatcgcagccttcgcaggcaaattcctctgttctgtgcccgtgtttgtggttcatgatctctgtgtttattcggcgtgtgctcctcgatttcctggcgccctgatgcgcttgctgtataggttcgttttaatcatttaagctctcggaacagtttgctttgcaagttgcagttctagtttatttcgggattattgggtggttgggctgttgtgtgttctagacttctagtgagtgcagtggttcagttgttgcatgtgttccagtttacccgtacaaaatgtaggggcaccgagt

SEQ ID NO: 48434 - DNA, 2379 bp, Oryza sativa
  unsure (1)..(2379): unsure at all n locations
atgatggattaagagaacgcattcgtgggtaagaaagatacatattagcaccaacatttaccataaaataatttaagaatttcatgtaaaaataaattgggatgttctgtatgaggaagtagtttctctgtttttaagtctgatgatatactagtgcctaaatagcattctcctgttatcgcagatacctcaaaggagcttcagatgaacatatttcacaatttttgcaattagtaagtcactgatatcatgaatagcttctttgcatttagatttcgtaacacgttgaattttctttgcagattaaatatgttagtggttcctacaatagcggggaaggatttgcatcattaaataacgccatttcagagaatgaaacttcgaagaacaacaaaccaggaagctcacgtagactattttatttggcattgcctccatcagtctacccctcagtatgcaaaatgataagatcatactgcatgaatccatgtgagtacttccccttttttacggattttgaaagctgctgcacttcctttggtgtagtgaagttatccacaacagagtttcaaaatataggaaatatatttggttgtatccactcttgtttgtactattttccttttgtcctctttatttaactaagtatttgccttgtggaactttgctactatttcaactttctaagcataccaattcctagcagtcgccgactcttttcctgacattgctttttcattgggacttttgaaacataaagttttggttttctggaagcaatttgggtgcaatgaatttgctcttagttattaattgagtcatgtgttggttcatagtaaattaaaaatcaaattaattatttttaagtttgatttttagaagttgtgctatactatgttgtagtttcatttcttttatgctagtcaccttctgtaactgtcatattgtgctttcagcttctcattctggctggacaagggttattgttgaaaagccctttggaaggacttggagtctgcagaggaactcagtgcccagcttggagagctgtttaatgaacaacagctgtacagaattgaccactatttaggaaaagaattggtccaaaatctggtaagttgtatggcttcgtctagttagttgaacgatatattccatgctactataacatatttcaatatatttcagcctgtgcttcgctttgcaaaccgtttgttcctacctctttggaatcgtgataacattgctaatgtacaggtaatatgctnttctatgtagtcctttgtatttttatttgtcaactgtagttacatctatgacatcctctgttattggtataaagttgaatggattagttttggaaattctggaaagttttatcattatcatggtgcgaacaacatgtgcttgaacataataaatatatgctgcagattgtattcagagaggacttgggactgaaggacgtggagggtactttgatcaatatgggtatgttgggagtaactttattttgcatgaaagttccttttactgaaagtattttgttgtaagcacatatgcttgtgactgtggatatactataaaagtgtaaaatcactttgatatattgtaaatggtttatggttcccatagttcacatgaagtcattcgatcgtgtacagttgtccattagaaatatacaaattgcattttattattttcttctaggcattaaacttctttagtttttatgataatacagtatttgctagatttaaaataaatcaactgcttatggtgtttatgttatgagacaaataatcacctagaggacctcccgtgcatcgttattcgtcttcgctgatgtaaatatttgacctcgcttttgttgctgcagcatcattcgtgatatcattcagaaccatttgttgcaggtaaatatatttatttttggtatgcagcatagttttccatgcacttgccttttctaggggagttttatgtgcactttcacttcccaatgtgaatctacattagcatttgcttactgtggtctgtggggactgctgaacattttacttgaccattcagaatgattggtgctttattccatcaccattcttatgttataccacgaggaggcagagcagcaacctgtcatgcattataattcctcaaaagagaatattgctgtttccactttcacgacttgaggccccctttctgtattgatttcgctcttgtctgcaggtcttctgtttggtggctatggaaaagcctgtctctcttaagcctgagcacataagagatgaaaaagtcaaggtttttgcttctccttatacaattctactctaactgaaagtaggaaacctgtatggatctttttttttttttttg

SEQ ID NO: 48435 - DNA, 945 bp, Oryza sativa
cagtgtctccgccgcgttccccgcctctccccatcaacttcgaagtcattagtcgccgcttcgagctcaaccaaagaaaatgatctgtatgctggaatgcccagagcttccaatttcactgtctgagatatgtaacctgtttggttgttccaggtaaatgcaacaagaagttagtatttcagataaagttccagaaaaaaaaatggcgctatcaagttagttactctaacactaggcaaagttccagagaaaatgacgccaaagtaaacgaatctaaaaaagagcaaaagagatacagaagtttcagtcaaagaatctgaaattcagcaaaagtttcagagattgtgccaagttggtgactctgaaattcagcaaaagtttcaatgaatgactgaaatttagcaaatgatccagctaatgactgaaattcaacaaattttcagttaataaatctgaaattctaggaccaagttacgctgacagggacaagtgaagcaccgagtggaagatcagcacaagaagataactctgaacagacaggactttttgcaagcttgcaaagtgcagatgccaatcctcatgacatctattcttctttggttagagaaggcctgtttgatactggtgatgagattctgtctatggatacaggggaatctgctgatactcctatttcaggcctagcgtcaggtttagcaaatcttggcactgctgatccagctgaaaggggctactcaataaacgagactacaaatgaggagggatacttgattgaaggggatgatccatcaccatcaaacaaagacgaacaagatgaccaaactgatgcacatggtgagtctacgccagaggcccagagccacaagatggctgctccatctcccccagctgccgcccatcttcgccaccgagcgccgccgccgcgcttctccccgtcctccccgt

SEQ ID NO: 48436 - DNA, 1573 bp, Oryza sativa
aattgctgatggaggtgtcatgcagtgcactagggaaattgctgactgtcgttggtggatgcagggacagagtttctgcagtaatttccgactgctacccctgggaaattatgatgccatattgggtatggactggctcacaatgcacagcccaatgaaggtagactgggttcaaaaatggatggaattccaatacctgggaagggatgttcgaattcaaggaattactaatcagccagcacagtgttctcatataacacacaaccagttatctggcatgaacaggaagggttcactgttgtattttatccagttacaaaatatggccatacaggagaatagcactatttctgattcagtcaaacctatgttgttagagtttgctgacctctttgaggaaccaactgaattacctccgagaagagcttgtgatcacagcattaacctcattccaggggctaaacccattaatctgagaccttataggcacaatcctgctctcaaggatgaaatagagaggcagatagctgagatgctcaagtctggggtgattcaacccagccaaagtcctttttcttccccagctatacttgtcaagaaaaaagaccacacttggagattggtaatagattacagaaagttgaatgccattacagtcaaaacaaaatatctagttccagtgatggaggaactactggatgaactatctggttcaaaatggtttaccaagctggacttaagatcaggttatcaccaaattagaatggctgagggagaggaacacaaaacagcctttcaaactcattctgggcactatgaatataaggtgatgtcttttggcttgactggggcacctgcaacatttttgggggctatgaatgacactctaaaatatgtacttagaaaattcgtcctggttttctttgacgatatcctgatctatagtccagattttgagtcacatttgactcatgtcagacaagtcttacaactacttcagcaatatcagtggaaggttaaattaagcaaatgttcttttgcttagtcacagttatcttatttgggccacatcatcggtgcaaatggggttgcaactgatccacaaaaggttcaggatatactcaattgggagattcctaccaatgttaagaagttgagaggatttctgggattggctggttattacagaaaatttgtacaaggctttggtctgaaaagtaaacctctgaccaatcttttgaggaagggtgttccttttgtttggagtacagaagcagattcagccttccaggctcttaagacatctctggcctcagctcctgtcttggctttaccaaattttcaaaaaacctttgtggtggaaactgatgctagtgactatggaatcggtgcagtactatcacaggagaagcacccaattgcctatataagcaaagccctgggtcccaggaccagaggtctgtccacttatgaaaaggagtgcctagcaatgatcatggcagttgatcactggaggtcttacctgcaacatgttgagtttataatactcactgatcaccacagtctcatgcac

SEQ ID NO: 48437 - DNA, 1078 bp, Oryza sativa
aagcggttttatcctacgtgacgtacacgtggcaatccagtcagcatttcctttttttttaaaaaaatggtggggcccacctgtcatctcacctcctccttctcctcttcccctctctctctctctctctccccccttctctcggcgagcacggcagctcgcggctctacgccggcctcagctacgcctgctacgcgtcatcggccacctccccgtccaccaacggccacgttcgtcttctcccgcgcggcgccgccgccgacgacctgtacgccacgggctgcttcacctactgcgccgagctcacgccgacggcgcgccgtgcaccgggacgggttgttgccaggtccccatctcgccggacatcccctacctcggcgcggtgttccacaccggcaactggacgaacaccgcgggcggttcacactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacacatgacatgtcatctgtgacgggtgtagtattatgaaccatcacaaaagagaccactcatctctgacgggtcttttaactaacacacgtcacagataacgttatctctgacgggtggtagttatgacccgtcagtgatgagtgaaaattcaaatttttaaattttgcaaaaaaacctcggattgaaacatgtcctatataaaagttgtagctcttaatgatatccacaactttataactaacaacatttctattagagatcatttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaa

SEQ ID NO: 48438 - DNA, 15126 bp, Oryza sativa
  unsure (1)..(15126): unsure at all n locations
atcgaattcctgcagccctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagatcgaggtacgaggtgtgtggagggactacgtgatttgcttggtggtggagtttgtggcttgcggggtggccattttatagggggtggatgcatatatgcatggttgaattgaaccgttccaactttgaaaaactagatggcaatttttgcagtgtactttctagccaggaaagtttggcgcacagtacaacgaagacttgaaaccatgcattgacttgtctatttcaattgtgcttgcagaaaccatgcattaattattcgaagtggactctaatttcctttagtctttatatactttgtactacctctctctctgtctttggttctaaaacacggccgggtggttgtttcagacttgtgcgcaatagtaataactagctcccggctagcacctaaataaaatcatatatttttagtatgattttacttaaaatttattaaatagctatctcattgtcttaagagtttgaaagaccaaaccttatcatccccgtgtttttaattatatagttttttaaaagtcacaccagttgctaccccttatgtcatctccttctttatttgcttgctcgatctaccactatttttattcattctccttagaaactttaaaaattggatcttatagtttttagagttttttttgtcacgttgggtttcgtttttataatttctaggcgtcccgtcaaacattgccattatactcctctatagtccgtccactatctcttctctttattgtcattgagattttaaaaatcgaacataattatcgtttgggttcatttttactttctagaagtcccgccaaaccgtcagcggctttgccattgtacttctctacgcctcgcccgctgcctcccttctttattgtcattgagattttaaaatcgaacatgattatcattattttcttttactttttagaaattccgaacctttaaaaattgaaccttgtagtttttagagttgattgtcttgttgggttttattttttataatttttagaagtcttgtcaaacgatgccactatgcttctctacggcccgtacgccgcctactttttattgtcattgtggttctaaaaatcgaacataactatcgttggaattcatttttttatttcctagaagtcccgtcaaccgtcggcggctctgcaactatactcctatacaccccgcccgctgcttttcctttttattgtcattgagattttaaaaatcgaatataattatcattggatttttttttactttttagaagtcccggcaatcgtcttgttcatttgcttcacggccttcctatcgtctctccttttaatcgttattaggattctattttgtgttttattaacagtttttatatgtcgtatcaaccgccaccactctactccattataggcatgttacttaatttatctcgtcatatgttttaaatggtcttttcgttcaatagtctttatttttatcataaattttagttatttataaattgtattccaaattgaaatcttatttttcgttttgtaatttcagaatttttttttcaattttaattaatatcgtattgtgttcttttaatatttttattttttattttcaagagaaaagcccatgcgctacaacgggtgacaactattttagtcttattattgttatatggcttagttatgatgattcatcactgtgagaatttgcttggatctatatatttctagaaaatcataagctgtggttaggagtctgttcgtctaaagttagcatgcgaattttcttatacgactcctatatttccaaaagcggacgaacttaaaaccaactcaaaggatatatattttttcaaaagcgaacaaatttataaaccgactcatacacggatgacgtaccggcaaaaatatcttaaattttttataatagtagagattttttttaaaaaaatagtagaagtagaagagaagattacggacaaaaagtcctttttttgagggaatcgtacttttttaaggaattggacgtttttatttttttttatacggtagaagttttttttctctttttttattttttcttgcctttttttctccgcagatagtcggactttttttatggagtcggacgttttttttacgtagaagtttttttttctcttatttttttctgttttttttccaccggaggagtcagtcgtttttttttttgggtagaagttgttttttctcctttctttgttttttcttgatttttttcccgtcgtctctcttttttttttccaccggaggagtcggagtcggacgttttttttacaatagaagttttattttctatttttttaattttttctcacttttttttcaccggatgacggatatgtcttttcaaaaacaaaagaacttaaaaaccaacttatacacggatgacgtaacaaaataccggtaaaaacatattcaatttatataatagtacagatttcagttgtttcaaaattgtattcctacttgaactctcttttaatttttctaattttggatattattttattttttattctgaattttaattaatcacgtattgggttgttatatggattcttctttcaatatttcttatttttaattctgaatttcagctattttaaaattgtattcctactaggactatccttttcttttctaattttagattttagtttatttttatttcaaattttgattaatctcgtattgggttcttatatggaaacttttttcactattgcttatttttaattccgaatttcagctatttttaaattatatttctacttagattctcctttccttttctaattttggattttattttatttttattttgaattttaattaatctcgtattgggttcttatatggaaacttctttcaatattgcttatttttaattccgaatttcagctattttaagattgtacttctacttggactctccttttctttctttttttttactttttctccgattaatgtaggacgtggtgcctcctttcaaagctgttttaataatttaatagattaagaaagtgagttgtaatttgagtcctattttatcgttaaagttttgctttgaattatatttaaactatttgttttttatttggatcgaataataatattactccgtgtttagttacaaaataattcttcaaacttccaacttttccatcacatcaaaactttcccacacacacaaacttccaacttttccatcacattgttccaatttcaaccaaacttccaattttagtgtgaactaaacacatccttattattgtagtttggatcatcataaataaacttttctatgtatatatatcaacaacctcaaacaaatcggctccagcacaccgccgaactcctccatctatgtgcagtctatatatttgctagagtggaggctagacatagttagaaaaaatatttgggtgatccatatttaaaaaatagcaaaaattacctagtacaaagtagaaaaaagaaaagttgatttaagggtgtgtaaagtaacattttgacaataaaagatggctcaaattacaatttactcttaagtaaacctccttactcatatttggtgtttcagacatattaacacaatcatttaaatgtaactttgacatataattaatattatcaaaaatatctaacaaagttatgcttttatgatttatgttacttcaattttggcaaaattttacacttttgaagtttacttatccaatgtaaataataagtgtcttatgttattacactatataatcagaagctcatcttcaaggaagtaaaaccataccatctaaatgtttacaaagatcatcaagattatttgcatacgaaattctgatgatcaccacgtaaaagggcttccatggattaaaaaaaaaaggcagaaatgatgtagaaatgaccgtttgagggaagcacataaggaacacatgaataagaagatatatcgataaatgattttttacgagactagatctcatgttaaaattcatccgaaattccttctctctccgttttatattataagtcgtttgattttttttagagtaaagcttcttttaagtttaaataaatttatagaaaaatataataatattttcaatataaaacaaacatattattaaaatatattcaatagtatatttaatgaactagtttggtgttataaatattgctaattttttcctataaacttgatcaaacctaaaaactttgactaaaaaagttaaacgacttacggagtataatattaaagagagggagtatgtcctaagccaattcaaaggaactttgtagaattttggatagcgatgactttcgccccttttcccttttctcatcgaagtccgtattgtgttagtttcatcgtcttatctttgcaagcaatcgattggattggaagttattttcgaacgtcctaagctcctagctgtgcactatccctctatatgatctcttattaacttgtctactcagttaagtaatccatgtatgagcaacaaggacagttctaattaagaacagaagccatattcgtcattttctccgaaggagaaaacacggcctcaatacattgttgcctacactgctaagtaatccctccatgagaacaacctgttgactgaagttccatcgctggcttaccggttactactacgcaatgtcaattttcacacaagacaaaacgggtgaaaatcctctgcaagagatgaacagaacaggtccagccttttgtgtggccacaacttgtaccatcacgaactgcatgcgagaattcacgtgtaagtagaccattaggtccagttctgcagagatgtcgacttctaatttgtggatagaaactttcctccaccagttaatcgcaacccgctaatcagggatgactttgacatgatccattgatcagtgatttcattagctttcagctatagaatcaatgtatcattggctcatgtcagttgataattaagtagcaacgcggctgcatctgctttggacgcggtgaagttttttatggaatacgtaattacgtatgtacgaggcaaatgcttggtctgaacttaagaaatgttaggcgggacacgtaggtcacgtcccagtcaacttgttcaggccatggagcaaaccatacgtcgaagaagttgtagtgatccagacatagtcacatgatggagattggagagtctacttaagtagaaactgactggccagtctccaactggtgatactctgctcttagttttatttttttccgaaacaacccgcacaaggtaatgcgttgatatatcaggaaaaaagaataagtctgtagttctagaagactagaaaaaaaaagaaaaaaatagccacaccacgcatcaacgtctaatcctgctactgaaaacaaaacaagcacacgacacgccagaggaatagttcttctgaacaacgtctaaaaataagggaacaacgctaagagcgccgccgccgcccgtcctaaagaaccaggacatggttaatacttaaagaaaccattagaataggagaaatgtaacaacgtcccgagaggaatgcggtgacgcaggcgtcgccgttatcggcccgaaggctaggctttcgcctgtagtttcctactttctcatgtcaatgtgtgcatgtcaagttcaacagacactactagctaatcctcttcaacacgcagccaccgtgtcgacgcctcaccaccggccggccatcgaagaagcatctcgacctctggcgtgctccagattcatccacatgggtgggctggagaggaagagggtcagagagaagatgaatcccctctccccgcactagtccatccagtgtggccatcttgcgatggcaaatcgccgccgcaagaggaccaacacctagagaggagcttgtcgcagtcctcaacgcccctcttatgatgctaccgttgttgccgccatctcgaccaggctgcccgtgtctcctacgggccgcctggtcgcatcaccttcgcctccgtcctcccactgtgacagtctcgtcaccgcaccacctcaccttgccgtgctccaccatagcaggctcgccaccacgccggccatgttccactaatcgtgctccttcatgccagggccatcatcatggtcttccctctggagccccacaacaggtgtcgcactctccacgcgcttcgccggccacacgtcgtcgtgtcggccggcgccgtgcgcttcctcctgtcacagcgccactgtcgaactggatctgggagctctagatccggcaccaccgccactgccgccaccaccttctctccagctgccaacctccaccgccgtctgcgcccctgcattgggaatgccaaatccacttccgagagcgtcggatccattgcgcccttgccgatcgactctagccgctgtggacctgcaacgccatgcgccgctccgtcctctcgtgccaagggcgagcttcgctgggtcacgactcacgatgtcctcaccaccgccttcccagttggccgctcgcctttgcagcagcgagctccggcgacggcgaggcgttgagggtggatggaaggtggcgacgcaggcggctagggtttcgcccccgagaaatctgtgcaagagcgacgcggggagcggttagtcttagttttattattagcctgaaactctgaatgagctctaagtggtccaatgaacactgatcatacgtcagaattcatttttactgcatggtagatatgcatgcaaataagtgctttgatcattattcagagtagtgagtgcactgggttaaggcccagttgtctctgttcattcaatcatcattcatcagcctgtgtttttcgacaggcctgagttttagtacttatagcctcctgtaaactcgtttctgtattataaatacctatttgccttctcaatccgacggtagcaatcctgcctttcgttgagaaaggagaaaaaacacagttgcagctgtttctaaccctctcaaccaaaccatttcttagaagaaaaattaaggactgaatttcatctgaatatggaaaactgtccacacatctagaactcagcttaaaacaataatgttctgctacccattttctactgaagggaactcgcagattttttttccctctttggatgaaataatccttgtactagtaaaccacacattcagaatttccatctttcccggacaaggcaacacacggcacacatggcacatcttgaaccaagttaaattcgtcgacaccagcggcgtgatctacggtgcgtagaccaacgcaactgtgcgtggccacttgcaacccgtagaggacaagggcaagttggatggccagccaagatagactagagtgcacatcaaaatctcgattaatccccacgaagttgcagtaattcggtggctacaaagttggacacgaagcacgagcctaaagggctcaaatggccaaatggtacgatgaaactggaaagtgcaggagaagattcaaacacaatgaaatcgggtacttcatccctttcttcttctttttttcttccctatttgtatttcgtttctgtgtaagcatccagaaaaggaaacaccatgccattaacaatctaagagataaaaataattccatgactgcatacgcagtgtttcccattgtgttcatctaaaaacactcacctcatatattatctggtctggataaaagtgaacaaggttaagagggtgagaagccaaagggtttgtctgtgacagctgataagagcagcaagcaacaggcgattactgctttcttaaccaacaaaaaggattccaaacctgtaagataggacacatctgtcaagcaatatctatctatctatctatctattatattattaaaacaactttgaaatgacgcaccatgttcgttgtgggggttagaaattcccacattaatcggagaaaaagaaaaagaaaagaaaaaggagagtccaagtagaagtacaatttaaaaatagctgaaattcaaaattaaaaataagcaatattgaaagaagtttctatataagaacccaatacgagattaatcaaaattcgaaataaaaatataaaaatccaaaatcagaaaaggaaaggagagtccaagtaaaaaaaacaatttaaaaatagctgaaattcggaattaaaaataaggaatattaaaataagtttccatataagaacccaatacgagattaatcaaaaatcgaaataaaaataaaataaaatccaaaattaaaaaagaaaatgagagtccaagtaggaatacaatttaaaaatatctgaaattcggaattaaaaataagaaatattaaaataagagtctatataataactcaatacaagattaattaaaattcggaataaaaataattcccacattaattggagaaaaataaaaaaagaaaaaggagagtccaagtagaagtataatttaaaaataactgaaattcgaaattaaaaataagcaatattgaaagaagaatccaatacgagattaattaaaaattagaataaaaataaaataatatctaaaactagaaaaaataaaagagagttcaaataggaatacaattttgaaacaactgaaattgaaaataaaaaataaaaacattaaaataacacaatacgatattaactaaaattttttaaaaaaattctgaaattagaaaatgaaaaataagatatcaattaggaatacaatttataaataactaaaatttgtgataaaaataaagattattgaaagaaaagaccatctaaaacacatgacaaaataaattaagtaacatgcctataaagaagtagagtggtggcggttgatatgagatataaaaattgttaataaaacaccaaatagaatcctaatgacgattaaaaggagagacgtcaggcaggccgtgaagcaaatgagtaagacgattccgggacttctagaaagtaaaaaaaaatcaattgataatcatattcaatttttaaaatttcaatgataataaaaaggagaagcagcaggcggggcgtataagagtatagttgcagagccgccgacggttgacaggacttctagaaaataaaaaatgaattccaacgacagttatgtttgatttttagaatcacaacaataaagagttggcggcggacgggctgtagaggggcattgtagcatcgtttgatgggacttctaaaaattataaaaaataaaactacaagtccaatttttaaaggttttgaacttctaaaaagtaaaaaaaaaaccaatgataatcatgttcgattttaaaatctcaatgccaataaagaagggaggcagcgggcgagccgtagaggagtacaatagcaaagccattgatggtttagcgggacttctagaaagtaaaaaatgaacccaaacaataattatgttcgatttttaaaatctcaatgacaacaatgagaagagacagtggacgggccgtagagtagtataatgtcaacgtttgatgggacatctagaaatgaaacccaatatgacaataaactctaaaaactataaaatccaatttttaaaggttccaagaagaatgaatgaaaatagtggtagatcaagcaagcaaatagagaaggagatgacataagaggtagcaactggtgtgacttttaaaaactatataattagaaacacgaggatgataaggtttggtctttcaaagtcttaagacaatgaaatagctagatagctatttaataaattttaagtaaaatcatacttaaaaaatatatgattttgtttgggtgctagccgcgcaattgcgaattgagcgggccacccagctagttctgattaaaacagcacgcagaactggtaacaaatcagagacacggtaaagattaacaaagaaaaacagcagacgaattggccccatatcatggtgccatacctagagtgagctaaccagctaaaacgtacggccaaaagaaaagagagagagaacattgcaatctgcaaggcaacaaaacaaaatcatatgcagagcatgagcgcgtgacaccattctgagaaacgctgagacggctgaactattaatgtcacaactgagcactacatacagaggagctgtgatgacgagctggaatctcatcaatggcacctctggctcacacttgcatcacgatgcagagtcacggcggtttcagggatgggccagctcctacaagaggaaacctggatttggcccatgatgattctacaaaatcagctagtagtgactggtcagtgtacagacaaacgactttcaatcgccttgtacatccagtgtgcaaactgttccggagcagcaaacatcagtggtaggcccatcactgatgaagtatcacaagaaacaaaacgcatacagttgaacttgtcccttgagaccgcaaaggacaaaaatttagatatcacatacaggaagttgcgcgatgaaaagacatgtaacttatggcgctgcaaaatttatctgtctagacatgctgtaaggacaatagctcattcagtttatatggacaggttctaaggcctgcatcaagcaaagacattgtatgcaggttttgtcgaggcagtacatggctgaacttgagaattcagataaatgtgataaatagcatagatctatgcattgtttttaaagaaaatagaggtacatttgtaaacaggcattattatagagagagagagagagatcaacattctaaagattaattaatccaatgaaaagaggcaaaggaaattgcatccatcaggacgaatgtgggatgataagcaaaggagagcacattgcatgtgacgcaacaatctaatgaagcatgcatatattcacaaagaccaggactgccaacctgattccattggaaggcattacaattaagtggtaatatcaagccgaggttcaaagcaaaagccagtgaaaagctggagaggaaatcttttgctcacagggcattttgcggaccacttccactgcttctgcttcgtatcgaaagcaagcaaagcagttgcaccatagctttggatgtagacaaggtcgtctgtgccactgctagcaaatacatcatcaaactcaccaaatccttgaaataatttatgaggcattcgacctacctcttgccattgttttttgtgaagttcccatattccaattcctttgatgatgtcaggtctgttctgttttgcaatcccaccaaccagaaccagcttctccctcaagttaagcagacgtccacaggtgagagagcaaggtgctgggatcgacgattgcattagtgacgccttagaaggcccagcaataaggtcatacatgataatgctatgacgcggttcaatattaccaagaatgcctgtggagtgaattaaacagtacaatactccatcacatatcacgctgtcatcaccccctctccaaccaatgaacacctcctcaaccgcagtcacccatgaactactctgtgagtcatacttgtataaagagaaatcccatcggacgtaatcctctggaacttgcttgcattttgccaatgtaatggtgtaattatgagaggaacgatctacctttatggcaattgtgctgtagtctggaaactttgcaccagggggctccaaaattctcttacaatcttttgtgataggattagatacagaaatggcattcctgctgtcattgtccatgaaacaaactaatccgcaagaagaagagacaaagcaactgctcttatctatgcatggaagctctaaatcataccatttgcggagaatcgggtcatatgcatacccagcagcactttcattagaagtgaacataaagtaccatggcctctgaggcaacatgtgggtccaaagaaacctgcttgagtagataatgtcatgccatcttttgcaaactgctgttgaccttatcatgcttactataggtaaaaacgtgaaaattctctccaggatatcatcaggaacaacagtgtccaatgaaagcaaaaattctttgccttcatcgttatcctcggagacaattccgaaattgaatgcagaaattctaatgtgatcaatagaaagagctgtccatgaagaattatcttccatgacatcagtcatcaagtgtgctagcatagatgacctgaataaaaaaaagttatatttataggacagttgcaaagatcatttacctataaataaataaatggaaaataaaacgaacatgggatcataagctaattacatcagtatattatttcaagaaaagctcggttaatgtttaaccacaggaacaggaagttaccattgcctattgcagacatactaacacatgatatgtaagtacatgatatcctaaaccattttatttcgaaagcgctcaagctatgtcagttactattgcagcagaactcaattaccataatgttagttcatcaatcttctgtgctatctgtaaatggtttgcatgccgtggcacagttggagcacattatgttcctcctagtctcctacccaaatgttataaggaacagatcatataaaatatttccacgggccaccgtttcttcaaaaaaaatttccagttcagcggtattttccgtgcggtttaatccgtacaaaaaatcgttttcatatcaatccaccgaataaactctgaaataagatcatgctgaaccgaacagaacaagccgcagctactccagttagtgatggtacaccgaaatattgctggtttgcttttccaagcagaggctcgcagaatgtgcagcgacgaagcaatacattatcaacaaataccaaacgcaccgccgtcacccacagttacagcgcattagaacagcacgagcaaggccatatcttatcgaatcccacatttctcacaaagaaataaagtaaccgagttttttttttcttcttcttctaattttctcaaatggaaaaggaatagagtaggggagaatattaagtgctcgtacttgcacaagcctccgccggcgacgtctccggcccctcatcctagagggcagaggcgctccgtgcccgtcgccgcgccgtccatcggaagcgagctccgagcagaacctccgacggcgccgacagacgatgctaacgcggcgcaggaagatgccggaggagggcacgaggatgctgcgagggggcggcgcgaagggagaaggctcgtcggcgggcggcgccgtcggtatttggttgcgtaaccggggcggcggagggaggcgaggcgaggctacaggccgggcttcgagaagcagaggccgttcggatttatttatagtgcaaaaggaaaggtggtgagatggcgattggtacacaatgtgtgatgttgacatccacggttaagattaacaaaccgagagaaaacggcgggggcaggattaattagccctatctataccaatctttttcacttggctatatgtatgaatcattgaatcgttctctctctaaaaatagtcttactagtgttactcagtatatatagtcggtcgttactagcgattggaaatttggaattggagataaggttggaatgtggttattagaaacaattgtccttgtagagaaacgtttagagtttttcgcctagctccacagggtggtaggctagctggcctaaattcgaaatctcaccccttttaattatttgatattaggttctttcctaatattcgtgttttttttaacattgtccttttgaaatgtttgtcacttgatttgggttttactcgtattagctttgaattttgactatataagcaaaatggctggaatggctcatttcctaaggctgcattcgttattttagattggaagagattttcagccacacgcaaaataagaaaaacttattgtcaaatgattaattaaatagtattaactattacaaacatgaaagattagatttaattaatgtttaaaaacttttatataaacttgttcaagaaaaatacgtatcatttaaccttttaaaagtgtgtttacgaaaaaaatgagaaagttgtaattgaaatttgaataaaataacaagccataagtctagtttatttttttttcaaaaaaatcctcttttctcatatactcactctgtcttctaatataagagattttaacattttacttgcaaaaaattggaattatttttttgacttactttattatccaaattattttaagcaaaacttttcgtttttttaatatctgtacaaatattttaaataaaacgaataatcaaatagtgcaagcaaaatgtcagaatctcttatattatggaatgggtggagggagtatgtggtcagaaccgattagataactcgttccgtcccctctagctcatccccgcaatgcatcgcactcctcgtcgataccgtactccctcgtacccggcaacaccaacggacaatgtacccgagcgtacacgactcggtccccctcccccggcccggccgtgcccccgcgcaccgatcgatgcgccgagtcgaacacgtcgcgactcacgagcgagcgactccccccgccgcagcccgcaactgcacaccgcaaccacacctcccgcgcgcgcgacccggcgacccgagccgcgcgtcgatctgcatctgcatgtgctgccgctgcg

SEQ ID NO: 48439 - DNA, 32555 bp, Oryza sativa
gtcacatatgcatgcgcccgcgcgcctcggtttagcagttccatgctattttggccggcccccttttttccggtcgaggcacgtactgtactgtactacgcgctcgctctctctctctctctttcccgtccttcctcacatggtcgacccgtcgccctctcactgtgctggtcctgcacgccgttttcgctgctccccggcgaaattttgttttgcgcgtcgtgtacactccatatgcgtgtacggtgtaatggcacgtgaaaaatttctctggagcaccggatatatatatatatccagatgcactggtcgacgggctcgattattattacacagggaataataaaaaaaaacgaggatggatgcatgcatatgaatgcatcgcacgtcgtggcacacgggttttttttgtatcggtccgtgggggctcactcactcacacgctcgatttcttttgcctttgcttgttgtttcttcttcctcctcctcctcactttgagtgtcaaaaaaaaaatactagtacatgagtgagcttaaagtcgaagcaatcacaagggaggcgtgcatcagtacatgcatgctagcaaccgagatacaggcttaccgacacttggtcctccaggatgcaaacaacaaagttcatagctcgatagattgacttttctctctctctctttctttcctttttgcttttagatacgttgaatggagatcgagcatatgctcctgaaaatgactaaacagctcagtccaacggaacaaataaccacataacctcgcactgaggacagtttgcgcatctactacattcaagttacacagatatactactgtatgtcaacttgccaaggcattgattctgaaaataaatgtaaaggaaagttcaacgcgacgagcccgacgcatgcagatgctccacggtgtgtgtgtgtgtcactctctgaacgccaacacagtaactagctggacgcctggagagctaaaaacagtgacctctcagctgcctgcctcacttatctctgtttcagactaacaatggaaccttgcttgtcctgaagacatgaggcccagctttaggtgcacactacactgtggttgtgtttagttttatgtgtgtaaaatttttaaatatatgaatacacatttaaagtattaaacatagactaataataaaacaaattacagatttcgcctgctgcaagacgaatttattaaacccaattaatctgtcattagcaaatatttactgtagcatcatattgttaaatcatgacgtaattagacttaaaagattcgtctcgtaatttacatgcaaactgtgtaattgatgtttttgttaaaaaaattttatctaaacaaggcttataaagctagtacggacgggcagcgaggtgtcagggcacaggcaatcatcgcagaaaattaaagattatgtgtaaacaggcaagcacggtgtttccaagttgagcacttgagcatccggtacgcggaagggagaaagccaataccgggtggattttctcatgaacgtcgcgacctatttattcggcgcgtcaaaagatcaatgttgatatcgatcaatcggccaaggccaaaggagacgaccacgtagccacgtaggagtaaaaagcaacgaggcggcgtcgcggcgatactttcgtctgctcaactgtcggaaagggtgcaaggcaaatactccctctattccaaatttataatgtcgttgattttttacataacatttaatcactcatcttcaaagtgtgaaaacaagctaaatgttaaaacctcgtaaaaatcgtatctgaaagtttcataaataaacgaagttgagtttggagctgggatttggtgagaatgtatttcatatctacacccatctctagtatttttttcatgaatttactaaacttttaagtatgattttcatgagtttccaacacttagctcatttcatcggatatgtccctatttattttattgtgaattattttatcatcaaataaaatacaaacttaacttattctttaaacatatttatattaattttttaataagacgaatgatcaaatattatacgaaaagtaaaccatatcatatattttgaaatgaatattttgaaatgaagatggtatgaacaaatgagtacggaatgtctgaatcactgacccctagtagaacagttgtggtcgggtagctttggctaggtgtatattaaggctgcgttcgcttgggtgtgatatagggtgagaaagcacctcgttttccacgcgcacgcttcccaaactattaaacggtgtattttttataaaaattttctatagaaaagttgctttaaaaaatcatattaattcatttttgaaatttaaaatagttaatactcaattaatcatgcgctaatggctcacctcgttttgcgtatcttcccaatctccccaatctctttcttctcaaacacaccctaaatcagcccggttgctcatctattctcttcgtcccataaaaaataaacatatgaccggatgtgatatattttagtacgataaatatgtacatatgtatatctactatgatgaatctggacatatgtatgtctagattcgtagtattagaatatgtcacatctagtactagattgattttttatgggacggagagattaccttgtactgtgactgtttttagctagcaatgataccctttgtgattgtatataagcagaatgtagggacacccacaccctatgaagctaccagtctactttacaaactttggagtttttccctccgtgtcccacgatatagaaatgtaagcatcagatgagatatttcatagcacaatgaatcaggacattccttgttcagatttattgtactatgaaatgtcatatctggttctagatttttatattatggaatgaagaaaataataaaatgatcactgtccaattcattgtaatataaaatatcatatctggttctagatttttatattatagaacggagggagtaataaaatgaacgtgcatcctctatacggtattgccgatacatttgactgtccgaaactttagcacctgtgagcatatgaacttctaaggaagaaacacaatcaaccgtcacataatctctctctctctctctctctctatatatatatatatatatatatatatatatatatatatatatatatatatatatatatataaactcgagtacgttgcaaggcatcaggaactttaagtacatctttcttgatatgcacaaggcatgaaaccaccacgacgaatttaccttgaaacatgggaggtggtggagagcaaaagactccgggggcagtgtgagtgagtggcgaggccactagaggcggctgcctccttgtgcttcttccccttggacatctaccaccgcacctagcaatgccacatacctaccaggaaaagcagcgcatatgcattgctttgcttgccacatttgcgctattctttccacttgtggcatcacacagaattcgcatcacttgtccttgaaacattttcaactcaacgaagctcctctcttctatgagatgcccgcaaagcaacagtggttatcttttgctatgctccatggaatctagtacatatataccgtatatgcaaacgcatcaaaagaaaaggaacctagaaaggacaagtagacctctaacatggcgtgtttagcaaatgggcagcatctaaaacaataggatccaaccaatatgccccgagtgtgcaatggaatattggaacaatttgtgaggttcttggagctcgcgccgtcgaagaaatcttctccaacattgcacttgaaaagctgcaaagacagagaaaaaaaaaagaagtgggctggttcttccggtaaaggagagggaacgaatgggatccaaatcaaccagttggggcgtagaaaaaaaagaagaaagaattcaggcaatcaaaggatcgaccaggaaaaagacggcatgttacgtcggtggcgcaacttgaatcaggattgtgtggatcgcaattggaagaagggggagatggaaaagtcctggaaaaaacaaaggagatggtacatggttgtatgtggccattgatgtgaggtcacaatcgtcaagtacttctttatggcctctttttggagaattatgcagtgtccaataagcgcaataagcaaaggaacagcgagttccacgtaaatctgacggccgcaagtggccctttccagttctgaactgtcaaacagtttaccctagtcgataagtcattgtaaagcaatatgagtgaacaggaaaacaattatacgagggaacaggctaaatcggaacataggatcctaccatagaaagcaggcagattttggagagcagaaatcgcacatatgacccaactgatggaaactataataacgactttagaatggaggatggcgatggtgatggtgaagaaaccaccatttaggtgtacagtgaaaatggcatctttgatagttttggtggcagcacgtcatacaggatcataagtactgtagcacagctcttgacaaaaaaatatatactcaatagtcgaggtacagaaaaaaaaattaaaaaatgtgccaaaacccaaaaaaagccgacaaactatcctgacaaaactattaaaacatgtgatcttcaaatgacctaacatcatgagtttattgcttgctatccccttgctggatacttgaatcatcaaagtcaagaaggcagatggtttttcagaatctgaatattgttttgtcattttcaagtgacacggcacataatgctttacatcagaaccaagaggattgtttatatagaaagcatccactaatcacatagaaatagtccacaaattattgtcaaagatatcaaaactacattgaaatgctcaaaagtttgacgctatagttcattgaattaccgtttgctaaaaaatatataaaataccaagatggaaagggctgtcaaaacggttaaaaaatcactgtacatgtatagtccacccaatgcttagatcgtaaggtcacaatatgagctttggatatcctccagacaattttataatacagcactttatctctcagtgcttcaccaaatctgccttgatcctacaatggaactttggaagcattaagaatcactaacaatttaagcaagtataccatttggtttttagaagataacttaacattgcagtctgcagatacttttccatgagttgtcaattaaccaaaactgtctttatcttactccgatacatcgaaaaggaacatggacatttgtaagatagaaaacgaggaagcacgtaatttcagaatcaatgcaaagaaaattggtaatacaaaagccaaatacaacaaagttacaattagatgtcccacgatatcagcagactacaaagccccagaagcctaggctatgaaaaaaaaagccacaaacaggctcgagacataaatagtcacaggctaaagaaactatttcgaatttgggccctaaacatggcctgcaagattttaacccagtccataaagcattcctatacaatactatcagattttgcagttcagattgtaaacttagaaggaaacaatatcaactacattcaggggatagtaattagctacaacagtacaagtgatgtttattccctgcattcaatcactgacttggacaaaaaactgttggacacttggaaccatcacatgccaaatcatcataaagaagctttgtgtgttaagaattatgacataaactataaaagaacgtgcaaatcagttaaacccagtaaacatatctcaacaaaagaatacaaacaaagttacagaaattaagctgatagttgtgacttgtgagagaaccagatggcattcatagcatcatcctgaacttaatctgccacttgcatcttcaaccttttaagacttattgtcctttgcaacaaatatggtaactaatatgatatccacataaaaaagctcacactaatcattccaaaacacttgacttttcaaaagtcaaaccaagtacagagtagttagtactgatatcattttttgttctcagaaaagaagggaaaacaaatcactatggacttgtttgcatcaggcctttagtgcactaatcctctggttctaccattgaagtatctttctgcttattaatcttcccagcactattataataataatcatttgttcattttatgtttcattaagggatcattcagaataattcaaaggccattaaggcttgagaactatcccacagagctagtctgtaaaaaaaaaaccatagaatactgttctatgcatgctgatcaatcattaatgtgtgatctttcctctaaaccaaacaatcacacctttcaaactaaatctaagattaagtacttttgatcactgaatatgaattaaaattatcaatagtccctcagattaaactaaaggttcaactgttactaaattccacatgaccacagaagacattaattagaagcagtgaaatgatagatatatgtctagttattatgaattgtctgtacataacataattcatcaggtaaagtgtaagacaaacatgaatacccatgtacggccaagttaaccttaaagaacagtggctacatatttcacatgaaaatacttgaaaataatatgatgtcattaaaacttttcacaacatctaagtttgcaatgctactacaaatcaacccaggcaacaattttgcaatgcagctgcagcatcaagaaagcaaacagccccaggaataatccaatttgacaattcttcacaatagcactatcaccgataaatttgatattgagcaacaagaaaatatccacatatgccattaagatgagtggaaatactcaggcattcaggcttatattgcttcaaacgaaatcttcaaaccttaaattgaggttctttgagcatagcagataacaaaatgattccgcgctattcattgtggcactataattctataattccattgattcacacaaaaaagaatcagtgagacatatttgcagtaacaacaatagatgctataatacaactcagcactatatcctcatggttaagaaactaattttccacaacaagaagaaacaggctatctccacaaggaatcaactgaaagaaccgaacctattaaatgcctggactcctcaatggcgagggctctgtctggtaatgccaactccgccggagaagatgctagcaaaggcctgcaggttctcgtcagaggggcttatgtggatctttcttggtaatggtaggatacaaggcccgcaaaacaccaccccgcccatctctctcaactcctcacgctcctcatcgctccgatcatctgcgccattgttcagcttcaccgcaacgtccagcttgtcagcgcacttcttgttcggcttggctgcaatctgctgcttcttggtcgtaagaaccgtcggagagggtgggggcgtcggaaacgagcggttgaggacgcggagcacgcggcctgctgggatgggcgccgtggagaggccgctgagggagacggcgggggatgagcggagagcgtgggcagctgccggggacggcggcgcggcgacgagactggccgccacgttaaggaggccgtggacgcggccggaggggcggcgcacaccgacggcgaacatcgacggggacccgacgggccgggacaggaggccgtggtcgccgagcaggaaccgggcggagccgaccagggagtcccccccgatgtgccagccgccggcgggcgcggcgtagatctcgacggtgacggcggcgcgggagtcgtcggcgagcgcggcctcgtggacgcggaagaggaggcgctcgtgccactccgggtcgaccccgcccgcgcggtccggccgcgtctggagcctgcgcgccgcgtccacccacgccacggcgtacgcctgcagcagccgccgccgcaggccggagggaggcttcagcccctgcgcggagatgagggtgacctccagaatccgctcgccctcggggagcgccagcccggcctcctcgtccggcgccgcctccatcatcgccgcccaagcggcgtagggtttcttggtcggcgcctccgcgctccgatttggggggtgggggttttccgcgcctctcccgtttcgtccgtttcccagagagggatttgaacggacggatggattgctactggccattgaccgatcgagggtcacaaataaaccccgccagattgaaagcgtttgacagctgcacgaaaaattctcaaataaaaaggagggtattccaaaaaattcaatcacattgcatctcacacacgccacaagccaatggctgtgttcagttccacgctaaaattagaagtttgaagaaattagaacgatgtgacggaaaagttgaaagtttgtgtgtgtaagaaaattcgatacgacagaaaagtttaaaatttgaagaaaaaaaagttagaatctaaacaaggccaataagaagatggtactcggatctaaatgggggagttcacaactatgggggtgtttaggagagaggggctaaaccccctatatatgctctactctatctatctaacgtgagttctaatataagtatagtatttctagttagtggcagaatcagccaattaggacctggcaatcctatgcagctgcataaacaccatggtttgaatcaatagtgtagttgctttgctccgtaagtctgtgttctttgctcaatgttcctgtcggtgatatgggaccgggagtatcatgaccagaggcttgaggtagacgcaatcgcccgcgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggctttatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggatggaaaccgtaccgatctccgcccattaaagagaaaaagaacagtccagtttggaaagagaaaggtgcatgtggtatccccttgagatataaaaggaggaccttgcccatttagaggggggatttttttcccggattgaaagctgagaacgggggagaagtcagcggacactttgtagctcgttcatacacagatccaccaaaacacaggagtagggtattacgcttcgcggcggcccgaacctgtatacatcgtcgtgtctcgtgtgtcttgccgacgagtaatctgaccacatacagagagagtgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaagccctaagcagggggaggcgcttgagagggtcgacaagtccgcagcgtcaccggccgcaggtgatgcaggagaacggcgagacggggagcgtcgcctcctcgtctacggcgacggcagcacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtatcatcaaggcggagggcgcggcgagtggcggcggctgcacgtcattcggctgccactccctcgtctacaccgtcgactcgggaggatcagcatggggagccggatgcccgcctcaacatcgggcgccggtgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaacgtccgttggcccccaaggttccggcccaccatcaccgagaagtacgacgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacgtatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggacggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccctggtggccccatctctgtccgtggcgaccttaaagtcgcgcttgcttgcattgagcagcgcgcggaccgcctcgctgctgcgtccaagcccgagggtggtgacgagaggcttggcccttctgcccccaccgccccgaggcagcggatggccacttgcgacgaggtcccggtcaaggaggttgccttgggcgacggcccatccaagaccacacggatcggtggttttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagctttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcgtatgtcgatgacttggttgtaaaaacacgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcattgaggccaaccccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatcttagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggaggcggccctccacccgcttgtcaaacggtgctgggtgcccccgaccctcaggaaggccccgaggccactgagggaaggctgcacttaaagccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaagatgctttacgctattctgatggcctcaaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactagggatccgccgcctcttggtattaggcgactcccagctagtcgttaaccaggtctgtaaggagtaccggtgctctgacccacagatggacgcctacgtacgccaagtgcggcgtatggagcgccattttgacgggatagagcttcggcatgtgcccagacgggataatatgattgccgatgaactctcaaggctcgcgtcctcgcgagcccagaccccaccaggcgcctttgaagaaaggcttacccagccgtcggcgcaacccgaccccttaggggagacggatgcgcctaaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccatggaacatcgaacaccttcgtcgcttctacccctgaaggggggggtcgggtgtcaggttttggctcgggctaaccccgcaccccccctcgggtgtgcagggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttattccaagctaagtcgcaaaaggaccatggcacagatcatcctcaactcatatatatagcaaaataaaactaacacaaaaatttttcatcatttctcattgcagattaagttaaaattgtacaaaaaagaggcatgaaggccttagaagaaagaacaagaaaaaagataagagtggcgggggcctgggggctcattcatatgcgcccgggtcgccggcctcgtcgccgccgtcatcctcatcgctggcgtcgccctcctcgtcggagctgggggcgaacgcgagcaaaggggccgacccctcgaagccgtcgacgatatggtcggcagcatcccggacgcgcgcgcgcgcgtcatcctcggtcccgggagggaactcctccagcgccatccagggagagaaatcggggtcccgggcctggtaactcgctagcacgagttcgaccgccccccgggcgaggtccctcgaggatgacttgatggtcttctcgagctcctcggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccctatctcgcccgccaagcggagggcctcggcctccccgatggaagaatccagcgcgcgctgcatgtcagcgacggtgtgttcggcagccgcgaggcgagcggctaagtcgctttcgcccgcagctgccccgccgataggcgccctcgcggccagctctttctcccgtgcctcgaggttggcagcccgctgctccagcgcggctctctcggcacggacgcattcaaggttgcggcgcgcctgctcctcttgcgccgcctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcatgcgccaccagcgtcgcctctcggagaccagcggcggcctcgcggcccgtcaagcccctctccacggcgccggcgtgttcttccagcgccatggcacgggcctcaagggcctcttcgcgccgccgcaacgccgcttcagcctctgttgctcgctgctctcgggcggcggcggcgtcgaggaccccctgggcggcgtcgagcttgttcttcagctccgcctcccagctcccgtgttgaaggcggagggagtcctgcgcctcgatcatcgcggtggtggcgacgagggcggcctctcgctcctcctccacctctcgggcgatctccgccagcgccgccttgcgggcttcgagctccgagatgtggcggcggtgggccttacggcccacctccaccatggcgtccaccgagcgccgcccctcctcgacgcgcgcccatgcggcctcgagctccgctcgttccgctcgcaaggcctccacctgggcgctaaatccatctagcaccacggtgtttgcggcggctaaggcctgcataatgggctcggcgctcaccggggcaacggaagacgaggagaaaagtcgccttggagaaaaggcgacgcggcttggccccccgaaagatgcgctgggctcggggatgtcccccgggcccgtttgatcctgggcgtcgcccggtgaggtaggcccaggcgatgcgcccgcggcctcgtcgcgagccgcctcggaggatgtcacctgaggaccgcccgagggagtgggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcatcttcagcttcccgaaggcgggctgcggcttcacgccggtcagactctcgcctccgctcctctgcggccgccggatcttcggcctcggactggccagatttggggcggcgggaggaatgcgacgggacatcgctgaagcagaagaaaaaaccgaaagacgaacaaaatgagtaagaaaaaacttcttttttgggaggaaaatggttgcaatgagagtgagacgaacctgcgagggggtcggttgaatgaccaccttggaggggaaatcaggtttccccggcatggttccgtctcccccgtcttgcggagccgcttcttcttgcgcaccccctcgggctgcgacgtcggcgcggccccctccgggcgccgactgctggcacgcgccgccccgccccctcggggaggagatgtgggaggtgttcctcccagcttcctcttcccctgggcgtcggcagggcggctgctccccgagcccccgacgcggggcccagaagcgcgaccccctcctggggcagattgttccccccggcggcgctcgctcgcgccgtcgtggtccttaggggctctctcctctgaggccccgacccccatcataatggttagaatggaggcgcggtcgggatcgctgcagagggggaggatctcctgaggaatgcgagacgcctccgcggagctaagattcagcaccctttgaaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtactcttcccccagatctaccggcgcccgccagctggagacctgcgccgggggctggctcggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccgaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactcaggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacgacgcatgaagtggatatgcggttgaggcgatcgaaacggattgtatcgtgcgcgcgttaattacgctcgccgaccgaagcggcgttgccgtatctccgggcgagacgaatctgctcgcccagattcgcgcgctgctcaagtggtgtggcagtcttgaatagaccgcccattatggacaaccaaagttaccaataccaatgtgcatggattgagaccgttgggtattttgcccaactacggagaccggtcccacccgtcaccaggctttaggggtggcgtcacacctgaccgcttcccttgggaagggaaattgctctggcataacgccgggggctactgtcggtgatatgggaccgggagtatcatgaccagaggcttgaggtagacgcaatcgcccgcgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggctttatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggatggaaaccgtaccgatctccgcccattaaagagaaaaagaacagtccagtttggaaagagaaaggtgcatgtggtatccccttgagatataaaaggaggaccttgcccatttagaggggggatttttttcccggattgaaagctgagaacgggggagaagtcagcggacactttgtagctcgttcatacacagatccaccaaaacacaggagtagggtattacgcttcgcggcggcccgaacctgtatacatcgtcgtgtctcgtgtgtcttgccgacgagtaatctgaccacatacagagagagtgagagcttgagatttcaccctaagcccccggccgaactggcaaaggggggcctgcgcggtctcccggtgaggagccacgagctccgtcagttcccaacttcaccctactcgttttccacgcgcatgctttctaaaccgcaaaacaatgtattttttacaaaaagaaactttaggaaaattgctttaaaaaatcatattaatttatttttcaaacaaagctaatagttaattaatcatgtacgaataagtcactccgttttacgtgcgtgacgaatgatttccaactcagtttgtcaaactcatcctaagagtaagtttaacagtatagcccactactaactccaattcatctatagccgatctaatagccaattcatacaatagttgctttctatactattaatatatggtcccacctctcatacacacattgcgtcttgaagtccgtgctacagctagctacagatctgtagctcgctgctcttctctctcatcttttatctcattaaaatatgtttatagttagctaatagtctgctattgtatctgctctaagtgatgtgggtaaatccacaatctttcatggcaacgaggtgttcttttatacttttgatgcttatggattgttgtcagagatttttctttcttaccttatggttatgttgactctttcatgatcaggatattcatgtaaattgaacatcgttttacattaaatttgttctaggcagccaccatgaataatcattgtatacgctctgattagttgtcatcattgttagacatgcccagacttaggagtctatcagatttatttgacagatgaaaaacatttctaaaacctaagaaatatacatattgattggtatagttcatgacttcatgtgattaaaatttggtgatgttatgtacctattgtattgcagtggtttggtagactaatagttctcatgagtcgtgagaccatcgagccttagttccgtcaacatgcaaatccacgtgtgcaatcatagcgagagtaaatctccctcctagagagccatcacagtggtggtgagcatcccaacggaacggccaaattaggctctttaaatatctatatagccagctctccaactaatttggacagtcaaacttgttacttactcaaacagcctctccatatacccttagtattttgagcctctgacattaggacctatatgtcagtctctactatcccttcttcctcctcttcctccccctcttcatcttctgattttatccaccccttcctcttctgatcttcgcccttcaacggtggtggcggcgcatactacagtggcggcagctgccgcagcagatggtgacgatgacggtagatggcaactgcagccccacgcgaaggtgacaaaaatcgcgcggaagcagcagaggtcgcaccctccccgaatccacgtctcgctggccgaatccggtgggggcggaggccgcgtgcctccctgaatccacaccgcgtaggcctaatccaacaaggacgaaggtagtggagaccgaccggatggcacatatgacggctggtgatgacgacctcggcaacgatggcagtggctggcgacgatgacctcgacgacaatgacagcggatgacgatggttggcgacagagcaaacaacgacagtgtcagctggcgacgaagatcttggcagtagtggcggatggcgatggcaatctcgacaatgcaggcgcaacggctggcgacgctgcaacgacttcagccggcggtgggcacgggcggagatggggacgacgacggcgagctctgcgcagatccagcgtgatggcgctgcagaggggaggcggcatgtcccggcggcatcggacaaggagggaggttgagcgtgagagaggagagagatggtggggcaatgtttagcatgtcttttttggttggccaaatttggctagtgagggaggagtttggctagtcatttaacttggccatccgagtagaaaggctattggagtgcgattttatgctaaacttgtcaaatttaacttggatagtctgttggagacgctctaaatatagtgtctgtgagtctctgagagagagggtagtaaatgtttgtctagacctgaccatcacaacgttgtatagtttctttaggcagttttcataaagggagcaaataataaatatttacattgagaccggtaaacaaaaaatcactggcttgctctattgcattttgttgggtctaacaattttggtcttatcgcccatgatagctcttgcatgagacctaatttcttcaaatttccctctcttttctccctcctctaagtaagtatcaggctaaaatttttttatgtgatagtgcaattaattatataaagatatattaattgtgatattagaacaactctaagatcacttgaaagagaatgagaattaaatttgaaaatatattgttcattcaattttttctcagaaatatttgggatacaatttattttgaaaatataccgtcgattttatacaaccgttggacgtaacgtcgagggcgcggtatcgcgaggtataagcgcgagaccgcggtctcgcgcagcaatgacgcaagaccgtgcggtcttgcggaatggaagagcgagaccgaacgatcccgccaaatcaaacagcgacactgtccaatggcttcattttattagtgattaattactcaattaacaattaattaataataattaatgactaattatcttgattagcgattaattaatccagaataattgatcgctaattaaatcggcatgccacggtatcgctcattgcttcagcgagaccaaatggtctcagtctttctttccacgagaccgcgcactctcacactgttcatgcgtggtctcgccttttcaccgcgcgatatcgccctcgacgtcactcccacatcattttcgcgcaacggttgtgcgagaccgacaatatatttctataaaaaaaaattgtatccctaatatttttttaaaaaaaataaatgaacagtatattttcaaatttaattcaagagggtgattcggtagtttagaacaaataagttggccaggcgtcgctaatgatcttgtctataaccgagtgccagatattatacgtagatggatttaaaaagaacaacaaaacaatgtcactggcatgtttaaaaatatggatgcgagtgggacggataagagcatcaccaacagatgctaaaaatctaccctcgcaattttgtttttaagattcctaatcatattttgagatatgaatagattcataaatatcttaaaaatctgattctagaaaataaaagtgggtccacactaaactaccaatagagatcactctcccctccgatgtacgtgtgtgttactggtagccgatgtgctcccttgttggtggagagcaagaaggacggagaaagagattccaattttaagaaggtactttggaaaattagaaaaaaaaattgaaatcatcttttaagaaaaaactaaaatgttgagattaggagttaaattaggcatgtgttagcgggtttctttttcctgtttattacaataatggttattgttttcttctaaattatgtattggcgaatagaaaatgatatcaaagccggggttttttcaggtaacggattttcttacttgcatccctatttaaagaacttggtacgatcatactgtatcggggaaaaaaacacaaagaattcagcatacagaacgtggtaaaatatgcacgctgagggcggattgcggaggacatatggactttgggggtaccgtttaattgggaagtcaaggccccttggttgcaacggtgagcccatcgcatccttcttgggccaaaataccaggcttaccaggttgcacgcgctagttctgggctatcaaccaatgggaaggacagaggcaccgttgcctagcaaggaaaattgccttgcaatggtagctttagcccctttgatttggaggaaaaacatagtaattttagaggattttaatcctatagaaaaatttcctatgaagccctttgaaacaaagaattgaatcctatctaatcctttgaaattcctatggaatggataatcctatagagattttggaggaaatttagcaagagcttcaatctcttgctaactttccttttgagtctatctctctcatccaattcctgtgtttttcatgtggttcaatcaaacagttattcctgtgttttgcaatcctctgtttcatacttatatttctattaaaatcctacgtttttcctattcctatgttttctcaattctgcgcagggccggtcctgagtttccaaaggcccggtgcgaaaataaacataggggcccttaatatattatcccttaatatattatctaaataattattaatagatctatatatatgatatgctgctgataaatacctaaattacatggagaaataatatttatatgaaaaacctcatatgtataaccttaaatttgtttttgggtacgtatgtatttctagatgcaagtattgatgatctaccaatatcaatttctaaatttcactacaaaacaataaacctaaatgtaaaatcttactaattaattgagcgtgggtggccggatgtgcgggtcactcaagcgcaacctctgtactatacacatctaattaacaagcagaattagaaagctattaatccaacatagccaaattacagatgacaaacagatagcatggaaatttaatttgcaacaaacgagagtaccacaagaacgtggtggtgttgctactgctcacctcctctttcacatgtagtgcagtagaaagcaacctcttcaatattcagtgttgaagatcgatttaaagttttgcacttccgccggcggcagcgtcgtcgcggcaggcgacagccgactgccgatggaaggcgcgtggatgcggcggcgattggaatgtagtggatgggattcctggatggggaacgaacgggataaacggcaggcaggtgctaatgtcaacaacacgcgcggcggcaatctcgcttgtgtatggtggaattgggaacgacgtgctgcggcgctgtgagcctgtgacctatatgatacgatgcctcttcgtgtgtgctgcctttctacgtactgggccaagggaggggggaggtcaggtcggggcccctacgacctgggggcccagatcggctgcactgctcgaccccccgggccagccctgattctgcgattaaaaggggcccttaactgatttatctctatcggcaagacagcttgtacgccgtacgcgggccacaaaaccgtgaccgaaactccaacggctgcagaattttttttatttataattttttttattaaaagttttacaaaaataattttccattttgaaaattaacggaaatagtcgcctaccgcccaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcctgcaaatgggcggcgagggggggcatggaattttgcaggcggcccccttgccgccctccgctagggcgattttgcactgtgcgggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgttgactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgttgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgagaggaagagctggcgaacgcgcccgaagaggtggcgaacgcccctgcggagctcgcggaagggccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttgaaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtagggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactcatccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacatcagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaatagcgccggtgtgtcgtacgccatacctgcatcaaataggttgatcagaaacatataaataattagttcaacataagtaataaatgttcataagcgaattactaacacatattaaacaaaagtacaaacaaacaaaagtgtttagtccgaacactaatcacgataacattatgacacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctccttactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagaaacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaagatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaacctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaac

SEQ ID NO: 48440 - DNA, 986 bp, Oryza sativa
tatccatattttctagcgagcagttcagtacataaagaaccaacaaatgctatattaactatctattatatacttaaaaattcattaaactccctacagatcctcttaaactgtcacatggttttctacaaacactcatgagatgccatgtagtgctcaaataaattaaaagttcctagaaattatgataaaaaaatcaaaccattgattttcctttaaataggtagatccaataattataactgctacatctcacaaaaataaatccggtacccccacctccacccctaccgtatgtgagcatgcatgtacgtacgtacctccaccgtcctactcatctctgggatccaattctcatatcctatttttaagataacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatactgctatctaactacaaatatttgagcaaaatagcacttcgaaaatgatgaatgaattcaaatgtgtgggtctaaagtccaagttcaatcatcaccaaagaagcttggaaccagaatgcacactctgggcctgaacccgatgaaggcggagctataagacattattagcaaggtggacactgacggcagcggcatcatcgacttctacaagttcctggacctaatagcgcactaaatgattagatgaaggacaaggactaagaggaggggaccagagggagacgttccatgtcttcgacaaggactagaaaacagcttcatctttgccaccgagccccaccacgtcatgtctaatgtatcaagagaggctcactgatgaggaggtcaacaatgatccgcaaggctaatggtgacaggtggatcaccacaaggagtttgta

SEQ ID NO: 48441 - DNA, 1186 bp, Oryza sativa
ctgggacgccgccaccggcgagggtgccagcttcacacaccggcattctccttcgtcatcaacccgcccaaacaggacggcggcatcgacaacaagggcgccggcatggccttcttcctcgccggcttcccgtcgaggctccccggctcctacccctacaacctcggcctcaccaaccagaccgccgaccaggtggccgccggcgacgaccggttcgtcgccgtggagttcgacaccttcaacgacaccatcgtgcacgaccccgacgccacctacgaccacctcggcgtcgacgtcaactccgtcgagtccaagacgaccttgaccttgcccagcttcaccctcgtcgggaacatgaccgccgtcgtcgagtacgacaacgtgtccagcatcctggccatgaggctgcacctcggctatgggcttagtggcccccgtcaccggccggattacaaccttagctacaaggttgacctcaagagcgtgctgccggagctggtctccgttggcttctccgcctccacgaccacatcctttgagctgcatcagctgcattcatggtatttcagctcatcgttggaaccaaaggccgcggtgcgtggcagagttgtagcgggagccaccgttggcacggtaatgttcgtcatactcctcttcgccatggtagcagtccttgtacgacaacgtcagagcaagaagagggagacagaggaggcaaagaacggaggcatggatggcagcgacgacgacgatgacgacgacggcgagaccatcgtagagatcgagatggggacggggccaaggcgatttccatactacgaacttgtcgaggcgaccaagagtttcgcggcggaggagaagcttgggcaaggcggtttcggcacagtgtatcggggctacctcagagagcagggcctcgccgtcgccataaagagattcaccaaagattcctccaagcaaggcaggaaggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaa

SEQ ID NO: 48442 - DNA, 1483 bp, Oryza sativa
tatgtgcatttatgccatgatttaaattttactcctattttagtttttctagacagatccattgacttggtgctccaaactagagctcagcactttggtcttcggttccatatgaccaacaacacaaaaatagcaactcgtattgataacaatcgatcgttgactcaacgcaatctcttctgaccccgacggtcgaaaactatggccggaatacagaagaagcaaatcaatgctaatttggcacaattactatacgtggaagaactaaataatactccctccttccctaaattttgacgttgttgatttttttaaatatgtttgaccgttcatcttattcaaaaacttttgtgaaatatgtaaaactatatgtatacataaaaatatatttaacaataaatcaaatcataggaaaagaattaataattacttaaattttttgaataagacgaacgatcaaacatactacctatatattttaatgtatgacaccgttgactttttaaccaacgtttgaccattcgtcttattcaaaaaatttatgtaatcatcatttattttactgtgacttgatttatcatcacatattctttaagcatgacctaaatattttatatttgcataaaaattttgaataagacgaatggtcaaatgttattcgaaaagtcaatggcgtcatacattaaaatacggagggagtatttaaaaaagtaaacggcgtcaaacattttgagatggatggagtataaccaataaatgaatggcaagcgtgtgctacaattctttgttagacgagccggccgtcttctcgagtctctgtgtgctagtggtggcatcagctgctcgagtgagttatcgtggacatcagctaaataggggtgatctgtccacctgtgtattaataattaaaaccattggattgttacccattttaagttcttgaccatttatctcaaaacgaagtacttgacgaaagagagattaattatgtggcatcacttgtagcgttgttgtcagtctcattgtttagtgagtggcaattcttatgaccatttgttcaaactatttttgatgtcacaaggttggagacctatttctggacatcaccttaccgggggaatgagaatgctattgccaatttatttacgtttttaactatcgtgcttgataggcaccactaccacaataacgtttctagcttgaatgtgatcgaaatagttaagaaaaacaaaagctgacaacgtagattcactagaacgggattggatatctctaacgggcttaaagcatcatctctttcgggcagggagcaaaggtcagtaataagaaaatatctcaatcgggcatccggccgtcacggatgacacatctcaatcaagccaacataaaagcccgtcatggatgactctcatctctaacgggcctagattatagcccgtcacggatgactatcatctctaacgggtctagattatagcccgta

SEQ ID NO: 48443 - DNA, 4869 bp, Oryza sativa
  unsure (1)..(4869): unsure at all n locations
agttgagctttatttatattggttcaactaaatattagatataattgcttagccctgcttagaaaccttagcacatttatgggataacttatgattcactattatttcatgatggtttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagagctccaatggtctagatgtggacatgatactcttagtaggatgagaacatgcaacttatttgccggcttgacaagcactacaaagcttatctttctcaaacttcacatctttcaagtccacaactagatcacgttttgaaagtttgctcaattgattcatgccaacatgggctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggttagaaacaataacttcttgcgggaagaaagcacatgacaagccaagatcacaaatttgagcaaccgaaagcaaattgaaatttagagatttaacaagagagacattatcaattgacaaatcattggagatagcaattttacctaacccaattacctttcctttgctattgtctccaaatgtcactttctcttgttcattccctcctacttcaaatgtggtgaacatagccctatcaccggtcatgtgttgagtgcatccactatcaagcacctaatggctcccaccggtgcagtagttcacctacaaaagaagatcaagctcttttaggtacccaaacttgtttgggtcattggaggttacagaccaaagctttgggcacccaaatggcattctttttaccaccgagtataggggaacccacatatctatcaacaatgctaccatcatgagccttcctaagcatataatgagaatcaaacatgcatgtcttaggaggcttaccaccggggcaatcattcaccaaatgcccaacctcacgacacttggagcaatacttaccattactcttgacaaaacgagtggcacggtgagaaggtttcttacccttctttggaatgaatccaagtccctccttgttaaggatgcaccgttgctcactcaaaatcttgtcaagagtgttcttacccttgaagcacctctccaagctcttattgagcttagccacttgctccttaagctcattgtttttaacaacaagtgaggcatcacaaatagaaacacaagagttagagctagagctagacatatccacaagatcatcacaagaggtagaaatgctagatgatgcaacatgagcaatatggcaagtagcactatcatcaagcaaatcacaagatatgccaacatcaatgagagcttcatgttgagtagtggaaaggaggttgtcatgagcttccttaagcttctcatgagaaatggtgagtctctcatgagaagtctttagctcctcatacaagacctccaaagaagcatgatccttctttagggccttgaacttgacaatctccttctcattataagcatggagctcctcaaacatactcacaagctcatcataggaaacattatcacaatcatcatcactctcactatcattaaaagatgttaccttagatgagtcctttgccatgagacaaagtggaccgaagagtgatggagcctccttgatggcaacaacgaccatcttcttcttcttggagcttgcatcatcaccaccttcttcctcggacccggatgatgcgaagctctcctcatttgagtcccattccccgatgaaagcctcaatcttcttgccttccttcttgagcttcttcatgagcttgtagcctccactcttcttcttggatgacttgtctccatcatcatccttggaagggcattggaagcaaagtgttgaagcaaagtgtcccttctcaccacactcaaaacacctcaagttggagagagtcttgttgggtcttctatttcttctcctattggagttggagcctcttcctctctcctttctccttcccaagagatcattgaactatctagcaagaagggcaatctcttcctccaagtcctcattggcttattcaccttgcccttgccctagtcttcaacttcggcttggagggcaatgccctttttagaaggtgaggcttcctccatctccttcttcttcaacttgtacatgtcattggtgttgatcttccccaagaggcttgccggtgtcatccttgacatgtcggagttgatgagcatggtgataaggggtctcatacttctccggtagagccctaagcatcttttgggcaacctcaagatcggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtgccctcatggatctccgccaacttgttccaaatctcatatgtggtctcaaggtttctcactctatcaaactcctcttggctcaaagagttgaacaaagcattcatggcttgggtattgagttggaggttgcggtgatcaatctccgtcaagggcgtgccggtgatagcaaagcctacatccacaatactccaaatatggaagctcatagctttgaggtgagtagacattttaattttccaaatagaatagtttgtgccattaaacatgagagccttccctacatggttcacctcgttcgacatcttctctctaggcggtgaagcccaatcaagagagaccaagctctgataccacttgtaggatcgagatgtcgactagagggggggtgaataggcgatttaaaactaaaacaccactaatcaaaactaacctaagttgctaagcttggtgaaggtcaactctaactaagcaactaagttatgttttgcaaacctaaggtgatagtggttcaattatatctctaggaaagtaaatcacactcctatgtcaatgtttagcaatccttaggtgatatgatctcaagtatgtctctagaaatgtaaattgcacaaatataaatgtgacaatcaaatgagacaaggagacaagagatttttcaccgaggtttggaaactcgccagtttcctactccctgttgaggcgagcccaactccaccgctcaaccacgaagccaccgcacgcccccttcgtcaaggggtgggtaaggcgggagccggcccacggaaaggactacccaagcctcaatcactagggtagttcttccttcactccaaaggtggtgaactccaaaccactcacaaaccggcgccgggcctcctccacaatcttttcggagaggtcaccgggcaactcctccacaacccgtctaggaggtggcaacctccaatagtaacaagccaatgacccgcgtggagatgatcaatcaagtgccacactacctctacaaatgaaagcaatgcacttgactcttggctaatcaaccttctaacacactagatggatgaacacaaaactcaagtaggtgtgaaaaaggtgcaaaggatgtatgcaattgaattgggtgccaaaaaagtccccttgctgctggtgggggagtatttatactcccaccccccaaaactagccattgngggcgaaatcccaaatcattgtgctctgtcggtctgaccggaggtatgtggccggtcagaccgtgctactctgcaacggctagaaaactagccattgaa

SEQ ID NO: 48444 - DNA, 837 bp, Oryza sativa
tgtgccgccggtcagaccggccttatgcgccggtcagaccgccttcttgcggctggtcagaccggccagggcacgccggtcagaccgccactatgtggctggtcagaccgcccctggtcaggccgagccgagtgaaatattgtgtgtgcgcgctatgaagatgtgagcacaagtgaaaatgcaatgacctaatgtggcaattaaaatcatctctttgctaggtcattacccctcttaatagtacggcgaaactaaaaaataaactagcaaatttgatcgccctacacctcgatcaattctaaattaaagcactagttttaccgtcttcttttcttcgcttcgcgccatcaaattttaatccatcgatagtcatccatgcgcacacatgacgtcgacctaacttaaatatatagctcaaagacaacggttagtccacaattagcgcttgtcattaattactaaaattaacaccgggggcctagatgcttcaccgcgtgctgcccctcctcgagccgccgccgcgtcccatgcttcaccaccactgaaaccgcccctggtccggggtccattttatgccggcaggttcccttggcgccattaccggcaatgagggttctttttcacagtgcgaaagccaagattgaaaatgaagggcgccttttcaagccaggccaattcattaaggttagtgaaccaggaatttggaagcgttaaggtatgatcggtaactcgatatcatacatattccagcgattagctccaagagagaccaagaccccatatatcatgatttgccaatttaaaattcagtaatatttttaatatatggatgattga

SEQ ID NO: 48445 - DNA, 1140 bp, Oryza sativa
  unsure (1)..(1140): unsure at all n locations
caattattaagagcagaaaataaatttatctcatctctatgcttttgatttattccgaatagtacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaaatatcatataaagaataaaataaatgatgacttagctttgtaatattccccttggtgatggcagaagtggccaatgtgggaacaaagtcgtccatcaataacaatgaagacaccagttggcggcgacgaaggcggtcgacggtgaaagcgaagatgcccactaatggcggcatgataggtcagcncgtgtaagcggaaacaccagtcgacggcaacgaaggtgagccaacggtgaggatgtagacacccaacagcggcggcataataggccagccgtgtaggcggaggcaccactcggcggcgacggaggcaggccggtggtgaagtcatagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataataggccagctgtgtaggcggaggcaccactcggcggcgacggaggcaggccggtggtgaagtcgtagacgcctaacagcggcggcataataggccagccgtgtaggcggaggcaccactcggcggcgacggaggcaggccggcggtgaagtcgtagacgcccaacagcggcggcataataggccagccgtgtaggcagagacaccagtcggcggcggcggaggcaagccggtcggtgaagacgtagacgcccaacaacggcggcttgatatgccagctgtat

SEQ ID NO: 48446 - DNA, 1109 bp, Oryza sativa
caccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataatgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatactgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttcacaggggaggggctggggtttataggggggaggcaaaaatcgccctcccccagggcggcaagggggccgcct

SEQ ID NO: 48447 - DNA, 11279 bp, Oryza sativa
cctcgcattggtactagcagagtgctttgcacaaacagtgaaaaatttcagcagacggatcctatgttttggccgtcttttccggaagcaggagtctcgggtaagactgctaaaaggttttctcatgcaaaggttttcccatttgaccttttccaaaagatatgaggtacgctgaggttaattattataatttccaactaactaaatcaaatactgagacatttaactgtttgttatttttaagatgtgaaaattaagaattacaacataatctataatatatgggtccaataataaattcttaactatcagttgtaagagtgataaatagttaaatatctctcaaacactatcactgctccttcacggatttaccacctcctggcgtcccgtatccattgagatgcaccaaggcttgcgatccgctgcagcctaccgcggcacggcacgacccgtcgacccgatgggacgtgtgagctgagcccgcccgctgcccagccactcaacacgccacacggcacgagcgccagctcccgtcccttccaacgtcccatcgccaccctacggatctgcacctgcacgcccctgtccgctggagtcgacaactcctcctcctcttcccccaccataccaccccccacggccttcacggccgatgcaccgggagatcgaacacccgtttccacccgggactacgcaggcgatcggccgacacgctgcgtcgcgtgccactgctgctcccttttgatttgccagtgcggcgaggccagcgctgcgccccgcaggcaccgcacgctgctttggctcccgtcacctcatcatcagtcagaggcaggccgtcgcgcgtcgtactgatcaacgtacgcgtacgaccggcccgtgccgaacagtgcgcgtttactgtaccgcacgtcctcgcgcgtgcaggtgtgtacatgtgtattgcttgtggcagaatacgtcgacgtgttcgcgggtagtactccatctaacctgctgcgccaggctacaggggctcaagtacgtacgagcggcagatttcgcgttaccacacgtgacgtgtttcttgacatggtagcgggtagcctacaggaatctctccctgcatgcttaaggtgtagtaggacattgcaacgaagggcctgttttgcacaactccagctccatctctactgaagttggagctcaaccaaacagttttacctccatctaaaatgagagtggatttaggtggaactctctcacaaaataaactaaggaggtgaagctgggtttaggcagctctacaactcatcttcagacccaactcctagagctaaatttaagagttaaaactctaccaaacaggctcgaacttagcctaaataaaatgtcattacgagtcgtgagtaaattaatactactacaacctactattagtacttcctctaattcaaattccttgtcattacagtaaaatttctacataaaccatgaagaaatggtaaattacattgttaacttcataagtaaaccataattattttttcgtgagacacaagtgaatgagagttgtgtgattattaatatatgattgtattaattgatgaaagatgggtaggaaagataattccaacctataaactgcaagtaatttctatatctgctatgtcatatagtcgctacgtgtagaaactatatactcaacggatggtttcttcaaaacaatttttcatccgttcacctctcctctctccttttatctatttatcacattgtttttattcttgtttatgtgtagagctagtttcctgcataagaaatagtttattcatcttttttttttctctctctctctctctcctagttaactctattgccaactcaaccttttggcttatatgacaatgtacttaaagctatggaaactagatgaggtatagggttgggaattccctgagacagtgttcgattgcagggattgcgaacccctccctcacagcatgcaaaatagagccgtggtttagcgaatgattaattaattattagctaaaaaacttgaaagatatattaatatgatttttaggagaactttcctatagaagttttttttttgccaaaaaaaggttaacatttagcaattttaaaaatgtgcgtgcgaaaaacgagggaggagatgttggtaacctacacaacctataaatgatttgggatgtgagaacgataaatattttttcaaaaaaataatgctgaaataacagttaatatgaaacaaagggagtacatactaatgtaggaaacatgcatgctgtagtgatatgacgtgcggggctcttttggattgaaggaattttaatggactttatggaggattcaaatccttgggaatttttttgttgaaccctttattgcaaaggaataggatgttggaattcctataaattgccctcctttgccccccccccaaccccaacccaacccaattccatagaaaaatacacatgagtcaaacttcatgttttattttccttcgtgaactctcttcctttacctctttagtttccgtctctatcacaagcaagttcctttgaaattcatatatttatttcttgacaactatctataggaacaaactttagtattcacatgttttagaataccataggatttcacagtgtcacattctgttctaaagtttttcctattttcgttgttctagaatcttgtattccaaaagagagtaaattcaaggatattttttcaacctatgcatgtgggagatgggttcacacatccccgccgaatatatatcatgataataagttaatatcataccaatttggtaactactttgtgatagaaaattgagaaaactgatgaagaaatcttatagtgatatatccgatggactttgcagatttatgcgctggacccatcttctcctttaactctcgtgattccttcaacaacgaaacatgacaataagattttacaggtaaagctagtgtaggacgtgggggtggttagagggaggtcagtgcaatgacggcccaatggcgggcaataggggaatcaagaaaacctcagttaagggccgttcggcggtgatagaagaagaacaatgtaggggcacctatgagaaggggaaataacagataaggagaagaagttaaatcaggctaaagtgacggaggaaggaggggcatagtttgagaggggtgctacagttgggcaataagactaaccatgaattgacggaggggttagtagtgcgctagataggggccaccgggccaggttgtggcctaccttactgtctagatatatagcaccttattgaaccatgatttggcggaacaacgatattgtggagattagagaggattgttggtcggtatgacgttgccaaaatgatattgtttgataatgggtagttttctaattcattacagattatctatgtgtgttcccattggtttcttttctggtatatgatgctacgactgaagggaaaagatttatgtgtaatggaatgtgttaattaggatttttttttgtttcactttctctctagatgacatagttctcttagatttactaatttttaggcttggatgtggttttttattactcgttttgtcccataatataagagattattctctttttttataatactaatgatagcaagaaaaaactagaatatacacattaaatgagatttggttatgggtgattggataatatattggtggttaaaataggtagaaatttgaattagtgtttatggatgtgacaaatagtacaccaaaattatttatattataaaataaataaaagaaagaaaatcttttatattacggtacagaggccacgattacttatcttaggcaccatgttaattaatctttggtctacctctcatgtttagagttactttacatatgccatttcttctgtgtgtgatagtcgagaatgttggcgttcgtgcacatatgcaacaatccttttatttgatctggaaatttagctgggtgccctagctatatatgtgcaaaggtcggagttgaaatatatttttcattacaggaaatgcaaaaatcttgcacagtacacactgtatagaggaagttccatttatgtaaacattggcgatgccaagttcaaaaccaactatactaccaaataatacactgcctgtccattgaaatgccttggaacaaactcaagtacatcacatgtggctgcatgcgctcccctcttcagtgctatacgtttatttgaagggttcagtgctacgtttatatcctcatctaattccatcagttctgctgctatgttgaccgttgtggcttgtgataactttaccttgatgcctctggtttgtatcatccaccgcagtgttacaagtcacagctagctgggattttatttacttcccgcaagagactattgcagccgttttgtagccatcaactattgtgcaccacagagccaacaatggctgtctactgccatgacctgcttacagtaagtagacagtattggaaacagatcgtgggatttgatgttgcagtcgacagcatggaacatgttcgcatggtgtgaactgtggagtccttgtgttatcagggaaggaagctactaggaatgggaagaaaacatactcctgttacttctgcaatataataatagtacagtataaaatagaaccggtcaccagttgttgaacacgtcgaacatgtgtgttcaagcttatatgattcagtaacttccccaactgatccaagtgtacaagaaatgctccaaagttcaggcctctccgctaagcatccatagtactatatgtactacagagtgcagagcatctgcggttctgctcatctgtttagattcgtggtaactgaaggtctgaagcgagccggaatatgcgaagaaaatagcctggtaatttgagacaattgcgtgcatgggatgtctcgattttcttttttttttatagtgtttgatgtagggtgtgtttagttcacgtcaaaattaaaagtttggttgaaattaaaatgatgtgatgaaaatattgaaagtttatgttgtacgaaagttttgatgcgataaaaaaattagaattttgaagaaaaagtttgtaactgaactcaaccatatatacatgctccgctgttgaaaaggccctagacagatcttctcatcatctctactactaccccagttgggccattctatatcctgatgacataattatcctgccgaacaaaggccgaatatattccacgtgaacgccctagatcatctctccgaaagcagttgcgggctctgtgcaaaatgcagccatatacacgcatgaaaaaacttaatccggtcatacagtagccgatagttgcaaggaccatgcatcgtccaaagaaaggtcccggatgtcaggctcaggtgattgcattgccaccatttcgaagaagttgtcggcaaggagtagagagctactctagctaatcaaagtttggaaagataaaaaaaataagggtagagactagggacaaaaccagctgtagtgttgcctgagggtttcacggggacagcccactaccgatgcaatgaactttgcctgtagatggacgtgcatgtggctgcatgggaacttgcattgcatggaacttgtttgcagcgagataggctcgttgcaaagcgcctagctgcagcaatgtggagtagcttggtgtattttaaagctttgaactgctacaaaggcgaaaagctggagtacgtgtttggtatgatttccaccagcttttcttctttcttgctgcgcttgtcaaaatggttggtggtccatcagttttacagagaaaggttaggggacaaattgattgtcaagtgctcgaatcttatcagcgacagggacattacatatcacggtaacttataatgctgttgccatttaggagtactactccctctaaccgaatcaaacttaggcctagtttaggtccaaagtttttcttcaaacttttaacttttctgtcacatcaaaactttcctacacacataaactttcattttttcgttacatcgttttaatttcaaacaaacttctaattttgacgtgaactaaacacatattagaatgtgtcacattcatccaacaattctttatatttttggaatgaagagaggagtaatttctacagtagtactgtacttctgagcaatattattgtcactggaatacttcgtactcccttttctttctctctttctctctctctcttgtttttcttgaacaatctgttcgatctggtacgattgcaaatcctgtccatcacgatcacatgtttgatttcaggtcccatatcccgtcaagatcgaaccatttcagccctcagggactttggaatctcagagtatctttaatatttattacaaaactactaactccgtcctttgagtttttatttgtaacttttagccattcgtcttattcaaaaatatggaattattttttttgacttactttattattaaaaaatactttaagtatgtcttatcttttttatatttgcactaatttctaaataaaatgaatggtcaaatgttgtaagaaaaagttaaagcgaccactaacttaagacggaggtagcatatagtaaaacgaagccttgttgattaagtagtaatagtagtttagagagacacgtaccataatgtatttatgttagataataagttgggattcatctaaaattttctttcaaacatgaatcataccacaattaaaatgatagatgagacccaccatatataaaaatgctaatacctgatagtagtagtttataccatttttataatgtatcttaccttatactccctctgtttcacaatataatgtattttgagtttttgtttacaatgtttaactactcttcctatttaaattttttttgcaaatataaaaaacgaaaagttgtgcttaaagtactgtggataataaaataagtcacaaataaaataaataataattttaaaaaaaattaaataagacgagtggttaaacattgcaaataaaaacttaaaatatcttatattatggtacggaaggagtaatagaaatgcatccattacttgtaacagaatatatgatcggtcaaacgacagtgactgagatgaacgtcgtgaaaattgatgctctagctaggaggttatcatatcaacaaagaaaatgaagacagctgcgaaccgcggtgtcatgaatctcatgttgcgctgtcttttctccccgacaaaatctattctgaactttggattcatattgatttgattccgctctgctgaaatacgatcagtatactactcctagtaggagtactctcatagcaaggtcaatagtacagtccactactagattaaaattatttatagctaatgtaatagttaattcatacaatagttactaactatactattaatatatggttctacctgtcatacacattacatcttgaagtccgtgttgtagctggctacagatctgtagctcgctgctcttctttctttctttatctttttaaaatatatttatagctggcttatagcctgctagtgtacctgctctcacgtacactacagtatatactactctcacgtactgtactcctactagaagtactccactccgtactctgcacacgctcttcgtcatcatgcacatctaatcatcatcgtctcttcaattacacaatatacagcctctcgtttttctttcaaaaggatataggagtagcaaagtactataactcgtacgaataacatgaatcgcggtatttctttgtctaaccagaaaacataaataaacttttaagggcgcgcacatatatattaatattgacaaccagtagtagtagtttgaatcgcgacgagtttgcttagaatgatgtgcttttgttggaacttgctaaagaatctaggattggaaacgagctaccaaccaggaagatatgcatgtccctacgctgatcaaagatcacctatgcctaattctcacaggggctctaaaaggattaaatacactaacttttgggggttacaagtaaaactaattacgtgttgtcgaaaaaatcgtacctactcccttctccacaaaatgaatcatcttctgatttacccccagaagctgattcacttgaggatagagggtgtgtatatatagtagacaatatttactatgggacataaaaaaacgtgtaattagctaagagacacagtaaaaacatgaatttgttgaaggacaccacagaaaatcggtaattagctgctggacacttgtcagattattttattatatccgaataaattggagagataaacacatgtataactatagttttaccttcaattttttttctttattcttccttatcttctctctcattctttctctctttctccctgctctttcttcaaccgaggacggctgcacagcgaggcgtgggccagtgtggcgcctcggacggggaggcgctgcgcggtcatgcgcaggggttggggttggctcgacgcggtggaggtggcgctagaacaggatgggaggtggtaccggcgcggttgggcgtcggcggcgcgcaggtaaggcggagctcaacggggttatccgcatcacgtcggacgcgctgatgctagacctcctcatgctgcaacgctcgtgctattgaagcccccacagaactccgcgagctcgtctggcagcgacgcgaccaccaccttggctggggctcacgaagaaggtgggagcttgctcagcccgatgttggggcagctgcagctgcgagggagctgcttcggcccggcgggaagtggtaccacgccggttgcgtcttcttgtggtgcgggatgtgccgcgctgagctgccggccagcgagggtgccacgacagctaggcatgacgcatcgtaagagctccccagcgacaccggcatcttgtctggccaggtcgccggccgccgtagggccaccacgccgcctccatagccacacatcccgcaaacgccgcgctacctccgcccagccgctggcatcgccgcgccgcactatcctagccccgccgctacgtcgcgccatcctcggtccgtcacgcctagtgccgacgcccggccgcgcccccgtcgcaccggcgctgccgccgccaggtcgcgccccgccgcacgggtgtgccgctgccgctcgccacacccctccggacgatggagatttttttttggtgtgtggtgacatgcgggggcaatctgggcatttcgaaaaaaatctcatcacttttagctggaaaataataaaataatgcgtccggtcggtaaatttcacagttttttagtgtcctagagcaatgtcacgtttttacggtgtccctcagctaattatacaaattttatgtgtcctgtagcaaattttgcctatagtagtatgtcatccatcgaaaataaattaaatgaaaacaaatttctactcaaggttctagagccaaagtggttaaatgtttctttaaaaaaaactagttctaaaattcaaaattagacacatgacaactttaatgatagatcgagcacaggccaagctttttttagattggaaagtgcgacaagggtgaacaattggtctgaaaacataaagcacatcaacagcatgttacaattagagcgagtacagtagcatatacaagtctgctgtaaacacatgtggaggagagaagacaagagagagaagaaaagcgggctacagatttgtagccagctgcaatacggactctaatacgttgtgtgagtatgagaggtgtgacaatatattaatactatagtatatgtttatatgtaactattgtatgaatgagctacttcctccgtcccataatacaagggattttggggatgtgatactttctaggactacaaatctggacaggcacatcgccctaaaatcccttatattacaggacggatggagtattagatttgctataaataaattagagctagtagttagctatactattaaatttgctcttacacgtgcttgaagcccaaaaatgcaattaaaagaatgagtaaattatggtttggattttcttttgttataaaagttccgctttgaaccacacgctttattattaatgttttcactttagataattaaataaaaaaatacttttgttgtacatagaccgctcctaactctgccttaattacatcagtcttgcataccagtaaacttgtcaagctatatgtaggccacacctttatatatgggatgcgcctgatatcaagagataaagggggttaggatgatccaaagcaataagaaagggataatattacattgttcaaagtgaaaaagtttgataaatgtgatccggactaaatctttggtaacagaagtggaccaaagcaaattcattcaaaaaaacaaattatatttcatcctttgtaattttacatgatctttccttagtttttgtgccccatggttgtaagctagtactagctataacatttgtttacgagtatattccatgaaaacacttaattaaccacacaataaggatcttttatgtataattaactaatataaagctccgcgtgaaaagaagactaaagagattaatatattcatctcggaactgttgtgcttcaagaagtactttaaaatcggctaaactgaaagctgacaaggggatggggctatgtaggacacagaatacattttttcaagttccgtgtagaaaatattagtcaaacagcggtacccagctgcagtgatcacgaagggattctttggagtgataaagcatgaaaaaccattttccagtatattttcaaaataaaacaatctaagatattgtggtaatgtatgtgatcattacatgggataatcgttgttactgtctaaatattactatcgtataacggtattttcaacacggtaagaatgttgggatatttaattttaaaatttggtataaaattttaaaaagaaaattctgaaggcgaccatgaaccactataatattcctccttctgtctaaaaacaatctaatccatccttctgtctaaaaaaaatctaatccagaaagaaatatgacctcttctatgattataaatctagactgctctttatcaagatttgttacgctagaaggtcacattttctttgaggttaagagggtgtttgggaagggcaaacccaaacaccctctaagggcacccgcaatggttatctatagctatttaaaaaagatccatgtc

SEQ ID NO: 48448 - DNA, 19169 bp, Oryza sativa
atgtatatgttttatagagaacaccttactttactattgcgggttctctaagtatttttaggaccatgggagtacagtataggccatagtcatctataggctagtagctctacaggctgtactgaccgtaatgattcagccatcctttcggactatttaaggcagctcttgtgtgcagattcctgagccatggcattgctccttgcctccttccagcttctccttcagttccaggccgatagccagttaaacccaaatatacatctgctctttcttttgcccggttacagcgtagcttctctcaatgctttgcccccctcattccatttatgttttattcctgtcatcttcgtgacctagttagtttcttaattggtgttctttgcgataataatctgaagtaaacaagttctttatgaacaccctcactattctcgtctccattggattagcagatgcagatttaccaggtttccttttctttgccgcgttgtttaagatttccattgtatttcttgttttgcaattcatttggtgctccaagattgtggctttgactacatgtgtaagaagagagctctcttcagtccactctcagatggctgtagggttttattagctgccgaatcatccattcacctaccaagaaagttgcaggagtgtatctcttggtagcggactggatgacgcgggagctaaaatttagctctgcgccgtttgtggttggactgaagggtgctcccttgctcaagcactcgtgcataaaatcatgccctaatgttaataataatcttcagatttctatatgagttttatgtccagtgtgttcagtttcaagatttggactttttttttatatcagtggtcaatgacctgggaaatctacagacagaaatctactgaagcattgactagactatccaagcctgtctggatatggcttgtcatcaacagtgctttatcatcattcttaagctgtatctactgaagtatgatttgattcggtttgtgtttttactatactggtgaggaaggaatatatgtccccaactgtatgctgttattgtacatacaatattcagggtgtgtttagttcacgctaaaacttaaagtttagttaaaattggaacgatgtgatggaaaagttgaaagtttgtgtgtaagaaagttttaatgtgatagaaaagttggaagtttgaagaaaaagtttgaaagtaaactcggcctcagttcaaaactacaggcatgtaaagcattattagttaaaaatgtcaacgttaacattattgtaaatgtgtctatgcatggaaatctctttattcacatcctgcggcccgtacatattgcataagtgctcagattaccacgaggcctagaaggttttactgagatcattgccgaaatccactttcaggggcagctagccagctaaacattgactttctgttactcagattcttcaggtcagttaattcagaagttggcagtttgttaatgaattctcttacggcattctgtaactagctagctattgtataaattaagacctatatttaatttactatttgggtagagatcgatgagttatatttgtgtaaagagtgattggatctactatctctaggatctgttgtagggaattaaacgcaacttcaaggattagtggtgcttacatgcatgcatgcacattggacacattgagattgatctgttgtatacatcatcagaggaggatgtaaacccagaggacatatactagtactatatggttaaggatggctttcccggaacatatatatcaaattagcaatcatgtagtatttttcttttgcatctccatcacaattatattctctgtgtatcaggcatctgacaaattcattttgtcaatgtatcctctcgtatcagtatgctgcagttatgactcaaaggcatactcgaaaaatggcgagaggagtcaaggacgactaccggtctgtgttggaatttggaaacgtttgaatataacgtatgaactgaaattcctgtaacgctggaatgtgagattccagattaccagctgatacaacgtatgaacagaaattactggaatgggagacttaaatcctttttcatgataataagtatacatatttcaagcgcatgtgttttagttaatattcgaagtaccaagtgattacgtgattattatttttttagagcggggtgattacgttatggcaatattgtaaaccgtcgcagggcatacattgtgttcaacacagtccaagatgtactgctagctgtagttgctgtttgcctgtccacgagaagacccagtttctgctggtgtggaattattttttgttgtgtgtgtgtgtgtgtgtgtgtgtgtgtgtgtgggacgaaccatcttatccaggctttttataaatgaaggaaaagaaatgtgtacggcctgttacggctgggaaaaaagaaggaaaaattacagagccgtacgtgcaacatctgcaaaagccttgtagggtgggacttcagcaataagcttcgctaccgtcctctccatcccaaattatgagattagcatacttggaatgtactgtaattgtataaaccagttttgagagtgcacatccttgttatttaagcgatatcacttcataaagaaaggtaaacaaactaatatcacaagtgagaacataatcggaaagtcacttttacacttgttcttgttatatatatatatatatatatatatatatatatatatatatatatatatatatatatatatatatatatatatatatatatataaaacaggaatagatatttagtgtatgtatgtatgcatccctctctattaattagttccttcaatgtattagagaagtcctgagatgacattgtcgactttcttcatctaattaatcggttcctcaaggtttaggccgagtttagttccaaattttttcttcaaactttcaacttttgttatcacatcaaaacttttctacacacataaacttccaacttttccttcacatcgttccaatttcaaccaaactttcaattttagcatgaactaaacacacccttaatttttttactagcttgcaaatagtgtgaaaatatatacatatgcgaggatgaagaaacctcttatgtatatatgtatagtgtgagaaataaatcaagcatctacatgtatctggtcttaaatttattagcacaacattgaaacgtagaattcaacaaacgtaatgagctgaacagagacaatagctgtacaacttctgtcataaatcatataccatttccgcagctgccaaatctatagtcctgtagatgggcgtgcttcgttctcttatttcatataagcctttccacattctgcagaaacatcatgtgattattgtgaatctttatctttactcctcaattaaatatatgaatggatagtcgtgtataaaatcaaattaagacggaaaaacacgagtaacacatttaaaatatattttatatacaagctttagataatattataatttcttttatccatcataaagcatggacattcagctagttattagaaaaaaaaaaggaaagggagtatctagaaaacattcaacaaatttttggttgaaaacatttttttgggggggggggggggtggttgaaaactttttaaatgtaattatagtgtaattaattagatgtaataatattgtaacttgcatgtatggcatatttccatcacaaaaatcacgtagtgcagtgttagcgcactcctagcaggaaggcaaggtcacggttttgatccatcataagcgcaagtaagttttgattttttttcatccctgtttgcactgatcttagagccaatataattgtctattaatcgaaaatttcccctataaaactatcgacatcaattcagcttttctaaaagagaaaaaaaaaactcgcctgtctgtccccgctataccgtagaagcggaaaagcatgtgcagagccaccgctccggttagcccagtctcaccggcgaaaactctattagattttaatatttttgaataaattggtgatgaaatttttgtagcaaataaaagttatagctaggtttgactgtacttaaaaaaatttctaacaccgccaccgcggaaaagtacggcgtcccacgtgcatagctcccggcctgatcggagaaaaccctaataaagcagccgatagatcgaccgatcttgcgcgcgcgcggtcgatagggggggtggcaggtgccaatgatccgcgggcgcacggccggttttgtaacacgtgccgccccgcggccgttgccgcgccgatcccgacgcgcatctgccgttgccgcgcgccgccgcccatggccacccgcgcgcgcggcgccaccaccaccgccagctagcgccaaattaagccagcgccaaggcgaatctccctccgctcccgctccccccgcgcgcccagatgctgcgccacgcgagttggatcgatgctctcgctcggctaaaattcctccaccgctgcacgaggggtacgtatggtgtgtggaccgtgtggtggtggtcttttcctatgtatgctgcctcttttcaattcctatatatgctgcccccacgagattgtttactcctccccatgccatgctctccacggttcgatgcccccgttgttgtacgttgttgttgcctctctctctctctcctcctcacacaccgccaccatgcatgctttcccgaggagttcgaacaagtgtacgccattaaacttgtttacaacaccataaatttgttcggaaccatgagcaagcaagctgccaagggtgatggtgagcagaccagtgatgagagattaaagaaaagctgggcgtgacatggcgcgcttccagccatgcacgggggggttgcatggtgggcggccagattcgctccatccaaccatcgcagcgcaggtgctgcgtggggtgggtcgtattctagctaatagtactccagtaggcaacaattgccttgttcaaaagctgccatggcgctctctgatgcattccatgctctgcatgcacgtcggtggatgtgtggagcgacggcgagcgaagtgatcacgtgtgccgcacaaactctgctttattactcggagtagcgagcttgcagctgttgcttactgttgtactttagtaagatcatggcggcgctgagatcgctttccgtttgttaagaatagtgactttacccgctaactgttgcaggtgggcagcacaccattgagattttgatatcaaccgttcgaagtagtaggtcgcataagaacaagtacaatagcatactataaaccagctataaacatattataaagagataaaggaagagcgatgagcaacgggctacagatctgtagccagctgcaacacggactccaagacgtaatgtgtgtatgacaggtgggaccagatattaatagtatagtaagcaaatattatatgaattagctattacattaattatagatgatttggagttagtagtgacctatactattaaacttgttctaaagaaaacaaaagaaaaacctgaccaaactgtttttataccctggtcatacttccgatacggattcgtatcatatgtatttcccgtttcaacggctaggtttgtcgtaaaagatctagatcatccttctctcaatcaacgtccacgattagtagacgttttttttttaagtcactgcacggaagatgcgcacacctacatgaatagaatcggtcagaaccaacctgctgaatccatgttattgcatatttaactgttgaacgcaacaaatcttcatcgattctgttttattcgtatctttagataggcagatggtcaaacgcaatctgtatcaacttgaaactaattaactaatgtcagacgcccacaaaaacagtaataaaatagaaatcttgcagaggaagaaccgtggtctgaaaataagtaatttgtcccatagttttctaacaataaaatagtgctcgctctcaggtctcacttcgattaatctaaccagcatcaatcagtcaagagagagggatggagagagagacgaccatcagactgaaaagactttgatattggtcgagatcgaggagctcaggtggagcgttcctagcttcagattagtttctgttaatccaaatgctaatcctgttcagatacgcgcaaaacaaaccaccaatcgctgtgtcaggcaatagtagagccgtggaggtgctgttactacaagattccatattcttgcgtcatggatgaactccatatttgccacagcatagcgaattaacaatggaggccagattggtgggtacaccagtgcactgtactccttccgtcccttgaaaaacatgtctaaaattaaatgtgatataaattagtataataaatcggaacacttacaccacattcaatcttagatttattttttttaatagagagccaatttctaaggacaaaattggataaacatatatccatattcatcttcaaagttgatttttttaatggaaggtgtacgtagcaccctaccctcaggcccgtccccggggcgtgcagcctgcgcgctctcgcagggccccgttttccaagctccctaggcccatatacgtggcctatacgttcttgtccatcggcctattagacaaggaccagaagcaagaaggcctggtgtgctggtaggagcgtttgcccaaccaaggacaacgagagaccacatggttcgttttcctttctttagatcgatagcattgcgccgctcgattcactcgtctcgtctgccgccggccgccctttcgcatcgctggtcgccagagtggccttaccgtcatccggcccgacccgccggcttgtttcgtgctgagcggcgaggaccgtggcttccgccagtcatgtcgcaggtggactgctagtgtatttgctcaatgcacttccaggacttcagcccttgagtagtactaagcgctagtgttggggtgtagaaaacaataaccacccatagttactggactcttctgaaatctgaagcctcaagagttctgtagaacttctggggctggtgagtatttgcagctgaacagcagcagcaatgtataactggcggcggcggatagtacagttaagaactataggccgttttggattaaagctaaaacggtgccctaccaaaattttggtaatttaaatagtaaatatgttagtttggtttgaagccaaacaattgataaggccgatactcaatttggccatattcttcatcatagtactaaaatttggctccatattggtatcaaactaaaagtaggctaattaactttaccctaccaaaaaattggtagtgccacaatatgcctagattttagcactaccaataaataggtagggtagagaatcaaataggcccacaccagagttacacaaactatacggaattacagaccaacaggccagggacaacaggcaaataggtttacacagcaatggaacgtttgaccgtcctttattattattattatacctctgagcaaacaagcgtgcgaatagttggtgctcggcgataataatgaacaaataggtagtgttttacatagcggatgaatactttaaacaatcaatttggcacaaacaggtgaaattccttgcagctgcaggttcgaacctgcagctaattacatggaagcagctataccgcagctgaaattacatgcacagattatgccgtcacctgaccaaaaagaagcttccggatctgcaaggaaacgggaagaagaatgaaaatatgaaggtataaccatttgctctgcatgtgctgtagcctatcagggtcattgttaaattgacaaataagaacatgcaaatcatgtttaaatgttctagtggtactgaactacttgtatacatggttgaaactttggaattggtggaacaaaatgaatattaaaatcgagctaaacgaaggcacctccggtaatttcttgcggaagacaacttccagcctggcatcaagtgtgttctcacacacaatctttccatctcgagaagccagcacaacacctccagagctgcataaacacattatattagcataaacagcaggatccatatcaggattaagaactacagtaaaagtattgaaattgaaacgaagctatggatttcaaatcccaactgctgtcctatactagaacatgcagagagagagagagagagagagagagagagagagagagctgcaacaggccaatgatcacttcattatgctatatcaggagctgtagtgctctcttcccatattcaatcagttttaaggtagacggatgtatttgtggcttaacctagtgcagtattacactattcagcatatcaactgttcaataaatgtcataatgtatgccaaagcaatagccagataagagctgattgtccaggtcagggtagagttaaagtcttcagcactaaacttctgattaacaggcccaagaccgacctgtatactcatattgatgttattttccaaattatacatgtttgtagagttactgagcagattatctgttagtccaaaagatagctttctttcttttagtatatttgctagactgttactagtagtacagatatacagtagcaaattggcaggctgcaagggtaagaaactatttattaccaaaacctctcatgggaatcatgagagcttggagaaggcggtaggtacacatcgtggtcaacaagtatctctgggtgatgaacttctgcttttgacgcatattcattctttgctgaatgcagtacagattccacatgatgatggtcttctttgcggcaacggagaagtaccgctggctctttcaaccgaagcaaaccctgtatttccagtcaatatgatgaatgattattttgttaataacagtagtgaacaaacaaggagatggcatttcaaacttaattccatcaattaaattgacacgtccataagagaagtttaaaggtgaatcataaacagatgttcttttagcactagctcttttgtgcatgcagttagagttgcaaaactacaatgtgatttaacacttcaatatccaataattcagttctgcgtatcgaacttaactatataggtgaaaccctcttggggtccacaattatcagaaggatcgctcaaaaaggcttaatggataagaatctagcagatgatgtattcaacatttcatacaaacctgaacgacgagttctttcaaaaggttcttgtattcatggtggttgtggctgacacgcaggagttgctttgtagcatcctctttcatggaattaaccaaatcatcctgagcttgaagcactttgatgcgagaagcattcagctgcatagagtactcactgataaaggagaaaacaaggcctcatcagttaacaaatggataaacccagaaatagtgatacaggtggattctatgaaacctatgctaacaagcaatcagtaccatattaaatgtaatacgcaaggaaggtaaacaatgtttgagtatgcatgttatgtcagtttgtactttgtattaccattttgtcaaatagttctctaactttttccatcgtaagattgttaatgtacaacttttattacatccagatcatgattgatacatactctcacttcaacagacattgaactgcaagcagcagttcacacaattttgtctaaaaaataaaatacagtcgactcatcagtgaagtttactgcactgaactacacatccgaatttgatttttaagtgtctcaacaaccagtgcagtcaaattacgattactgccaatttaaccatgtggctgaagtagtttgtagctagcttttactactaatgttgcacacaaatgagaatccagcattccagctgtatctaaaatgtattgaggcattgatgtaatgtactgtatgctgcagaaatcctcaacatgaaatgctgttaatgggaccatacggagaacacaggaaaacataaataatttgaggaatcgaagtctcacattttctttctaacttcgacttgcttctctttccgttcatattcttgcctgatcttctttttctcagcttcaacaagttgaagcttctcaatattgaactcctgcaaacacattatacaaataagttaacatatggaaggaaatcagaatggttaaccaactgtcagcaatgataaaggcatagtggtttatctggtttgaggaatgagatggttaattgagccttttttttcggatgatggaagtataactctgccttgcatcaaataaggatgcacacagccaactaaggagctaattgacaactcagtcctatatgacttgtttactttgaggaacggaatgggtttgaccatcatcacctatccctcaaaaacacacttagtggagaagtgaggaaaggatcatcccacgaaaattcatgggatcatcccatgatttatcaagacatactggatggtttggtttctaaagccaaacagcctactaaaatctgaacaactgactcgtcaaacaagtacctgttgtcagtcattggtattgataaaaggtggggttgaaaagaatggacacgcaaacaaaacaagcatgtatttccagaagattaataactcattgtaatgaaactttcttttattacaaacatgaggatgcccctgttgcttcaagaataaatcatacttccagcacagttgtagtcagaaagcatattaaacatgttcatgtccgctggaccttatgatagtaaaaggcgtgatacatgattgcacaattgatgatgcttgttggtagcaaacatgattgccaatcatgcacaccaaggggtgatcgatcaaaccatgcaggtggatcagttgtattcagctgaaatgacaagctagagcaagtaaaaatgatcataacagtagcagcccactcagcaagtatgttgcttgacattcatcatggccaacccatcatgccaacaagcaatagaggtgttcatgcatcctatctccattatgattgcattgacataaaaaaaaggaataaaaaagtttatggctggttaatggtaatggataactacagctcataagttggcaggtgatggagggtggtgaccagttgttgcaaggatttcctttaaccatgtattagtacctctttccgtcttctcattgttaaccttatcctccaattgtgcttctagcacaatctagaagcgaaatgggagagtgaacagatcaagcataccctattcaagtttcagttcatcttaagcccaaatctcgcttctagaatgatctagagacctttggattagactagcctctcttatcgcaattcaagccacaactggattcaggtacggactaaccagtagcagagaagggcggaaacggaacaattgaccatccagtgtggcagtacttcctagtccaaagtaagaaaacgagctttattggactagaaactcgtgatctggaagcttctagatccacgcaccgagatctgctcaagcgacacaccccggatcccgattcctctcgatctacctcggaaccagggagcctattgcctagacgcttcgactacaaaattctcgtcccagaaaccgaaacctaacagtcaaaccgctcggatcctcggaaacaaggtaggatcaagtatcaacttctagctctcgacgcttcgagatcacgggggggcaccaggcagatcgggcgggtgaaaagcttcggaggcgcggatcgagaggcttcccgaagcttcgacgcgcgggggagaggcgaggcgaggggaggggtaagtactgacctcctcggcggagacggagatctcgctggccttctcctcggcctcctggcggatgaaccgcaccatctgctggatctgcttggcgacatcggcgtcgttcatcttggcggcggcggggatcccgacggcggccctcgcggccttttgctgctgctgctgctgcgctccggcgaaccaccaccgcgcgcgggggaggggagggaaggggaggagagaggagtccacgggagtggtcgagagagggaggagggatggggagtcgtgggactagtctactagcggtctagccgcgcggggcaacgtgccgcccttggttgccgctgccctgtcgatcattccgtggacgcggtccatgggtccgtgatcttttctctctcgttttcggtcgctgtctgtggcgctgtggctttgtcgacagctgttttttcgttaagttgagcgccactgttacaacatctttgataggtgtggtttagtaaagaatttcgcagaataagtatttccgtttggcaactttggtattaatagcaggttatactgagctgcaaaagggtgtatacatatttatgtttattcataatgagatgggttgtacatggatataacctttagataataaaaggctctattaagggagacagaaaaaatatatatatggttcgtaaaagggtactccttttgtaaaagaaaaaactcaacctagttaaaaatgagacacaatagtttaacgaatctggacatgattatttaaataataaaaagaaaaaatattggtaaaaaggtattccctctttttaaaaaaacagcatagttggggatgttatataatatggagtttagtccaaacgaatttgaacaggtacctttccatattcattgtaaacatagattgtgttcgaatcttataaagattcagattaaatatgggcatgcaaaaaaaaagctattagcatatgattaattaagttttaattattacaaacttgaaaaatggatacatttaatattttgaagcaactttaatataaaaagttttcactcaaaacaagtcgtttaatagtttaaaaagcgtgataataaaaactaaggtaaaatctttatctttacaagaaatgaactaggtcatagtgtctatctatttgtagctcgcattcaccatgcaaaatggatgagtcgtgtacctattttctcggttgtcttattgttgcaattgcttattaggcaaggcaaaataaacactcccctttttttttccccttggacttgactagagtacataaaaccggacaatcatttcttactagatttaaccattttgactctagtatacatctttagtgctgtgtgtgggaatggatgataagtattttttaaagaaatacggcctttactatatgttaaaacaagaaatgatactacagatgttagcttcgtactataccaaaatgcaagatcctctcggtcaattaaatataatttttttgttgaaatcgttgattaattgggcatcctcttctttttacttttaggcaaggcatgagttcttttttaaaaaattcagaccaagggagttagcatggtttttatttttaaaccgggtaaaaaccttacgacatcatgattatttataagggaaccgacaaaagtcataaaacccacaagaaacgaaacatgcaccaccacaagtcagtgagcaccaaaatatagagtattatcttctaaacgacacctccaaatagggatctggcgcatgcaggcatcggcgatgcaagcaatagctagaggttgagcaaggcttttacccagagcttccacaacctaccaaccatgataatgggcttgttcaatttctttatagattataaattatcgtggatatattttataaacttctaaatgatgtgaattactttgaaagaaaggactcttcatcggtatttactacaaaaccttttaaaatcaacttatcaactttataatatttatatatctcgtttatactattgaataattatcataaacccaatttcacttattatcatcaactatcataaccatttttctaaaaaatcacagaatacacgtaggtgctcatagcgcgcctgtgaatgtatagacgcacaccctatctctatgaacatcactaaacttcatcactaaactggaggtgttctatgagaagagggcggcatggaggtcttcaggcatccaaactaaggctgtgttcggattcaacggatgggaactaatccttcccgcacgaaaaatagagcggtctattagcatgtgattaatgagttaatagtattaatcacacgctaatggactgctctcattaatcacacgctaatggaccgctccgttttccgtgcggagggaataagttcctatccagctcatgcgaacacagcctaatgcatgtatggtggttggtttttagagtagtttctgacttcctgtgcacatgttggaacgcttagcctgggtgtcgtttggatagctattcgagccaacgaataacccatttttatcctttgtatggcattaattcttgaaatctctctcctactagtactatgaaaagagagtcatatcctcctcccgttcttaccggtcccacattccagaaaaaaccatttacatttctaaaaaaaaatcttttttctgaaaaaacatgccttatatgctctattcgtatcaaaatagtacacttaatttaaaaccaatatgatatagatgagtatacttattttaaaatggaggaagtagtttcattctctctcttcgatctctctcatataccttagcgaaaattaaacatgtcttgttttatttacaacactcacatcccattcacatcccattgtacatgtctaataaaaattatacaacgtattattggctgtcccggtgaaaaacaaactatatactccctctattttcttctgataatcagtatttttgttttgagttctgacaacaagataaaaaaaaaagaggcataaccccgtaacccattttactccagggcgcaaagactgtccctgtgttcctttgcatacgaaccaattggccatgtaaactggagagctaccaaaccatgcatgtgaaagcaattactgcatgcagatcaaacaatcagtgtatgaaccgaacagccatcaagcttatacattgatgaaagaaaaaaaaaagaacgaattaccccctcaattatggaggtcgattgaattacccccataactgcaatacgggatatttgacaccataaacttttgaatccaggttaattatccccctaacaaaaatcaaagtggttttcagcctacgtggcagacacgtggcgatacggtcagcaaaaataaataaaaaccagtggaacccgcttgtcagcgttgttttttctatatccccattgtcccccttctttgcttctcggcgagaggaggacatagcgtcggcggcgaggtccagtccgaatggaaggggaggaagggggctgcacgagctcgcctatccctagcatggcgagtaggcggtcgacggccgatagctgggaggatatggtggggcgcgacggggatggcgtggtaggggttggagatggtgggccattggcgaggagggcgttgaagacagcagagcaacggtgaggtgggcttgaggcgggggctcgtcgatcccgtgcgtaggagctcgagtttgctcgggggacgtctctgctagctcatggagggcatccaccgtctcatccagatctggcggagaggcgaggaggaggtgggaggtagtgaagatgtcgtcgggcgaccgacaccgatagcagcacacccgtgaagcttggcgttggtgaattaggtgcgggagcggaggaactcaaggagggtgcccccggggtcgccagtgctggctccattgtcgcgacagaactgaagcgctcgtcgttgaccacaaataccaccacctctaggccgcacgccatcgttgcctatcgcactgccaagcgccgcccatcgtcgaccattttcttcccgaaaacgctgccgccgctcgtgccctaccgctcgccgctacttgccaccgaccggagcccgctgaccggttccccctcctcgtcttgcgcacgtgcttccgagagagagagagaaggggggagagagagagggagagagagattaggaataggtgaagaggaggtatgataagtgggtcccattattttttttaaaagagaacggctaactagattgccacgcataggctacgtagaacaaaaccattctggattgggttgagggggtaattcgtccggtattgaaagttcaagatgagcaatgtctggtttttcgggttaagaggttaattcgatcgaccgcgatagttcgcgaggttaattcttacttttctaaatgagaatagtttcatcttgtttaggcgctgataaaaagggaaaggagggagtctacataaaagtatgaaagagcccagatcgcatcttgcctctgccttcttacggaatcttcaagtgtgccaccgtggagtggcgcagcatcacgtctccttcaccaattagtatataccgccgtttcagggcaggtgattaggtgtcgccggcgatgatagccggtcagacgggcatcaggatgggaatgggtagagtcgatccatttatccattaaatctattcgtaaatttgtcctaacggattttaaggtcggtccaaaaaatataaatggatcaaatggctcaaagcattagaacctaaggtttaagaggttcgacccaaaataacttcacatgtataaatattttaaaaatttgtacaaagttgcttctctatataataaatcattcctataaaattcaactaaatttaacaagtttttatagtgtgaacgtgagtttaaaaattttgtgttcgagttttacacgcatgtaactagaatttttaaatcttagtaatgctcgtgggccccgtatgtctaaatgacttaaaatttgaacaaagttgcttctccatataataaatcatctctataaaattcaactaaatttgatatgtttttataatgtgaatgtgagtctaaaaatttcaggcccaagttttacaagcatgcaataagagcttctttttttatctattaggagcgtagatgatctatttatatattcatagataatctattgatctaatgaacttataatggattgaccgtattaaaccatagtacaataaacttattttatttaaaacggtttagactcgatccatgtcctacccattcccatcctgagacgggcacggcacaggataagctgataatgtggaggccccgcgatctggcgccttgtcgttggctcttctctaatctttttgcacgctacctctgggccccacgggcaacacgcacgcaggcacgcgaatagcgggctacgtggccagaaggcaacccgatcgcgacgcagctgcagctgcgcgcacgcgcgagctagggcctagctaccgtgcaacgtggcgcgccgtgcacggcatctccgagctccaattgcacgttagatggtgatctcgaaatctgttgcacttccagcttggttgcagcgtgtgccaccgaaatcaagcacgggatcaaccagccactcgtgctagcgatctacgtgtatcaaaactaaggaacacgtagtagctagagttagtaatatttttagctacacacagaacacgagtactagttcgtatttgtcactagaagagcacactttttgcaaattgccgcccacgactatgtcacgaaccggcccgtgaatttttatcaaatatactataaccattgctaatgaaacgatagaaaaaaaaactaattctatactctatgtgctgataaagcagatctgctgactttagttaagccaaatccgcatgcagctgatcaccgagatgccacggcgccgaaccctttcctgcgtgcgtgtacgcaggggagaaccttcggcccccgggttggtggggcccaggagggggcggagcagcaaaccacgtcacccacatgactaggctacccagctggccctcgtgggaggcgcgggtggacgcgtagagccgctccggtagagacacgtgtgccggaagcaacgggtgacagcgtgactcaagaaattaaactatccgccacgttgcccggctcacccacccactctacaccggcgcttccgcaagggacccaacgaacgccattattcataggatggcccacatgtcatcctcatgtactctaacaatgatattttatttttctcggagaataatgatgatgacgatgataataactattacaattattaaaagtgaataaagaaatatagacatatgagagaatgcgtgatttttttattaaggtctcacagttacaatttagagatagcgactaaaaaagtatttgctaaatcgacgcatatctgtgaatctgtttacctgtataataacagattttgttaacgaaactgcacccaactctgtgggtacacgaaccgggtgcctcgtagcgaaacagcccgcgctcgggcctaccccgtgtatcacgagccgacacgtgtctcctgacgtggtaccctttccttccgcgccgcctccccactcatccccttccccgcaaggccttctccctcccgtcaaatcaaagcaccccgccgcacgcagacgagaaaggaagcgcgcctcagcctcagtacccaccacctccacgctcgcgccgtcggcttcgtgctcctgcgccgccgcaccgatctgcaccgtacgcgggcgtcgatccatccaaggtacgcgcggcgcggccgatctctgcctccctctccgtgttcacgcgcaatgcccggcccctggttcgtcttctctttcgttttagcacttcgccgcgagggtgaaggtttgtagtagcggagagcaggagccaggaagcccaagccctccctcgttcgtccctgaaattttaacgcgtttcgtccggactccggaagatcctctgttcgatcttgtagcgagtatattatcatacttctactgtcgtcgtagtagcaattcacctccaaaaaaaaaaacaaaactgtcgtagtagcagtgattcaaatgcattggttcggctttcttttgcttcctgttgggtttaaaagcgaatcctatggccacacgtaggaagcgtgtacacgtttcttaagtttactactagtatatttttcgttatttcaaacagaaatgaaattatttatgggaaaaggtgagagttgagtaattggaacgccgattttcccggtttcactatttgttaggta

SEQ ID NO: 48449 - DNA, 18694 bp, Oryza sativa
  unsure (1)..(18694): unsure at all n locations
cgagtaaaatttttactcgtgatgacgtggacgaatctcagccgttggatttgttttggagggccaagattcaccctatgtcaccttgtgacatgtctaccctatgtcacccaatcccgctagaggcgaagaaggaggatggcgtaggagagactagagatgagtaagacgatgaagcagtgacgccgtgatggctcactggaaaggaggaattttaagtgtcggattgctgtacaggaatgcctgcacaagctaggtgtgtctagtggtttttgtacatgattgtgcgatatctatgggcctgcaagagtttcatatctgtgcatttagtgaattatattttttactgaaacatacttttttgtgtgactattttcagtacttatgatatggtttagcatatgaccaatctgtacgatgaaaatatgcaggaactcataaaaagtcatgggaaatgacgaagctgtagttactcagaagatggggaaagcaccatcgccccctaaggtaaacgcatataagtagataaccaaggccaaatatgggcacagacaacattgcacgagcaagatgtcaaattgattattggcatttcttcttttatttgacaacataaatccgctttgaggttttagatgtgctagggctgcatcaaacagctgcgaagcatgattttgtcaattagccacattattgacaaggggtggaatccttaaaggtgcctaagtagcaactgtattactttgcaggatcatccagcccttagtccataccttgattggtcaaatatgcaggttaggtgtctgacaatctatattttcctgataactgaagtttggattttcctttgaactgagtaactaaatttaaggtatcataatcaacacaggcatattacggcccagggatcttgccaccaacattttttagccctggaatagccgctggtcatacccctcctccatttatcttgggtcctcaggtttttgactttactctccatgtatcaggtgtcattcttatctttaagagttctaagttatttccctgtgcctctacagcctctggtgccatccgcttttgggaagccatatgccgcaatttatcctcctggtggagctttttcacatccgttcatgcccctagtaagcatttcattttgttcacctatctatttttcagaacattgcatttaactaaacatggaaggcaccatggatttgagtcaactatcacgctttggaattaaagcgatatccaatttgttaaaatgcttgcataaagccatgttaacatggaaacttctctatgagcagaactaacacgaatgatttctgccgttcgaagtattcatgatatgtagttggaacttggaaaacctatccttgcagacgaattatctctacatgaaaataaattcattcatatattgccattttttctgtagaaggaagctggattttttatttttttttcttctgtggaagtatatatgtatttttaaatcatttgttcaattgttcttttctttaatgtctttcttgcttcacttgtgtgaacgttctgtgctgaattgctaatcgttttgctagtatcttaattatgcttctgttattgattgtttatcttatattttttatcaagatggtgagcccattgagcatggagccagcaaagtctgtcaacagcaaggatagctgttcaaataagaaaatgaaggaaattgatggtgcggctgtgtcaactggcagtggcaacagtgaaaaaacaaggtgatacaggattttacaaaatgaaaacgataaccagattgatagttcaacttatatacaactattatgagtgacaaactgatttcatgtgcatctgatgctgccaatgcagtggagattgcagcttagaaggatccagtgatggaaacaaccagaaggtattgttctgtagttatttaatgccattgaagatgttctgagccagcaagcttatacttaacatgctgatatatttcatcattattcaggcaagtggaactcccaagaaaaggagcatagatgataggcctaaatcaggtactcaatcttggtatcatctggtacttgatttttataatatccagttcaatgactcatcgtgaattttgcggcatttcttgttatttctctaattgataactgaaacataatataatcctctgtttaagttttcagatgataagaaggccatatattctgagcactaagcaacactaagaggtgatttggtttttgtttttccttttctccaggcgtggaaactggtggagctttaacacctaatgatagacctagcgaacaagcagctttgccaaatctatgcattccggttacagcaatcaaaccagacgtgagcactgctagtgacttcagagttattgccaccccagtaactgaagtgccaactaaggtatgccagttgcagttttttttcttgttaaagtgccagcaaattatcatttagaaaaggcgccactaacttcgtggagtgaaccatgatccatacttggacgaagcaatcaaatttcttaatgtttccactaccacgacttcagtagaacatccttttttttttgagaatacaacatcccttatttattactgctgttattttttgggattaattctcgagtcgctagtatggttttgctaaatagattgctggagctctttgcattctttttcttttaaaaaagaactacacattcattccagagagaaacagaacaagacccgtcccagaaggacaccctgagatagcaacaaaacacctcaccaaacaccactgtcaggacacctaaatgcaaagtacctagatactcaataaaaaatgagattcactcttgagatcaggaattttcagctttcgattcatgggatcgtttcttcttgaattaaactatagacctataatccttaataaattgtcaggatgataaggaatcgaagcgcgagagaaggaagcaatcaaacagggagtctgctcggaggtcaaggttgaggaagcaggtataataagatgcttagctagttttaacttgtaatgttttgtggtatccccttcagtattccatactctagtagaaatttaaaccatacttgtacaataatgatattctttcattctaacaggccgagactgaggaactggctagaaaagttgagctattgactgcggagaacacatcccttagacgtgaaataagcaggctaacggaaagctccaagaaacttagattagagaattctgctctaatggtaaacatcttttctaacaatatgatcattggagtattggagctattttcattgagcactagtccttttttttcttctctcaaatgcgccttgtttaacaggagaaactaacggaaaccgggcctgatgaagcacaagaagtgcctccagtcaaaacaaaagcacagcaagctcgaggcgtcgaaaatttcctgtcaatgatagacaagactggcacgccgagaagcagcgggcacatggatcatgccattgccacgcccaagcttcgtcaactcctgggctctggtctggcgactgatgctgtagccgcaaggtaatcttaacgacttgaccctcccgccgttcgtgctcaaacgcagcatgtggcctggtgaattttataagctcaacctgcccgcacgattaacatcgaagtattaggtacgattttgtcactgtattcgcccttgtaaattactagtagctgccttttagacgagcattccaaccgctccaccgggatatgaatgcccccctggccgtcagttcttccctgagtttttactctactctcgtagatctgtaacatcagtgctggctcgcgttgttcatatcaaactgatctctgtaaatactgtaacactgacagaaagccttctaactttgatcttttacctttacctgcttttggatgatccatttttctctcctacgggtgtaaacgtcgtctttttctttggttagttcgacacataacattgtagccgatgcgatcaacaccggtggttgttcgcttctgtccttggcgtacgacatgttctttacggctttctgttgatacggctctctattgatgatcgataagatcacacggttgcatcagcgatgatcactatgcggtggccggtgggcaattactcgccggcgtcctatgccattcgtcttgtcgacggaagcgctgtactccgttgaaagcgagaacagaggcaagggaatctccggttgctgctcctgcacctcccaaacatccgccatgctgttgccatgactatgggcatgtgtgagacaacactgtgacagcaaattcaggcttgaaacaacttgggcattctaactactcctacgtttaaaacggtatcagtatggcagagtgactcaagtgccatggtttgtgccagcaaattcaggctcgagagagaggtgcgtgaatttcgtgatggttttggtgaggtcgtacttgtacggtgctgatgagctgatctgactgcgtggttggattgacgcatggtccagtgctgtgctgttagcttgggccctgcacggtattaggccggctttcttttgactcgactagcacccgcgtgacccttgactgaattggtaatatcgatgcatccaattgctgcaaacgggtcggccgctagctcaccaccacgacccagagtccgaacatgctaaccaattttcacctgtcaaggcctcaagggctcatggcaatgggcaaacaggcaggcgcacgccacgtacgagtggaaaattgttaatacagctttcatctcttaatacagaagtgattaaagccatgtttgtttcagcttaaaattattgtaatctagattattaaatcagattactctaagctggattataataagctgatataaaataaactacgagttgtttgtttctctggattattagaggcatctaagggtactgggtctttagccactcaataatctagaaaaagcttctctagaggagattattagattataataatctgacttatagattataataatctagcataataatttacttgtttgtttcagcttactcctaataatccagattataataatcctaagctgaattaaatagggcataaggagcgcaacaataccactattatgtatcttggccaaaggccatgttcatttcttctgcaagtaaaggattaaattttgtatactcgtggcacgcttttcaaacgactaaacggtgtgtttcgtgcgaaaactttctatatgaaaattgttttaaaatatcatattaacccatttttcaagtttgtaataattaaaactcaattaatcacatattattaccacctcgttttgcgtgaaatacttaatctttatcttcatcttcagaagattcaaacaccacagtaggccatttccattagtaaaaagaaaacggcagtccaacatttgagaatgattaaatctagagaatgtccaatgtttatatacctattttaaattcatccaattttagataggaagatattttaagattcatgtaacacatgtttctctaactgtatctccttattttcctatattgttgtcgatcgacgtaatcacattttcccttgtaatccattgtctcttccccacatgcatcgcctccttctgcctagctagtgcaagagcctgcaaatggcaccagcgaggcctaccaaaccgatctcgacttacccctcccccccaggcgcctttctcttgaagctaataagtggcaaggtgccctagcccctgttgttcttcgttgtcttagcaacataaagttcatgccgtggagacgtctctgcctcctaaccttttgtagatatgatgcccctgctactacccttctccaaactcatggcttcactttgttgtctacttgtgtccaccacgtcctaggccatcctctaaagccacccttgttacttcctactaccttcatcacctcctaaccctcgaaacccaaacatataggttgaaacatgtgaatatttaaggtgacggaaaatccagtaatctccttttgcattgttcacattatctagccactgtcttttaaaaacatacgaggtaaaattgactagcggatatttatatgcatttttaatcactccatcttctcatggttgttctctttatttgctgctccgtatgaccctgcgatagctgtgtatctagaagggcatgggtggtccgattgatagaaaaaaattaaacatcacaaatataactatgccaacatatacaatacatgtatatctaatagaattggccaaaaatgcatcatgatatattactatcatcttacaaacatcttaaaattaacgttaagtaagaaatttgacttgaagaagcttatacggctacaaaagtttgaagaaggttaccccatcatcttatttctgagtttattcttctgatataactgtgggaggcaatcaagaagcattcttctatgttccatattactaaagaaagatgtaatattttcatctttcttcacgtcttaacaatccgtaatacaataagtacattttgagatgagaagaatccaaagtaaaaaattgaaaagaagagtacaagtctagaagacctattcagctaatcaataatcacttaccccttggccacttgcctttctttcttgatgtgtccctgcacactgtgacaccgtgccgtcaccggccggcgcactcgcgtcccgcccttgctgccttgctgtcgtcacttgatcactataggctaggcggcgggaacgtgtaaataggaaaccaggaaaggagtagccgagcaaaccaagaggtaggagccctaaccctagtcatgggtacgatagatcgtcgctcaattgtacgagatgggcatgaggcggagccgcggtcacaaagaaggagcagaaacgaattgacgtcacttcaactttagttttctttttaccatacctacctatgcatgtcttgggccgacacatttttgggtggtccggaccatcttgaagatccatcgatgccctatgagattactacatatccttcaagtttctgacacattcgttgtccttggccgcatattgcccctggccaccgtcgaggtcatgcttggtgccactgacaaaacacgccttgttgagcattgcatcctcaccacaaattgctatccttgccgtctctggtgatctggtcaaatctagcacctttatagcccatgttgacactcgcattgctttatgaaaaataaattaaaataaaattatatcgtacatattatgaaaagtataaaattggtactctttttaaataaactgattgatgcaacatgagtaaaatgctccaatgtttcttgaagttgtatcttgtatgcagatgatatagagggctatgaactagtaaaatacacccccttcccgatgtttagtgtcgtagtatccgagtcttttttttctttggtcttctatttccctcctctcttagcataagtcggtctggcttaatgtattgtgtaacaattattcttttcttctaatatattgacgtgtaatttttttacgtgttcaaaaaaaaaactagtaaaatacagatatatacttttaaacctattaaagtagtgtaaactactctatccgtttcaaaacgtaagaacttagatctaatttttctaaaatataaagaaacaattcatttgtagtatatcatataggaaaaaacagtactaatcatatcgtcatatgcgtgtacagagcgaaaatgttaagcggtcggccgatgtctgcacacgcctgttcccacttgatcgaggtggcgcccgccggtgcacgtgtccgcgcctctcggattccgttgcgacgctgtccccagcagctggtctcgctggcttcgctcctcgtctggaggcgagcgagcgagccgggtcggcgctgcgggtgagcgacgcatatgggtttccgccccgcacgccgcccgcccgcccgcgcgccacctgattcgcattcgctccatccgcttcttctcggattccagctgttcccccgtggcctttcttggattcccccgccccccggcccgcggctcccccgccccacgtacccatggcgttgccgaggtggctcccatgatgcgctctcgccgcctcgccatgtgacccgcgcgccacgccgctttttcgagaccgagagacggagagagagaaaaaaacgtagagatccacgccgcattctccatttctccccctcccgggtgcagctcgccgtatcctgctttcttgccttgcgggcgtcgtcgtagcgtggtaggagtaggggagcccggcgcgcgggcgggcgcgggtggttggtgagtgcgcgcgcaacgcgcagcagcagcagcagcgggaaaaaaaaaaggctaactaagctaggacagaggagagaaaagccgtggcgctttgcggtcacgagattcagggggtggtttgcttttgctcgcaagggaagtgttgggggagccgtagacatccgaactgttctaatggcgaccctctggggggcggtggcggtggcgttgctttgcgcgatgtattggtgaggccggtactaggggagggggtagtagtagtggtacaagtggtggttgtcgtcgtcgtagtcttgtgggttgcgtgcgtgcgttcgtgcgcgccagcgaagttcttgcgacgatcgtgtggggtgggttcgtgtgctctctcgctcctgccattggttgatgagcatggggcattactccgagcagaggccggggttcgaggtgaccaaggactggaacggcgccgaccaggtcatgatccggtcgccgcggggggcgtccgtcctggtgagtcgccgcgcaaattttcactcttctttttgcgggtttctggctggcgattagattagctcgccggcattttatctcctgcgcacgcgctactctgatgcgggtcccttgggttgatgcggtggttgtaggtcagcctgcacggcgggcaggtcgtctcctggaggaacgaccgcggcgaggagctcctcttcaccagcagcaaggtgaggcctctgcgtaccgatcctgcctctgtttcctggcaatgtggttgtttctgcaactgatgatcggattcgtgcgatgtggttggggaagggtttggtttcatcaggtttctctcttgtggatatacgaagtacttgcataattgcagccggaatgtgcgtgttccttttttttttttgcgcttagttgatgcaatttatgctggagcaacgtccttgtgctgaaatttctctgatagacatgcatgtgaactgaaattcgtctgtttgtgattgggtaaaagaaaggtagacttttttttaaaacagtagaagcctttctttggggcatactgtataatgagagtatgagactaatctattatttatttattttttttgaaaggagagactaatctattattaatttaggatggtaaattacaggctcaaatttggttttcttttttctctacctctgaattacctgcttaaggccttggattctcctttgtttctgaaatatttgtgtgctagaaaagtagatataataacacattataatttgcgtgctttcagttagttttaagatttttgatagctattgtgtgtacatacaggctatcttcaagccaccaaaagcgatgcgaggtggaattcccatatgctttccacaggtactgcaatattccctatatgtttgcagtgaaaagtgcacatctgcaccagtttgggagatggattttcatcccttgaggggatgcaattttacttctgaactggtgaaaaaatgaacgtttttaactgtaaaactttgtcagtttggaaattgtggaacattggagcagcatggatttgcaaggaacaggctatgggccatagatgatgaggctccaccactaaatcataatgataacaacggcaaagtttctgttgaccttctgttaaagccatctgaagatgatctcaaatgttggccacactggtatgataacttattctggggacatatatatttaactgtccttgagtagtttgtctgttacagctaggtgagtaaaatgtccaattctggttagctagtgtgtcagggaggtggttggttaaatagctcaggccataaagtaataagtacttctatgggccttcggtataaaaatttctaaatgactattcatcagaatagactgattctgttgaatatagcaactgggtagaaatgagagaaactactttttggatcagaaacattggacaaactaaatattatattgcttcagaccaaaggttttttagtaccaaagtaaatattataccaaatatatatttttattaccaaggaaatcttaagtctaaatagtgtacacctgttattgatgtggacagggatgttctgtgtgcaataagctcaatacttcaacctcgagctatattacattaattctgtgatatattttataaatatgatagatgaactttcaaggattaataaaaaagagtttagggttaggcagatgttctgtttgatgagatttgaaactgtaaatctgaactatttcaagcgtatagtggatggaatgctttagtagtttcattgagcattttgatatctgcatattcattccggaagatttgtcatttgtctgatatacttattataatgtgaattccagctttgaattccgtctcagagtttctctttcgacggatggagatctctcgttagtatcacgagtcaggaatgttaatgggaagccattcagtttttcgtttgcttaccatacatatctttcagtctctgacatcaggtaaggcattgtttgagcaaataaatcttgttgctcactgaatttcatgttatgtgcttaccgctgatgctatacactctttcgagttacaaatattattccttctcagtagaatataataatagcttaaggtatagtacatatttatgccataagcaattagcatttccttttttttagataatgtagcataacatttcctgtcatccattgaagctgtacatctcatgctttcacaatcaatagaacatttggggttttgtgattttctgatgaacaatgtgcataagatggtgtgctgcacctttctcattgcagtgaggtgagaatagaaggtctggagacacttgattatcttgacaaccttagccaaagagaacgttttacagaacaaggagatgctataacatttgagtctgaggtaaattttcactatttatatgtttgtgtacttactccaactttataggtcttacatttctttggtagagatgggtgttgcattttgtcggtatactatagcaagcctgcctataccgcgtgcttgcatttgaacactaaatagctaatgatcttgaatctgaatttggtcagtcctttcatcctcagttgtgtgttgtgaacttctgcaccaaaatgatgcgcatgacaacagatttactgattcataaaaagtaaccatgtttacaggttgacagagtctacgttggttccccaagcgtaattgctgtgcttgaccatgagaagaaacgcaccttcattgtaaggaaagaagggcttcctgacgtcggtaagatgatttccttcatgtaccactccaaaccagttttagcattgttaagccggatggatgaaaaattactttctgtcctggtaatcataaataaacaatgggtttcatgctctctatcttggctatcagttgtttggaacccatgggacaagaagtcgaaaacgatggcggattttggcgacgaggagtacaagcagatgctgtgtgtggacgctgccgcagtcgagcgagccatcacgctgaagccaggcgaggagtggacggggaagctggagctgtccgccgtcgcttccaccaactgcagcgaccatctggactacccttgtagctagctccagtgttcctataatgcgttccagtagctatattcagatgcttagttttgccccccctaaatcgaaaatcatgtactacgtttttccttgtacatgggagtgtgtactacgtttttcattgtacaacatgggggcgctagctaggtccgtcgtcttgatcagcctgttgctgatcagtctacccgtgtcatttgtcagatactactatatattcagatgcaaagttgttgtgacaagacttcacttgagttttctgaaaaagtatttgccgtgaagaccttcttttgtacacagcaacgtgacggacactacggctggtagctacaaacaaagtctcagcaaaaacaggttgacattacaggagaacgtggcgatcgttgcagatcggcttggcctcgaggccgccgccgttgttcctctcccgcgcggtgacggtgtagccggcgtgcgtgccgagcagacggtcccagaccacgaagaacggctgcgagaagttgcgccggccgccgctgagctggtggtgcacgtcgtggtaggccgtgttgttggcgaacgcggcgtgcagcgggttccagggcaccaggaggccgcagtggtcgtcgatccccttgacggtggcgaacgcgaggaagaaggccgcggcgcgggggggcaggcccgaggcgaggtacgcggcggcgccggagagcgcctccgtgagcacgccgtccacggggtggccgtactgcgccgcgaacgcgtagggggccacgacgcggtggtgccacgagtggaaccgacggtacatgtaccggctcgagtgcatcagccggtgcgcgaagtactgccacgcgtccagcacgaacatggccaccccgaaccgcgccgccacgtccagtagcgccgccgccgccgacgacgacgatggcgccgctgccggggcgctcgcgtgaccggccttgacgtcgccggcgccaccgtctttctcacttgtcagctgcgtaagatcgataaaagaaagacaagatcaatcaaccagttgtaactaggcagccttgtaactatcacgtatcacgagctgtgctctgctccaccgtgcgcacgcgtgtacagaacctgtagtgtagtttaagggccaaggttactcttgatcgattaatgcgttttgtcaggcaggagtgcagggtgatgcgaagttagtgttgcactgttgttgttcatcttcttgccggaagaagctaggcactgcagtctgcagatatgccgatatgggtgaatcagggggttcttcttaaacaatgcagccgtatcacctactgatgtggggtagaaaccgctagagctagcgactgtactcagtggtgtaccagtatgccgtcacgtccataatgcgacggatttgcttttttttttttcttgctctctgcattatggataaacacagtaatattttccatctacagcaggaggttccaaacaaagatcactcaacaatcaaaagctagctagctgaacgtcgagggttgtgagacgacaaaccttgagcacggcaagtgagatggcgacctggatggcctgctgcagcagcacgcccttcaccacctccttcttggacgccatgttattgctctcctcgtccctcctcgagtgcagcctgtacctgtccagagccctgacgctccccaacgcctcgtagatccccgagtagagccagtacacggccaccggcgccagcgtcacggcgagctcctcgccgctgatgaaccccatcgttgcaactagaaagctagtgctacaaaaagcttacgtggagaaacaacgagagagatggctatgtgtgcttcaactctcggtacgactcacactgccactctgcttgcagctctgttgctagtaggccttggcgcgtcaactcacgctgcactcgagagggagatatataggctagtgtgttctactgtacagtggtgaatttaggatacaaattaagggtgtgctcacataatagaaattatcttagcggcaaaagtaaatatacatatgcttatcacttttctaactcaattaattaatacataaataaaacaaaagaaatatgcattgtttaaccaaagtatgatttaaaactatttgtgctgcgcatggccatatcaaaagtttaaccgtataaccaaatttccgaattatctattactttagaggtttttgaacattacaatgaaaaatcaaccaaaattagtaaactggtaatctcaacgttaacaaattgggatcgattatgtgatagaattatcaaactactagtaagaagcaatctggcatatattctagctaattagtactcacagctttttaagttttcaccattctcattggctatcagtactgtactatgttgcaagggatgatagatttggcggcagagctggggcttgagccctgacaagccccaacgatatatacgcccctgctactatactattttgtttatagaacaaatgcaaactagtccgatgtttgatttactcctcggcagtgtgagtgcatgcaacagatcgcctgaaaagtcgtgtgtaagcatcgccatatgtttgacttccatttgatcaaatccaacctgcaactgcaagacacatggctgccatccacttctcacactagcttgtcaattactgctcttattttggtctcaaaaaaaaattactgctcttatttcttcagcacagatgtcactaatcaatgtcatcatcctcgcctattggttaccagaggcaccatctttctttcttcctttttcttctctactaggttctgctgagatcattttctcatcaatccagccattttatccatactatctttctactaggttctgttgagatcattttctcatcaatccagccattctatctatactatctttcttttattttagaaaaatgtattttttacccgacctagagacccaaccggatatatacagtcttttaaattggaaacttagctccacaaataaaccaacctaaaattcactcgtaggaagattcgaactctaatatttcatgatgctacctaggtcactgcaatgactagattacgtgctctttcgcaacccatactgtctttctactttgcgcgcggttaggtgcgccggccaccagccaaccacctgacgcggtggcacggttgcacgcctccggccaaacgtcgtaacgtgcccggcgaattcagctgacgcacctcaaccgacgccggcgcgcgcgccgttggacgcgaacaacggcaaaccaacagctcggccggcctgagagccgcgggcccaacgtaagttttagatgggcttagtccacagaaaaaagcccaagtagtaactccctcccagccgccggcccaccgcgcgaggagatctcgcacggcgagtcggcgacacggcgacgtcgcgacttcttcttcttcctcctcctcctcctcctcacctcggccgctgcccgtcgctcggcgagccgccggcccgacggcgccgcacgcgcagggagcactcgaccggcgctcgccttggacgaaggcgccggttagccgcgaggcagccgcccagcgctcgcgttcccccctcctgatccgtggggttgctcagcggggcgccgtgccggaggagatgcagaggctgggggatttcaggctcccgcccttcttcaactacccgccttacttcacgtaatccctcccccctccccccccccccctcgttgctctcgctctcccccgtaacttttcctccccagctttcagttttacagagggacccaaagctcttcccgtggtgacaataggttcagtacagatgtttgtacagtgtgatctgtgaatttgcggtctttaggaggaagaggtgaccgtgggatgttgattcggttaattggttaggatctttgcttactagtggtccttggcatcgccggaatttccagtttttagggcctacaagtgactggcttgtttggctcccagagttgcttacggaatcgtaacatcagtatttagggtaccgtacgatatgatcttgtgagttaactacttagctagcaactctaaattttgttagctttattcatctctgctgagggcagatcgtcccctgttttatagtgattctttttcgcgaacgcgttttatagtgattcttgagaccaccttatcaataaggtgtaatgaaaatttctagaacttaacaagttaacaactaacttgttgcaagtgaagaacacaatatgcaccttttgattctaagtatgcctttgcccaagtgtatgttcacaatgtcacactgcatggaacacttctacttagaacggcagtacttgataattggatttgatatcttgcaagtgtatgcttatgttcttatcttgttggcactagatgtagatatcttatgtcttggctttataattaaatttcattatatatgttaagatctggatacctggtatatcttgtgtttcaacaggtttgtatcagttgaaccattttcttgctttcatcttcttgcattttatgatattcacaaccacaatcttttggattattctacagaaaaacctctgacttctgttaaaactttctttaacaattcggtcaaacaacacaactgagattggtagcatgacaatttgtgtctctcagattgcagcctgtgcgagaaacacgtgaaaagcaagtgcagctgtggaaagatctgatacttgattattgtagaagtcaaaagctatatataatctccctagaagaagatttcccattgttctccaatccaaagatcgagagtaagatttacctatcttaatcttacatactagtttcttctgttattcataaaaaaaaatgtgtcgcagtagctaatcatcaaactgtttggttcgttaaaaaaaaaaaaactcagcaacgaggcatgactgcaatgcactcaaagggctatggaggctttgagtacataagaacaaaataattgtacttgattagctcgttacactcttacctgttgcactgaattcacataaattgttctcttctgcaggatctcttagccatgaagcaaaggaagtattccttgctgctcttgtttatgaaggtccattttaccattaaatctcttatcttttatcacagctatagtaattctgtgcattacaaaatcatttgtttgatgctctgcaccttcttaaatctatgttgaaactgcatgcaggacgtgcagaatggatggacaaaggtcataagaagtgcctcattctttggttgcggatacaagattgggctaactacatattaaattttgtacgattgttttatattcggcatttgtttaggcgctatctattaattatttgtgaacaatacatagtggcattgtcttcattgtgtcataatatttctctctaccctgtgtttgtaggtaaaggataatgggctggaagatagtgtaatgactgttgaagaaatacgttcaggaattgaaacacgtgggactggtaatctgcaaacctcagaatcatggcactaaattttccttttctccaactgtcaatattgtgtgtctcaaagcatattttctatcctgaaaacaattttgtggtggaaacctaataacctatggtaggggtactaatattgtagttggtttttgtattttggcttgatgtttcacttgtacgtcggtattttgaacaaaggtagtctctggatggatgggacactgcaaagccattaattaagacagacgattaatcagtgtttaatggacagctaacgtctcaaatactgttcataccgaaaattaatcaataaggtatttgtcaaaaagattgataaattgtgactaagcaagcatgagttgtgtgccaaacatttcattatttataagttttgttgaccgacattgttaggacactccagcgaacgctattcaacacaatttagcctctgtgaccaactaattggctgtttttcagaacacccatatacattaattggtttttgtacttcttcttcttcatcatcatcatccaataaagatgtttctggcctgttaaaagtggcctgttaaaagtgtgaggcttaaattgatttatctatatctatctatactactagtggtggtgtctgttctgccacatcacctctgttgtctctcacaatctatactattacaccaccctccaccctacttcatcgttggctctcacaatctatactattacaccaccctccaccctactttcactgttggctttctccaaatttcgaaaatacctacttgtccaataaggaaaatcataaaagtactacttgaactaaatatgtccttaattggcttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48450 - DNA, 842 bp, Oryza sativa
ccctcacaatgggggggggcttcaaatgacgcttcaccttcatagggggagggctacgggattctgctgccccctctttttccgatgccatcaaaggccgtagtaaactcttaccatacccactgccgggagttctcactcttgggatgcggaatcgctcctccttcggagtaaacggagtaccggtgggtgtggtatacttggggagcatctcatctccttccttggtgaacagggtgcccacatagcgctcggcgagaggtggcgcggccttcccgtcatcttggaaaagccgtcgtgccttcaacaaccgagttctcccgttgtcggccgtcgcgtaggtgaatccccccagattttgtccttgtgacatggcgaggggagagggatcacgctgccgaacggggctgagaagggttcggccgaaccagggagctcgtcgatcggctccaaaattgcaggggagcctggcacagctgcaaggggttgagcccatacagcgtttaccccttccatcgtgtattcttccaccgggatcaattgatttgccggtgtcgcctctccggtgaggtcgtacgtggaattggatgaagagccgatgaatgtaatcaaggatttgccagccattggtgggtatgagtgggaattcgaggaattgggttggattggagaggagagtatgcaaaggtggagagaaagaggaagaagaagtgttctagcgagatccgagcgttctacctccaaatgcgcatctaaacaaactaggaacgagcgggggagagcgaagttcaaaaatggggctgatcgggcgcctccctggctcggccgaaccagcaccttgg

SEQ ID NO: 48451 - DNA, 3775 bp, Oryza sativa
ataggtcatagactgccctcacagaccacacatgtcttttctgcacattttgtcctcactcgtgtgcacccgggaaattcttccggtcggtcacccatcccaaattgctccaggccaagcacacttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgcccatgtgtccaatgacagcgcatgtgccatgctgtgtaaccactccaggtctacaccagccatgcgcaccatgcctgcgcaactgcgatacacgcgcccgtgaaaccgcgagagtcggctctgataccattttgtcacgtcccgccttcccccaagccgggcccacttacatctgatagctttcataggtcatagactgccctcacagaccaacacatgtcttttctgcacattttgtcctcactcgtgtgcacccgggaaattcttcccggtcggtcacccatcccaaattggtccaggccaagcaaacttaaccctcgagttctttgtgcatttggagttttggacttgtattccataatagctcccatgagcataatctaaaagaattatttcactaaacaaacctatagttaatcttgagtgataacatgtggacttaatattaaactcaaatatcatcttctcagtctaaaagaagtttaatgtaatccctataataatattagatgcaattatgaagtgggaacacatatacaaacaaaggtcatcttaattctctaaaatattttgtgcaagataaaatcatggaaaaatttatgtggacaatgattagcacaaacttatcctccgtaatttggtaacgtgttaacactcaagttgatatctcaaattaatcggtcgaaacagacaactaaaagaaatcaaattaaattttaatcggctaaaaccatatttcatccaaaagtacatttaactgcacataagtgaacatggaaaataatttattcaaatactagattagttatcatgaataaatgtaatttttctagaatttttcttctctgtttaagcctcctaaaaattcaatctagctttctaatagcccatctttgtttaatttctgtgagcagtccacccattatttttgagtgcaaccaaagaaaatggaatctaggtgtaatcatttacctccagtaaaatcaacactaattaatttggtccacacattgaattatgtagtttcaaagttagaggagaaaataattccgaaaattaatctaaaaatcaagtttacccagaatcttacccaaccctctcaccctagcctagtttgccacgacctggacccacctgacagcctcttaagcttgccttgactctgtccatcacttcctccactgttccagccgagagagggagagattgagcgagccgacgcgtggccgcaacgtgtcgtcgatctcggtttcccttttctcgctctctactcctcccagacgcgtcgccattctccacacatcactttggagctgaagaagccgagggagaggttctctgcctctccgtcatcctcaacctcgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcaagccacgtcgacaacgccctggagcacgcaccggagcgccgccgcttcaaccatcatcgtcgtccggccattctcattcacctcagagaaagctgctgcgccattgtcattgcctcaacctcctcttcaaaacgcctcaagaaccccagccggaaacatcaagaacacggagaacacatccttttcttcaccggcgccaatctaggatcgcctccgccgtcatcgtcgattaccgctgcctcggtgagccatggttcgattccttgcgcatacaccatcttcttggacctcacaaccttcgggcttgctggttggaagcagctaattgtcccgttcaagccgtcgtcgttcacccgaggaggagcgccgtcgccgagccgttccacaagtcaccgttgccgccaagacctcgacaaccctagctcgacccacggtgagcatcctgaagtctaaaaaaccacatgcatgcatccttttcgttcgtaatcgacttccatgcgcacatgcactttcaccccaaaaccaccgccgttcacactcgccatcggcgctactccgatgtcctctaaccaagaaaactagaggaatggaatcgcgagagcttgctcttcattttatcttttgacctcaacctcaagcgagccaccgtttgccgccggcgagctccagatcgagctcagccatggctagctctgctatgtctagagcagagggatgacttccgtgaattagattaagtgcagggatccgtttacaattatagaaacacactgacatatgggcctaggactgcgggttgattcctagaaaactcaagggcctttgtgcatattggtccctcacagccatggggacccatcctttaaaatctgaagaaaaattaggaaaatgccccaacaattatatgtttagcagaaaaatgcacaagttgtaaaatctatattaaatcaaatatagctcattttgaagtgattccagtttctgtagattcttgaagtaaggaactttattccggaatataaaacttgacactcactgaacaaataatgtttttaagatttattttagattaggtcatgcataaaacatgtaccaacttattaaataccaaggaaattcatttcaactcattttgaaacaaactcaaaaacttcagattcatcatcagacactttctgattaggtaaaataaaagtaatgacttactttgcttcaaaagcctctaaaactattatctttaaaatgactagttttagataagctaaactttagaaattcatgtagaacccaatttagcttcaatttgaataaacttaagttatgtaggatcactaacacatgtatttccaagttatgaaataatattatatacttgctgtgtagtaaaagtctctaaatattcatataaggatttactaacatagagcagccattaatttgtaaaacttgtagaaaattcatttttagtccaaatgaaatgaacaaagtttctatagaaccagcaaatagttatcttcaacatagtaaaataaaatttggcaccttctgtaaagaacattgatcaaacccttaactaagtgaaataagaatttaaacacatagtgtggtttaagtaatacataaacatgtataagtatatatatacactttaggtctaattaaacctaaataaaaacttgattgaccagtgaagccatagttccatcctcatccactaaacttagaagaacttggctcatataacaatttctaggttaatataatatattgctagtttagattaaagcgtctctactttataaaatatgaaccatagtagtaaagaccataaacatgtgagataaaaatgttttagttaaccaaattattccttttattcaacttaaacatgaagtagcatgttctgaacctataactcaggagtcatacatatataaaacactatatgcctaaaacacgttg

SEQ ID NO: 48452 - DNA, 1190 bp, Oryza sativa
tttggcaggaattttggaggtcgggtggttttcttttataatagggggtttcttctataatcccatataaactgaattagggctattaccttacgaggggcctaaaccagtataatccttatctttttgtgtgcttgatatcgtatcgtgtagatccttataccaacgtaccccaataccatcaaaatacggtccgcgggtatccccgtcaacaatatgtatacgaatgttttcagttttacatattgaaatactattttatttgtcagtgcaagatattaggtattatgtactaagaacgacaaatcagttaggccctatgcatagcatttcagatttcgattagaaatagcgggaaatattatatcacatgggggcacaatcttcccaaatggccagtgggttataggccacgtgagaaacacattattgcaggctggcacatgtgataattgatcttccttgggatcacgttaagagactggcctgcaataatgccgtgagtcttcgcatgcggttgggccacctgcatgcaaaaatgttgattttcgcagacacatgtatgcaggtgagccatcaaaccgcatgtcaagatcgttttttgtcgcatagaaaaactaattttgtcatcaagaatttgcatgcatgtgccaaaaagtctttcagcttacaacattatatggtcatagattagtttcagttttgttgggcagcgagaggccgatccataacttctgcctttgtgaacgacagcaatgccaccaatcgagaaatgaacggctgaatggcttggacccaccgtagtgactaatcatgtcagccataaattaataacaccaggtgtttactctatagaaaagatcaacgaaaataatcaccggtggcaaagaaagataaaccaaaactgagcacatccttccccttttgctcccaagtcccaacgtcgaaaaatgtatggattgacatcctatatctattcatcctgctatcttcgaacgagaaagtataacatgaaaatcactcgttgatgcagcctaagaatgatgcaacaaacttctttttgttcgatctcttaacataccgtgccttactgcctagagcccactacggtgctctctattgttagtaaaaagtaatctaaaccgtggatctaaggttcaaatctatttatattaccactcatttagtgg

SEQ ID NO: 48453 - DNA, 2508 bp, Oryza sativa
acaaaacagaagttgcaaattgagttacgaattgcgctgcatgaatgcataggacaaaataaccatacttgtttgattaagaaaacataccagcaacaatagactttttaaatgtctctagcatgaagaaaccatgaagaaaacatcgtgcgtgtaaaatttatatgaccaagggccatcatcagtgctttagctttagtggcaggcctggaagaggaacatgagagaggacaagagaggcactatgccaaattgtcacttaataggatttaaatcctggttccaacaagtgttacacgtatatgtctgattaacaggaatttattaagacgaggaatttgtcactagacttcatctcttccattatcatgtgttataagaggtatactcacaggtatttgtgcacagcttccatgtaattaaaaaaaaggcactatatagtggcaaattcagagtaagggctcgtaactagcgcgattcaatgtcaatctccaacctcacaattacagtgctcatggtagtaagtttttgttatttacactgagatacacctaagagaggttttccattattgtacaacagtaacaacagctggatggcttgctatcaatttgagttttcactgatacgctagcattctgcagagaacaaaaaatatgtcaatagagcatgtgccaccggcccaccggccaccgccccacatgaaagtattgagttatgaatcgctagcataacagctggggctttcacttatgtgctgggatttctacagagatcaacaatgccaacagagccatgtgaaaactgtgagagttttaaactataaattgctaacagcaacgtccacaaatttccaccataaagcaggaccggttttatgccttccagacaggttcattgtttcgttgaagacgccatgctggagagcgaagaatgttttgtttaagaagctagagtagtggggagtgctttggagggttttctacctgtttatttttggttgcaaagtatgttgttgcaaggcacatgatctgtcttagactgtttcaccttttattttattttcctattttgactgggtacattttagtaggtgcagatcgagtttacctcacttcaaaaataatattctattctgtcaagagagattctgctggtgtcttccacggatgaaaagctgatgttaaaaaaaaaaggagttcctttaaacaggtaaacatgttcagatattcaggcaactttttgcgagtttgccaattatgcatgacttcaaatttgcccaccgtgtgtaagggtatgtactattagagaaaaacaagtacggttttttaatgattaaaaaccaatacttgacagtcttgcaataatgtggacggcaaatagaagaccctgaaaacatgggaatgcaataagaaaaatacttatatattttttctatttatttaatgtatagtgctcgtgtaagttttataacttttcttttgaagtgcttgagcctaaaatctaccaggcctagcaaatatatgtgaaggaaacatgaccacgatagtataactgacatgaaaccaaacagaagttcttaatctcacatcaaattcgtttgatcaaaataaagaagaaacttatatattggaggaacacaaaaggcactggagttgaattctatcttacatggccaacttatgttgaaaaggagaaaattacttcctcttgggtgatgttttgctctcgaattgttaaatttagatacaacacataattgaccagtaagttgatgtcctgctaaatgaaaggatcaatgctactgtgcaagaaatgcaagatgaattgggtggttcaccctctagatagtttcaacccacgagaaaatgaagaattataattaccagtttaaagagaaagatatttaggtgccaaacttccagagttaaacagattatttcacctgacaggactcctcctagcatgttgctggcaaaaaattgctcatgtagacttgtgcgagcatttcaccaagctttacttgtgattcagtggtaagatgcagatgatcttcatttaatgacagtccaaatgcgtccacagttacaacattgggcaggttgataccaagctgagctttcctcactttttcaatgttctttttattcccagatgcaagagcaacctgtttaatgcaaacaaatcttgatataaatgataccccatattacaaatgatatcgagtacaaataaagggtaaggttggttgacacataagatggcatcgtgtgtgtagaaagagtgaaaccagccatcttatattggtaactgaataaagaaaattcaaggttcaaaagaaagattacagagccatgcaaaataaaacatattagtttactagttaaaaccaatcagttatcttgtactgggggatgtaaaagagggcctgatgatgtattaaatcgaaactattaacttcaactttatacatcccttaaagcaacatctaggcacatgtataatcgt

SEQ ID NO: 48454 - DNA, 1388 bp, Oryza sativa
gcgcgcgcgccaacgagaggataatgagatagagcgccgacgcacagaaaacggagcggtatattagcgcttgattaattaagtattagctatttttaaaaaaaaaattggatcaatatgattttttaagcaacttttgtatagaaactttttgcaaaaccgtttagaggtttgaaaagcatgcacgcggaatacgagagagaggggttggtaacatagagcaacaaacgtagactgagttcgtttcccagctttccaactacaaaattatgcgtttgttctcaaaaagtttctgcgggcggccgtcatcaccgctgctagctcgtccagcatcccaagcccagcatggctgtggtggtcgttggtgtgatgttgggacttgtatgtgttgtcacatagtgatggacatgcttttggacagaaattttatgttggatatgaatatcacttggatttgggatggacaaataggagaaaagttgtccaaattttgtatatctgccataattatgtcatttttttaaattaaagtcaaatttatcaaattgagccaaatctgtcaaattgaatccaaatttatcaaagttatctctaatatatcaaagttatgctcgttaaattatgttaaaaagtcaaaacaaacaaaaaaaactttgatacatttgggtcatatgagcaagggcaaccaggacaattcgccccttagttaacaccgttatcatgtcttcacgaaatagggtcgtcaaccttttatttttgattggaaaaaacgaggtcatataagcaaactaaaaaagtagggttaaattggaagttagactttaaaataggatcaaataaacaattgccccaagattacttcatacaaagaaagcattaatgaaatttttttgattggtcttatttacctaatttggattacaacacatgaaaaaaaggtgtttttatattcaacaacgtatccagcttatttgaatgaaaaaaattaaactctacgatcaaaatcccataaaattcaagttgtatattccaatgtaagaatccagatataattcaagttgtatattccaatgtaagaatccaaatataaaccaactaaagattcaactattttagatggtatcctctatctaggtgaggcggtacacccaatgagaaaggatcgccttttccatgatgaggaagcgataggcagaggacatgcgtgcaatgagaagcgtcgtagatgaggaaccgcgctatcgctaatcttctgctagcttcccattccttgcttctctgcagtggagctccaataggtttacctcaccaatatctgccagtagtttctcgcggcactactaccttctgatcacgtgcgagtattgccgcagagatgtgtatttcgt

SEQ ID NO: 48455 - DNA, 1150 bp, Oryza sativa
agcatcctagactgttactttggaggttgccgcctcctagacggcttgtggaggtgttgcccggtgacctctccgaggagattgtggaggaggcccgtccccgtttgtgagtggtttggagttcaccaccctcggagtgaaggaagaactaccccgagtgatcgaggcttgggttgtcctctccgtgggccggctcccgccttgcccaccccttgacgaagggggcgtgaggtggcttcgtggttgaccggtgaagttgggctcccctcaacggggattaggaaaccggcgagtttccgaacctcgatgaaaaattccttgtctcttgtctcatttatttgttgtatttacatttgtgctatttatattcatagagacatatttgagcccatatcacttaggtttgcaaaacttaacttagttgcttagttaaccttgcacctcaccttgcctagcaacttaggttagttttgtttaagtgtcattaagttttaaaaccgcctattcaccccccctctagtcggcctccttatcctacgtgggtttaggaggctgattgtggggtcttgctggcacggttgaggtcttttggccagttgagtggtggcgtgctgggctggtggcaatggaggagacagcgatgacgagaaacatgcagtaggtgatagtttaggcgtgtcctgctaaggaaaaaagtggaaggaattagggtttgagtatacgaagcaattgttcaaaagttgttagattttgatgggtgttttttttcatcaaatgtataatagacagactcataaaaaaggaattgattacctgtattcgatggaaaattaaaccccaaatcttgcatattggactaaaaatcaaactccaaggacccgttcgttagtcatgcagatgaggatgtagacgtaggattcatgaaattcggatgagacttcctctggttcgggaacataacagtatcctctcgcgtcgtcctccctaggggcggcacgggaggtgacgacccggctgccccttctccctcacctccctcctccgcctcgctgccgcccgagtggctactggcgcacggccacaaggacagtggcggcggggcccctctctctcgcacgctcgggtgacctagggagtcacccagagaggc

SEQ ID NO: 48456 - DNA, 3838 bp, Oryza sativa
gctctacctcccttagccattcatcgctcattatggatgttaactcccggacagtttctcgtaggaacccgagttccataggattgggaggtgacaaaggaacgggtggtttccttttgctaaaatagttcagggtattgccgtagtctttgtcaaaaccgtccctgaacataattgtggcacaatccggaacctgaatttcttcattctcgacaaacggctgctcaggaaccttttcatcaatcgagctagcagaagtggatggttcagtgagtggctcgatcgttagaggttccactatcttggacagggatgccttcggctggggttcattgggctgcgtcatgaaggaagtattttctaggatgcgatccaaaattgttcttccttctgacggcgttttgtgcatgaacgaccctccaacggttatgtccagatagaatgcagattccttatccaaacccgtatggaaatattgcagaagcacatactcgggtaaggacagggttggtccggattgtactaaatagtgaatctggaccaagttgcaccgattgattcatttttgatctgcttgaaactaagaatttctactcgaaaggcagtaatacgagtaactggaaagaaggcaagacagaatctgtctcacaacttttcctagctaccgtttacacatccaacggtagaggtgtaccattgctttgctctctcttgaagagagaacgggaacaatttccaccgcacagtttcttgtctcatgccacgaatcttaaggcatgatcaaacttgttcaaagtctcgcagatgatggtagggattttctagatcaaagccagaaaaaggattttccctacccacttattaattcaagacccatttccttacccagtgtattaattggccttcatgaaagaaggggcttattaaattcccccccaagaaccaaccttttcaaaccaaggttcttccttgtccaaaaaaatttgaccaggattccttttttagattaccaggggtaaaggtgaactaaaaaagtaaaagggatccagggttaacctgggttcggaattgatcaccacccgttccccgccaacggcactaggaatggctgttggtattaaatacggttacagataaaatctgcaaccgcacggatttaccgaggagcacctttccctacggagttttccaggggtatcgaatccaaatgaacgtgtatggtcaaatcttcctccggttcatccaaggacacaaagtaaatgataggccaggatagagaggatttactagtgagagacagtatctagggaaagcttaactttaatcctaatgcaatacttcaggcactggcaacccgctgttcccagatgtcgctctagtacgtacccggaaagggaggacttaagtgatctcaagggctgtcaccacctctacacctacctcaaacgtaccgtgggatacgcagcaattactggataacaattacttaaataccacgtctaagcaattaatatctactttagtgtttataactcatcaaagcaatcactatattttagttgattatagtgaacaataatcccgtatgctatttaggaactaaccaagagataattctcacaagataaatctaaattattcaagaagaatattatattgaattcagagtaataaatagaataaaagaaataggagaagattaccgacaactccggaattcttccgacttcttctactctactctcttcctattctagtgtacaatatagtacaatagagcctcttataattcagctcaagcttggaagtgtgtgtgagagtgaatgaagtgaggtccttttatagggcagttatgacggttgtgagaaggggaaatgtccgaactgcaccgcaaccgtcattggagaacatctggagcatccacgccaaaccccaggatgaacggtgatcgggggttcggccgaaccagagggttcggtcaaacctgggctgggccctcctggcctggccttcggtcggtggactctcgggaccttcctctattcatttctcggagttttcggttgatttactgatgtttcgatgaagttcacaaccctacttgtatggatacataattctcctcactttagtctgattttcctcccaacttcagggtttatcatctgcatacaaatatacaccaacacttgtggaatatgtaagattaagcacctattactatgttggatgttttattatctagactttatgaaaatgttggcggtatgggattgtcatttaacaaccgccaacaatggggcatggcatcgggtccacgagattgatcgccgcagactaaggctatgttcgtctgttcgctggagcctgttcccaactggaacagtgtgcacgaaaaataaaacggtccattaacaagtgattaattaagtattagctaatttttttttcaaaaatgtattaatatgattttttaaacaactttcatatagaaactttttacaaaaaaacacaccgtttagccgtttgaaaagcgtacgtgtggaaagtgaggaagatgagttgggaaacctgggctaggaacacagcctaagggtctgaggcagaagcggaggcgaaagtttctctttttttttcgtgaagtactttcctccgtgtgctgtgatgagatgattaaagatcaagtttctgccttaatttctcaattggagcatgatttttcattagttccattgttttcagaatggtaccaataatgttagaaggtgctttattttatacctagaaaaatgtctgttgtagagaaatgaagaggccatggtaggacaccttgccatatattttttaagaagaatggctaatatgcattggctagggtttaatatctaattttattggcacttgcccttaatggaaaactttgccttgtttaaggggaggattaccttattttcttttttggagcccacctttagaataaggaatttttaccgttcttttgataacttattggggacaagtaatattttaactaacaggtgcagggaccacctaccaaagtaatttgttatggaaaagaaatagggtgtttttggggggtttttcaaacaaacaatgtgaagtacctactttgtaatttgccttaaatatatggcataatttgaattaaagctcccattaaactgattatttttactaacacaaaattttagtcatttattaaaaaatattaaagatcgtagcgttagcacgggcatatactagttttaaagatagaatgaggccgaactaaacaatgctaatttaattagtgaaaaccgaaacaacaacagggaaaaaaacaacctaaatactctgagcaacagccacatgactaattaataagctcaaagcaaagcatactccctacacaatgccattgacattagaccatctacacccccccccctcccggggattggacaaatctagcatccctaagaagcacaagtgaacaaggtcaacatcctaaccaataccaaaacacaaccccattggacttagtgttattgttgccacatgttgcccccctcccccttcctcccacgtcaacgttgcacctctaacttcactaccaccagctttattgaaatatgcgtaagctagattagcaaccagggagcagccaatcctacaccctattagatgggagtgctaactcaaccaggaggtgggaggtgtcatcatcttgttagatttaattctcaggatctaatttgcttagcttaacacatggtcacaaattctaagtgtggaattgagatgattactgaccggatgaactgaagccataagcttt

SEQ ID NO: 48457 - DNA, 4320 bp, Oryza sativa
ttaccatccacagaccagtggtcaagcagaaacatcgaacaaacaaatcaagattattctgcaaaagcggtcaacaaaatgggaacagaatggaaggatagattgcagaacgcactgtgggcataccggacagcatacaagacacccattggaatgtccccatatcagatagtctatgggaagtcatgtcgactacccgtagaacttgagcatagagcatattgggccatcaggaattcgaacatggattttgagggagcaggagaatggagaaaaatgcagattgcagaacttgaggaatggagagaaatggcttaccacaacgcaaagatatataaagaaaggacgaagcgctggcatgacatgtcataggctctccagaccttccattatatttgagagatgaagtgaataattcaagtcatcaaacaagcataatgaaacatccgacgcctcgagagaggaatattggagacattgctgggcccttagcctgccagtcaacttcagcctgagatgtgcccgtcaaaccactcgaaggcggcgatcagatgtgttacacattcaggagacttgacaaaaatggctaaagatctgcaacctcccaaatattcctaactcatactcatgtgaatctagttcccaggatgtgcactagattcacactttcatcttaagcatgattatacatagcaaacacaaataagatgaaagcgattataaactacatctactttagttacattggccaaccggccaaataaatatatagaacaacggaagcttgtctacccaatccacaagcacaccgactaggggtttaccccattaagttcaagtcctagaagaagcagtcgattacccgcatcactcaaagactaagactaaaacctgcaaacaaaagattaattcaatagcaagagtcagtacattattagaaataatgtactggcaagcaccaagacaagcctaacaccctactggtaatatggatagtctctgtccctgtattcacattccaccttcaacaaagtgttgatttcccgtaaagctaactgtagtcctttaagtaagtagatatcttaggcttttgcaaggcatataaccaaggaaggcataatatggttctttttagcataaagcaagttttatttgcataaaacatttctaaatcaggtttactttcaaataaatttcagcaaactagtacttgacatattgggcatcaaggtaggcattaatcatgtataaatatgcacctcattgccttccatggcagcaaggagatcattctcaaatctcatcacaatttgaaggtaaatttcagcatttagaagaataaacacaactctacactcaatagatatccacacgccgctcatgaccgcgagcacggctaatcgattagtttaaactctgcagagtttgtacactttacccacatgatgtgaaataataatcatgcaagagcatggcacgcgatacataagttcccgatttattacccgcaacaaagcttttccaaaattcatgatttagccttacaccagcacgatacgtgttactccatcctaagccatacacgttatatgacctagaaccgttaagtggcgggcccacgccttaaacttaacgccgtggtggcggacacaacgggaacccacccacgtggcacaataccgttgtattggacagacttagtcacctaaactaccacgtcggggtaaataggaagttcctctgagttatccgaactcatacacaccggcctacagaatgtaaggctaaaccataaataatttactaagcttgggctatcccatactagcacatgtggttgtactgtatacgaaatgaactgacattgagtgaagtccttaggtcggtttgggcacactctccccctatcggtacacaactaatcaccacatgtgcaccacttgaggcctaaacctaaaatccatgttttccacccttttatttattcaaatctccagtattaaaggtctgcccagaataaatataaatcaattttcaagtttgtaatgagcccataatgtcaaggaaggcccttcttagcaagggttagctttatagtaacctagtgtcccccaaactcatataaaaagtgggatagtcataatggtcctaaggttagaataataggataaggatataaggtggggtaaggttataaagccaaatataagaatttgtttaaccagttaacccccattttaatttgttagtaaaccattgacaagcaagaattggcaaccatttccaataccttccaaaacataggttcaaagtgatcaaagaaaggaaggtgggacttgccttgaatcaggaaaatgtcagcacctaaatcactttttcaccgtttaagccatcatctataccaagtacacgttatgccatttaaccccaaaatatgcgtaaaattttaaatgctctaaaatggatgatttgtgcacagtgaatagggactggtttaaaaagaaattaggtggaagaaattccaattcatccttttttaattgggagttatgaattttacaaggttcatcgggataggataagaattatttaaggactaatgtggaaagctggtgtaaggttaattttaattaggttaaggttggttaatggacaaaagtggttttttaaaactaccccattgggttcaccaattttggaagttaatatgaattctttatgcattttacaagttataacgtgttacgggtgtatagtgttatataggttcatggctttagaggtttaggtccagaacttgcctcatctagctagtgatgtataaaatgagtattttagttaactaatctaatcttagttcataattttagagtttatattattttactacacattttataattagggatgttctatgttagttacttaacacaccaacctagaaattgttatatgagttaagtttgataagttttggtggaaggggatggaactatgcattcactggtctaacaagttttatttgggtttcattatagctagagtgtatttctatatacatttatatatatacatattgctcaatcaatactatgtgattagtacctatcctataaatttaaagtttagagctataacctgtacagaaggttccatattttattttaatatgttgaagcccactgtttgctggttctatagatatttggttcacttcatttagactaaagatgaattttctacaaattttacaatttaaggttgctctatgttggttattacttacataagtatttagaggcttttatcatacagtaagtatataattttattttataatttggaagtatatgttttggtgattctacaaaacttgggtttactcaaaaaggatctaagatgaattttatatgaacttctaaagttcagcttatataaactagttttttttaaagataatagttttagaggcatttgatgcagaatgtgtagatgttttattttactttgtttttagagaaaatgttggtggatctgtagaaactaagtttgctctgaaatgagttgaaatgaattttgtatgcattttataattttgagcatgctttatgtgtgatttaatttggataaatttgagaggctaaatttgtactgtgagtgcaagttttgttccataacatcaaagttcccaatttggtgagttcacagaaatttgaatcatcttaaaatgagctatatttaattttatatggattttacaagttttagttactgttcttttataatttcagattttgttcctaggtgtgcattgtcagtcccaggccaatatgcaaaaagacccctagagtttcagtaaataaacccgcagtcctaggcccatatgtcattgagtgaaaacattacataatgaaccttatagttgtttaaattctccaagcgaggtccctgtctccttttccattcgataagcagcagagcagccatgggcggcatctctgctcgccggtgtcggcgacaaacggtgactccgttggggttgcgaccaaaatagaaaatgaagggcatgatattgcgattccattcctatacatttctcagacagcagacatcggagtagcgccagcggcgagtccgagcagaggaagttttcgggtggtggtgcatgtcgtgctatagactggatgtactcaaagggatgcatgcatgtggtcttccaggctctagggtactcaccgcgggttaggttgatgttttccggggtcttggtgacagcaacggctcgcgcatcctcccggcgacggcgtccttctgcgggtg

SEQ ID NO: 48458 - DNA, 1457 bp, Oryza sativa
aatggcccaccctctggttaaaattggaaattttaacctttcaaaatgggaaagttaccttccacctattttgataggaaatttttaaggtctagaatttgggtacgttacaatattatattgaattcagagtaataaatagaataaaagaaataggagaagattaccgacaactccgaaattcttccgactacttcttctctactctcttcctattctagtatacaatatagtacaatagagcctcttataattcagctcaatcttggaagtctgtgtgagagtgaatgaagcgaggtccttttatagggcagttatgacggttgtgagaagggaaaatgtccgaactgccccgcaaccatcattgggagaacttctggagcgtccacgccaaacccaggatcaacggtgatcagggggggttcggccgaaccagagggttcgaccgaacctgggctgggccctcctggcttggccttcggtcggtggagtccatggaccttcctctatccatttctcggaattttgggttgatttactgatgtttcgatgaagttcacaacccctccttgtatggatacataattctcctcactttagtctgattttcctcccaacttcagggttttcatctgcataaaaatatacaccaacacttgtggaatattgtggaatatgtgagattaagcacctattactatgttggatgttttattatctagactttatgtagatgttggcagtatgggattggcattgaacaaccgccaacaaaacccccccacacttagccctttgctcgtcactgagtaaaggttagtgtaaaatgaatttcttcaagatatgtatcaagcatataaattattttacaaccatacctgcacctgtgaactttatcagtggctaacttaccatcttgagtaattgagaaatagaacgatcttgattccagtccttgcttccctgttacactcatgggatttttataaattttcgcaaatcagctcttctcctcctattgacttcctctcttgtccctcaaggatgtatattttctttttggatccttaccaaggcaaaatgtgccataattcatccctattagaaggctgatatgtggagcttggtagggattaactgtgacatacctgcatcatatatagtgcaaagcccaaaaatattgactcaaaaagataatcaatcatactcctagaacaagggtctttatttatggcggaaaatgaaaaagtaaaatattttgtggaatgatggaataaagaaatgattctccctttttcctatactttcgctctaattggttctcttggcatgattatggaagggcatggctatattttctttgctcaatattttgagagcaagctttatttcatcttctttcttttctttctttttttttctagccatgcctttccttccttttctcattttctttt

SEQ ID NO: 48459 - DNA, 946 bp, Oryza sativa
cctgcagcccatataccattccaaaccacgaacttaaccaaatattaaccggtaatagcatttttaattatgatgagaggggtgaaactaatcacaaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccctttgcacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccatgctggcttgtggttggcacggttaatgtttcacaaccgaaactcgtgaaccggtccttaattgtcatgagcacgactctcaaaaccatgtgctcacaacccaccattatcaggttttagttggcaagtaattaattaaccaatcacgattgaccatcgtgaactatcattaagccatcattaaataatagtgaatcttaagttatcccaatagtgtgctaatgtttctaagcagggctaagcaattatatctaatatctagttgaaccaatatatataaagttcaaccagtcaaattattataacccaaggtatcaaggaataaagtgatcaagaacaaaagggctataacaaacaataggttaattccacccaatgacattcgaaaataaatgcaatagttgaaaagaaacaatagctttaaataggatcaacatgctcaaagggttgtttgggatatgtgtgacttgccttgctggccttggaactcttcaaattcttctctggcgaaaacggactctccg

SEQ ID NO: 48460 - DNA, 2917 bp, Oryza sativa
caggttttagtgggcaagtaattaattaaccaatcacgattgaccatcgtgaactatcattaagccatcattaaataatagtgaatcttaagttatcccaatagtgtgctaatgtttctaagcatggctaagcaatcatatctaatatctagttgaaccaatatatatatagcccaactagtcaagttgtaataacccaaggtatcaaggaataaagtgatcaagaacaaaaaaggctataacaaacaataggttaattccacccaatgacattcgaaaataaatgcaatagttgaatagaaacagtagctttaaacgggatcaacatgctcaaagggttgtttaggatctgtgtgacttgccttgctggccttggaactattcaaattcttctcctgcgaaaacggactctccggaaacgtcggaatctaaacaggaaagagcaaaatcaccaaaacagcacataaacaagcatgaacagtacatgtggatatttttaacatgtagatctcaattttagaaaaatttagagacttgaaccaactaaatccgagctaaaatgaattagttatgaatttttgaagattaaatcggattaaaacacttatatggattttaattgaattatgacgcaataatgaattatttttgaaaaggaaaaggggtttattgcgtcagcggctagggtttgcgggggaccgggcccccggcaacggttcacgggaacgaacggccgaaatcgatccatccaaaacggacggccgaaatcgatcgggtctacggcggctcacggcagacggcccccatgacgtcagcgggaacgtcacctccggcggcggttggggggttcaccggttcgggcgcgcttgctcgccggcgaacgacggcgcgacaacgcggacggagggcaccaggacgtagagcgcggggcggcgaactcaccgatgaccaaaacgtcggcggaagatgaacggacggcggcggcgacaaaaaagaagcggcggagaccttcggcttgacaacaacggcggtgctccggcggtctacagcgacggcaaaggggcggacaaggacggcggcgacttggcgaccacgatggcgacctccccgagcgatgacgacgaccggaacgacggcgaagcacggctggagcgacggcgacaactgcggctcgaggttacacggcgctagggcgcttccgacggcgagagacgaagacaatggtggtggcgggtagcggcgacaccggggatccttttataggggcaaggaggcagcggcgaaggcccacggcgaccggcgacgcgaaagaaacattggggttcggaggaaagagatcgatccgattcgacctcgaatccagaactttccaaagcgatttagccgatgattccaaaagagaaaaggtagaggagatcccgaagattgtttcccctctattgatttcaccggatcgggaaagacgcggccgaatttggaaagcgggcggcgggcgacttgccgctagggtttccggcggcggcggccggaggtaaacgaagactgacaggtgggccccacctgtcagcgggcggacgcgcgcgcgcgagcggcggctgctgctggactgggccgactgggccggggagagagagagattttgggccgactttcggcccaaagccaaaagagacttttaaaaaacctttttcaatttaaattattcatgaaatgcaattccatttattaaaaatacttccttagctcaaataaatcccagaataatctaggaattatagaattaagcaaagtatttaatgaaattttatctggccccattttatattggaatctattaattaaaattagatttctcttctaggcttttaaaataaattctaataattccaattaaacaacaatttatatattttggatttttagggtgtgacaaacctaccccccttaaacagaatctggtcctcgagattcggaagaactggcgaacagatgcggatgagctgacttcaattcatcttctcgttcccaagttgattcttcttcggagtgattactccattggacttggcaaaaacggataactcgatttcgggttcttctctcatctatttccaaaatacggattggtttctcaacataggtcagatcctctgggacttctatctggtcaagattaggcttcttcggtaggtacccttaaacactttttcaattgcggacaccatggacacacattagggactccggccaaagattgaggtaactctaactgataagcaacctctcctcttctactgacaatcttataaggtcccacaaaacgcggtgccaattttcctttggtgtgaacacgatgaactcctcgaacaggcgtgacacgaaggtacacataatctccttcttcaaaactcaaatctctgcggcgattgtcggcataactcttatgacgagactgggccacacgcaatctttctggaatgatcttaaccttctcttctgcttcccttaggatatcagtcccgaaaacctgacgttctcccttttgatcccacaaaagcggagtgcggcacttccgaccatacagtgcttcgtaaggagccatctgaagactagcttgataactgttgttatacgaaagttctgcataaggtagattcttatcccaacttccaccgaagtctaaagcacaagctctcaacatatcttccaaaatctgattcaccctttcggtttgtccgtctgcctgtggatgataagcagtactaaagttcagcttagaacccatctcttcttgaagcttcttccaaaaatttgaagtaaactgactgcctcgatcagacactatttttttagggacgccatgcaaacacacaatccttgccatatacaattccgccaaccgacttccggaataagt

SEQ ID NO: 48461 - DNA, 1385 bp, Oryza sativa
caaaagaccatttaaccttatcataggctttctcaaaatcaatcttaaatattaccccgcttttatttttacgacacatttcatgaatagtttcatgaagaataacaacctcttccataatatttctcccaggaataaaagcagtttgagtaggactaattactttttgagtaacgccaattattctatttgtagcaaccttggtaaaattttaaaactaatgttaagtaagcatataggcctatactgttgaattttcatggcctccacacacttaggaaaaagaataatagtaccaaagttaagagagaataaaggcaaagtaccattatgacaatctttaaaaagatctaacaagtcggctttaataacattccaaaacacttggtaaaactcagctggaaatccatcaggacccggagccttgttgtgttccatttggaaaattgcctctttaatctcattctcggtaaattcttgagttaaagcctcattctctaattgagatacttgagggatatcatcaattttactctcataaacctgaagatcaaaatcatctggaggaccaaataaacctttataataagtggtaatatgcaattttaaattcgcatcaccccttattaattgatcaccatcctgtaattgaaaaattctggtttttctatgcttaccatttgcaaccaaatgaaagtacttagtattagaatctccctccaagatatctttagtcttagccctttgataccacctaatttcctcttctctcagaagcgtagataatctatttgtataatacactctaatatcaatttcctcctgagtcaaaagaatggtttccgtttttttatctagcaaatccaacttatctaataactcttttttctctttttaatagatgccgcttgtatgtttagcccatcccctcaaatgttgtcttaaacgatgaattttagcctctcaacgctccatgggagtattaccttcatcaacattagaccaaatctcttttaccatatcaacaaaaccatcccgtaatagccaacctggttcaaacttaaaactatgttgagcattacccggagacgaagaatttgtatttaaaagtaaaggagtatgatcagaaatatctctattgagagcaaaaaccgaggataaaggaaatttatgttttcactccgttgacattaaaactctatcaagtttctcatagattggatttgctagattatttgcccaagtaaaattcctacctaacataactagctctctaagactcaacccgtcaataacagcattaaaaagaaagggcaatctatcatcataattagcattgtttttctcatcagggctacaaaaaatattaaagtcaccaccaataa

SEQ ID NO: 48462 - DNA, 1296 bp, Oryza sativa
ctattccgtgtcgtccgtcgtttggtgatcgatgtgatgataatccaatggacggttttcaattaatggcaaataaaaccgtccagacaagcttattcaatatacatggagtatataggtatcaaatcgatccatatgccagcgacagcgagcgatatactggcagttttaattactactcatagccagtactgttattactgtacatgtataaatacggccgggatacagctaacctggccataaatatatatattgctgcccgtattcctgtgagatcgatatatattgctgaaaagaaaagaaataaagaatgagtcgtcatcaccagcaaatatgtatgcgtgcgtttaacttttgaattcatgtcgtttgcgcaacagaaagaaaatagtccagcaagacgatgagttgtaaaattttgtttgtatccatctacaggtgatggttggcgtcgttccgaaatcaacacgaaagagaagaaaaaggaaagaaaaaggttggcgtcattttgtagtatatacgtgtaggtgtatttgcttaactacgacgccagcatcggcctttatttcttttgagcatgtagttcgatgggaagtgttagctagctaggcatgtagacacctggcatggcatgcacagcctccgaggccagaatagttgtgctgatgatatacacacaatagatggcacgcatccacgctcgatcggttgatcgatctgccttttgagttttgtacacatccatcttttcctagcatgtatagcgaaaaagggcaagtagtaaacatgtgtacacgcgttctgaacttgaagctattagctatatatctatcttcctcacaactctccttttaattagttcttccatttccacaactactccatatttccttttttctcatttcttcgatttgtgcgtcgaactgcagctgctggtatccagccgccgcttctccgtagctactttcaggccggccgaccgagcggacaggtaaaccggtgtggttgtggcggacagccgtctatcatctccgtaggttgttctatttgatccatctatgcatctgtattgtattgtattttcacgcatgtatgtcttataatatcctcttatccggtcattggtcaaacagactcgcaccagctgctttcgctctcccttattaaattttcaccggcgggtcggatcgcttttccccttttttttggtttcagatctacacccttgtaaaaaaaattgattccttggttaaaaaaaaattaaatcatagggacatatttagataagcactg

SEQ ID NO: 48463 - DNA, 1052 bp, Oryza sativa
gcatcttttaaatggttgtggtcggggacgcagattctctcacccaaccatacagttccttgctcatcctccaagaaaccgatagcttttcctcttctcatattcttcttgatttcttgaatatcagaatcattaatttgggcttctctaacttgatcaattagagtgggcttcgcttctaaggctgcaacaaaacctctactgacaattcccaaatttaatctttcaaattccttgcataattccaatggcaactgtcgtcattccgtagcattgcaatagcctttcctgctaagagtgtgtgcgacaacattagccttttctggggaataatgaattcccctgtcataatccttaattaattcccacctatctccgttgtctcatgttcagatccggctgagtaaaaatatactttaaccttttgtgatcggtatatacctccgtacgagtcccgaaaagataatgacgccaaattttcaatgcatgaactactgcagctaactcaagatcatgagtagggtagttcttctcatgcggacgtaactgatgagatgcataggcaaccaccttcccatcttgcatcagaacgcaacctaacccaagtttggatgcatcgcaatacacttggaaacccttctttggatcaggtaaaatcaaaataggagctgatattaagcgattcttcaattcttgaaaactctgctcacattcttctgaccacttgtacttcacatctttctgaagcagccgtgtcatgggcttagcaatcttggaaaaattctctataaacctccgataatatcctgcgaggcctaggaaactgcgaatctctgaaactgtctttggttgttttcaattagttacggattccacattgctaggatcgacggcaactcctcctgctgagatgacgtgaccaaggaacttcacttcagacaaccaaaattcacgcttactaaacttagcatacagttgatgttctcgtagcttctctagtgcaaggcgaagatgttcctcatgctcttctctggttcgggagtagataagaa

SEQ ID NO: 48464 - DNA, 1108 bp, Oryza sativa
gggcaagagcacaagaagagaacccggggaaaactacttaggactgagaattaatttaacttttattgatcttaagtgagtttcattattacaaaactgaagactctcacaccactaaactcaccaactacctaacactcgaaagcaaacaaacgcatgcacttacatcccaccactgatgtaaatcacatgcgaggcacacacaaccaaacttaaaacaagcaaactaacacaacgatctaagacaacggtttgacaaggctttctaattcttccgggcatcggagttgattgaaggctcgttcggctcgtcttcatcatcttgaattgctccccactcgatcttggaatgggtgcgcttggattcttctacttcatcatcacttatgttgacgaccggagaatccgctagggctggggtaacttttttttccaccacacggacctttggcgccaattggtagcgatggacaaatagagctctcttccttgcggtaagacgaaccctggccttctgcggtggtgcttctcccttcaacgcggctagttccttctccaaacgatccactttgtcttctagcttgcaaatcttaccacgattccgatcttcacgatcttgagctgctaacacagtctccacacggctttcatccatagcccacagcatctcaaccaaatgccttgtggtagcatcattctcaattccttcagtcttaaggtaactgccacggtcacttccctggggttgacggggatggtagcgatactcagtgtcggccaactgatcactgtagcgatcgcggagctctcctatggcgatccttgccacctcctgacatgtatggatgtagtttcttcctccagcttcgaacatcactgaggggatatcttcactattactgttcaaggtgactttgactccgcacttctcttcgtgacgatcatgaggaatctgggcataaaaaggagcagtcccaaatcctatggcaaaggacatcgtacgcaactcctggacaaatccttcaacaccaaacaagtactcaggcttgtagcgcggcatctaaagacaagtgaaaggacggaattaaggcatttattccattaatag

SEQ ID NO: 48465 - DNA, 911 bp, Oryza sativa
cccaccaaagaatttcccaccacctgtgggaaggtatattgaaagaagcccaccttcgcgcgtcgatgttaggactgcttatcctccacttggaaccactggaccgtatggaccgccaaagtatgttcaatggtatggtcgagtcttcaagctgaggatgagagattaatcaatagtcctatctaacctctactgccacggtagtatgacttaaggacaagcttaaggaatagtctaggtatgtggtggcccattttggaagaaaatcgtggtatgtaatatatgtaatatggctgccatgtactccatttatgtaagaacttgttggatggatgtaatagtaactaagaactcgtttgtccttaatttagaaacctctgtgcttgctgtccagaactttggaaaatctgtaaacataagttcatctaagttagaaatctggttataagctcctgttaatatgaaccaacatttatcttgttggaactaacttctctagtgtcaatttaactaactatctaagcttccataaacccacaactgagtagaacttgccactcacccgcgaaataaaagtttccaaatgttttatggtagcaagtctgtcatacaacttaaaagaaattattatctgctgtcaatgtcaatcctctggagatagtcataacttaagccaaccctacccaaatctcggggacgagatttattttaagggggatagactgtaacatacccgaaattttaggacttaaaatttcttgtcaaaatagttaaaggttaacttctccaaatttcaagagccaaaaattccggttttaattaggggaaggaccaccttaacccatggaaggataaattgaagaccaaaataaatttttttcattcccaccataagactagaaaggtcacca

SEQ ID NO: 48466 - DNA, 19767 bp, Oryza sativa
  unsure (1)..(19767): unsure at all n locations
atccccgcgccgaggaggcggctactcattgtggccacggcctccgcctccgcgtcccgcatcactcgccaccgcctcctcgtctcccgccacctcctcgtcccacgctgccgccgcctccgcttcacctcgccaccgccacctccgcgtccaccgccagccgccgactcgcgagagagagtaaggaagagtgagagagagagagagagaagagagaggaagagtggaagagaagtatgacaggtgggtcccagatttttttataaataaaatcctgactggactgccacgcgtacgccacgtaagacaaaactgttctggattgggtcgaggggggtaatttatctggtatcgaaagttcagggtgaacgatgtctgattttcgggtttagagaggtaattcggtcgtccgtaatagttcagggggtaattcgtactttttcctatttcataatatgattttgtcatgcagtgttttttattgaatttttgacatggtacataagacaacacgcacattcatggaccagccgtgacacgcatcaacgagatatgctagtggagtagtgggacatttgcttctttttttttggcaaggaaagtttattagtttgttaaatctaattagtgcacacggccacattgctacttatagaacatttcaaaaaaaaacatgatcttaatcacttttcacacagtagaattgcatcaaaatttatgcatggaaaataacacagagaaggtaaattaatagatacgggtacatatggttgaagtcttatttatatgataggtccagcctcttcccctgtccctcccttatgtttaggagcgagatctgcccaagaacaacccccccctccccgtcctgcagctcgctaacaccatcctattctctggctcgcacaacgaccccaacctcgtcaccaccgaaaggcaccaactgtgccgacaaggcccacctaaacggtctcccactccctaagccaggtggatacgacgtgccccgccccaccatcacccctagctcctcaccccatgacatgagccgccgtatggccggtctgattgcttctcacggccatccccctcccttcacaccaaccttgaactattggtcgaggccgccgcagcctccccgaagccgtcgtgactcatcggagttggaggagaagaatgctaccataaatcttactgcacatctcatgatccaaaattcacataataccccccccccccttccccacaccaaaaaaaaaaattcatggtatgccagttctaataatgcaatatcaagatcgatttggaaggactgttcaaaacggaaagctcccgtgatccttggagaaaaactgaaagggtgcatataaaataccgaacaaatctagaaaggaggggggaaaagcagcgattgtgcaatcgacttcaattgaaataacaagacagaaaaaccacagatgtgagacatggaaaacttacgtgcgcctctcctgttgtatctattttgatttcactgctcgtttggacttcttggcctgatccttctgctcaatcaccaccaagaattcacaattcaaggcctgatccttctgctctcttcacccccacggatgatccaactccttcctgccaactgaatagatcaagagatctcttccccaataatttctgttgggagttccttcaataatttcagatgttgtgctggtggcaacttcccttgatgacaatcccaaaaccctagcttaacacctctaatttctatggcagagaatctggaaggataagcaataggtcttggaatatttataggccaaacaagatctatgccacaagagaatatagattgggcccaagtagagtccaattcaggcaaaaactataggcccctaggaaagaaaggaaattatctatgcaaagtaagttgggccaagtagagtccaactcaaaaaagagtccctgtttttcttcattttttttacaacttaaaagagaccctgttggattcggtttcagctttcttatctgggccaaattaagctggtgcacaccaatataaacagagatctcatataaacatgcagatctgaaattgtttggtctttggtgagacacccatgcagataaaaccgcttgagatctaaacagaaattagaaagcctcagattattaggcaactatatatgattaaatggaaagagacaagtgttgtttaaccccgtttgttcgaggatgttcaggagataacaacggaaacaaatcaacagtgtttacacccaaatttagcacctatggacaaaataggggaaaattatcaaaatttagaaagtgtcgggtttccttcaaagggccggtcagaccgcaggtatgtgggcggtctgaccggctagtagggccggtctgaccgcaggtatgtgggcggttagaccgtcaaggtccgagtccgatttcgtcaggtctcgagtttccttactcaggaaggcatgtttcatgttttctttagtttctatcccgagttggatgtggagaaggcaagaccaacccctatttaagggataaggccggttcattgtaaaaccccgaatacaatctacttaaatcgttcttttaccatgttttctattttaccctagttttagtccatcttcgtcgatttgcgctgtaaattgtccgccgccgctgcgagagtgcgacgcctctctgtaggtttgtcctgaaaaccttccgttttgcccacgagacgggtagttatcctcatatcgatctaaatcggcctagaagctgattttgatctctaaatcggctccgctagccggtttaactgtttttctacgaaacccatcttgatttggccgtttggctagatcgaggtggttggcgactccatatcaccgcaaggcgtttaggtgttgtgatcgtgcttgtcgacttgtcacaaaaagttaccaacaaaactgtactaccgatcattagaattaccgttatgttgtgttctttcagtgctacacatcatccagtaaattaattaaccaataaagaatatttgctgacatgaaagagagaaaaaagaaagataaaacatcattgctaccgttaactgtgcaattgaaaaagaatcgaaattccatcatactacctcctcaggttataagactttctagcattacccacatttatatagatgttaataaatctaggcacacatatatgtctagattcattaacatatacatgaatgtgggcaatgctagaaagtcttataatatgaaacggaggaagtacctttgaacatacacgcctaaggaaaattagactccaatagtactccatataatcgacaaatttactcacataccacagagaaatttgtgtaatgaaactcaattgagaaataatttgaaccagggcaaacagatggaaaataaaaccaaacaaatcaacaacaaactaaaccctagatcaaaccccaactacttaaccaagatcatgttgcattgcataaagaaccaaagttaattactaaaattcatctagatgaatgctggagtacaagaaataggtgggcagtactcatgatacaaacgcatcggttaaccttccccatgaagttgaggtccatcgctcatcgccgtgccgatgatagagccccaccacacgtcacctatggtgcagctcgaaccaccgcctgaagcactctgcattgttgatgatttcccgttccaccacgaatcatcgtgtttgggggagaaggcgagggaggagaggaatttggtggcttttggggtatccctgtagcgaaaaggggttaaatgcaattttcgcgtcacgctatgctgcagaggggacgaacacaaatttggtgccaaaatggagagccgcatcaacaaactaacaaggccaaacgacaaatggacctattgtgctacattaaaccaataatatagacctgaatgtgtattttgcaaattcgcggattctaagtgacaccatcgttcaactttaatgattgaccatatattacactcataataataggagcatggatttatctaaatgcaaatttcattaggctcaccttttccataggacaaggtgatttttcgtggaactctgaataggatggatgattgaacatcatgtccaaaagcttttttcttgaccactacctgatgtgcctcgaagaacaatgtattcaatagaagactagtgtatatagtcgtgcgaatgcacgactttaaccttcctctataccgaatgtcttcacatattattcgtaataaaaaaatatactctatctatttttaatagatgatacagttgaatatgatgtttgaccattcgctttactaaaaaaatatgtaaatgttatttattttgttgtgatttgttttatcattacaacaataataatcaatggtaggatgcctgatagccataactattatgtgcaattcgactttatcattttggtaaggtgaaaatggtaggctatgtttagttaattaccttgtaaatttgctaatgtttattttattttattttattttagttaaactaaatttataataatttagtttagaatatgtgttcactgcaaaaaaaaaaactgagatggtttaacttgtatgctaaacaaaactggagattgagtgtactttatacaatggtaaagaaaattagtaaagaatacaatttcaatagtaagacttgaaacttccaaggtgtttcatgtatatgtggtttttattatagataaagtatataaaaagttactagtatggaaaactcaatctctaaacctatacatctaaagagaaatatttatagggttaaaaatgaaaaggtgccattggtgtgacagactgataggttcctaagcatgtggccttgggatcatgggatatctagcaacttccttgccattaccccctaaacccgaaaaccagtcatcgttcaccctgaacttttaataccgaacaaattacccctctcgacccaatccagagcgattttgtcctacatagcatacgtgtggcaatccagttagtattttatttattaaaaaatatgggacccacatgtcatacccctcttcccctctcttcttctatctatcgctcttcctctctctagctattcctctctcgtagcgcgcacggcggtgtggggacgggcagtgggcgtgggtggtcggcgaggcaggcgttaggcaccgcagtccaggaggaagcagcgatggcgcgggatacggaggcggcgaccgcgcgggacgcagaggcagcgacgttgaactcctccgggagggagcaatggaggcgcgggacacagagaggatggtccggtcttcttcttcaccgtcaggatgggggtggcggtgggcggcggcaggcacggcagcacgcacggcgcagcggcgcagacggcggcaggtaggcgttcggcgccgcagtccggtcttcttcgccgtcgggatggcgcgcgggatgggggcggcggctggtggcggaggaggctggagacggggctcggatgggggcggcggccggtggcggatgcagctggaggtagggctcgggatggtagggtgaccggtggcggaggcggtggctggaggcctggctgctgccgtgcgtgccactaagtgtgccgccgtctactccgaccaccctggtggtcacggccaacgaccttgtagtcgtcgccatcgtccacgagctgcgccatgtaaccggagacaagccgcgcgttcatgccgacggcaaacgagctgctctccacgagccacgggccgccgcccgtccacccccgctgccgccgcccatcgtccgcccccgcgtgctattgcccgttcgcccccgctcgccgcctaccgcgccagccgctatctgatataaccatgtaagatcattatataaatatttaattataacgaatctaatggtataattaaatagtaggttggataaatgattgtagagaaacatgtatttaaattttgaatatttgaatatgcatggatgcatgcacttgacgtgtgcttacgtgcactagctccctgcatgcacgcgaggacttctgttgtctcgggtgaagagacaccgttactaccgtccgatttcttgcgtcggcccggacgcccgatgaaaagcattctcgcaaactttacaacgatagcctccacagtcaagctcaacaaagacaacaagagccgaaaccacgcacgcccggagagagtaggagaaaaatggacactcacttagaactcgagagagaccgacgagagaggtaaagtggcagataggagagccatgtctaaaaatcaagggttaatttgatcaatggcacagatcaaattaacccaaaaatcaaacgggcatatagattgaattgccttttcgaatttgattaggatgctcaattataaagaataaggatattattcttaagtcaaatatcaaaactcttatcgtttcaatttactttgacaggatttgagtcgaatacgaattcagtttctatcttcttataccggacaatacgaattcgcataagtatcgaacttgcacccctgattctgataagcttatttaatgtactagtaccaaataatagcacactaagcaaatgcaaaacacactcccaatgggaagtgaagcaccagctctaccacgagcaaatgagactagcaacacataacaaaccaacgaaacaggcatacaatccagcacaacgagcaaaactatctttaaaggcaagaatattattcataaatgacgcatgatttttatcaaaacgcttgcaaatgatatcagataagtagagtcaacaagacaaaactgtatctgccaaagcacacctccccaactccacccaattacgccattatttctgggcaaaagcaaacggcttcccattcctccccttcaccagtctcaaaccataaaccccacaacaaatcctcctaagtgacggcatataagatgatgaaaacaaagcaggatactccagagtcgtcatggcgaacttcaagttgacacttctcatgccacagccgctagtcgtgctgggcagcctagtaccggtagtgcgcgggcttgtagggaccctcaactggaacgctgatgtagtcagcctgcgacttggagagcttggtcagcctggcaccaagcttgcccaagtggagggcggccaccttctcgtcgaggtgcttgggaagaacgtacaccttcttctcgtacttgccagtgctcttctccttccacagctcaagctgagcaatgacctgcaacaagcacagaattgattcaatcatgtaacttacagctatactcagcatgtttagtgagacaatagatactggtcatcatattttacctggttagtgaatgagcaggacatgacaaaactggggtggccagtagcgcacccaaggttcatgagacgaccctcagcaaggacaatgatgccagtgttggtctcagggaagacccagcggtcggtctgaggcttgatggtgatgcgcttgacaccagggtaggtctcaaggccgagcatgtcaatctcattgtcaaagtgaccaatgttgcaaacgatggcattgttcttcatcttcctcatgtggtcaaccattatgatgtccttgttgccagtggtggtcacaaagatgtcagcctccgagacaacatcctccaaggtgaggacctggagaccctccataagggcctggagggcacagatggggtcaatctcagtaacaatgacacgggcaccagcctgcttgagagcagcagcacagcccttgccaacatcaccataaccgcagaccacggcaaccttgccagcgatcataacatcggtagccctcatgagaccatcagggagagagtggcggcaaccatacaggttgtcaaactgttcagaagaaacacagagttaatatatctcaagcaaaaatgataaaatcattgcaaaatataacagattgtaattcccagcattcagtaatatttcactacagatgaagggtgtactaaggagtccagtaaaatgccattaaacaatcaagctacacaagtgcacaataacgagtaaaataaaacaaatggcaagcagtttggtaccaatattttattccatattctgtcatcagatccgcaaaacatgcaagctaacaacaaaactagacatctttgacagctacgcaacaattagaccaagatttagatccaaccgcagtaacctaagacttaaattcgacgctcctactcctataacacaggagacactaaataaaggaactacaagcatcccgtctaaatcaagcaaccaaacgatcacgaaaagcaaaattcgcgcactacatcaggtgcaaatttcccccaattgttagtgttgcttaggtaaaatcaactaaacctttttaaccctgtctttttagtttgtgtcacaaaaggagatctagatgacagatccatattcaacatgccacaaacatcaggaatctaaaatgttaaagacacatgtataatccacctaaccaccactcctatagcataaactttttttatgcgtaatagcccaccagatctactgaatcaaccgaagcagataaaccagatccagatccacagtagtagcataatcaaatccataataacggcaaaatcaagtagtactaaggtaagaacagtacaagcagcaggctaggctaacgcaaacagcttcagatctgaaatataatgggattagaaagggagggaggggatgcttcaccttgctcttggtgacggagtcgttgacgttgatggcggggaagaggagggcgccggtctcctgcatctggtagagcctcttgacaccggtggtggtctcctcggagactccgacgagcctctccttcatcttgcggtacttgctggggtcggacttgaggccgtcgcggatgatggtgagcacgatcttgaactcggcgttgtcggtggactccgggtcggggaccttgcctgacttctcgaactcctcctcggccttgacgccctcgtggatgagcagcgtggcgtcgccgccgtcgtcgacgatgaggtcggggccgccgccgacgccccagtcgaggcagcgctcggtgcaccaccagtactcctcgagggtctcccccttccaggcgaacacggcggcggagtccctggcgatggcggcggcggcgtggtcctgcgtggagaagatgttgcaggagcaccagcggacctcggcgccaagggcggtgagggtctcgatgaggacggcggtctggatggtcatgtggagggacccggagatccgggcgcccttgaacggctgggaggggccgaactcggcgcggcacgccatgagccccggcatctcgacctcggcgagctcgatctcgaggcggccgaagtccgcctgggagaggtccttcaccttgtactccctccccgacgaggtcttctccacggagagcgccatgcagcggcggcggcgagctcttcctggatcggatctgcgacggcgagagggtgggtgggtagagaggagggaggaggaggaggaggcggagtgggagggtgggggtgaggtggggttttatggagggagaagacgaaggggaggcgttggatctgggtgagggggagatctgggccgttggatctggtggggattggtggggtgggtgagattgggaagttggtgatgggtttggggttttgtgatgggggtggggggaagaggtgatccgggccgttggttgcgggggccggcccatcatggcccatctgaggaggaggacatcgagatctgaagaatccacgcgtgctggtttggacagtcactgtttcacatgacttgtcgctgctccattcgatgcgaaaaatatctccttcggacacacagagagagagagagggggatgggtttcagatcgcgtcggcgcgccgcgtcggcggctgcaccgtcatgcacacacgatccaaaccggggagcttgttggtgtagatcatggcggacccacgcacttgccactcagatatgtttgagttgaattttactcaaaaaagtcttttaaatttagtgaaatttgctgagacaggggacgcggagccctagagagcttgcttaatgacatggtgagtgatcttaggccattcccaacccaatgactaagatggtatccatagtattaaataaattgccatctagaataaaaaatgatatagcaaatgaataaatgaggaaagagaatttctacacaacatccaagacatcatgtgaaataagtagcattaaatttaagtatagaataatgatgtttgcattggaaaagttgtgtcttagtactagtttcttggtgatgtgaagtttttggaaattatatttagtgtcttgggttaggaatggccaaacgaacacatcaatccagagaggagagcaatctcgagaacctagttgtgtgcgagtaatgtagtatttattgtagtagttttttcaccattatattcatcctattgtgtattaagaagggatgtcgtcgttgattgtagctttagtctacttggcacatagtctcgcataatatcatacttataagaccagccactctcctgtaaatgttatagcacttaattattatagttataatatgtagccggtatgttttcatttcctaagcacccaaatgtgtcggggaaaagacaacatgctattttgtgagctcaccaatcatcttctatctttatatgtgtacaaagacggtgtttaaaaaaaaaacaagaaaagacatggtacccaagccatttttgacaagaagctagattttgcgattacatgctctggtggctgttggtcagttggcgtagttgtgcattactgcatgtttttatgtttatgtgcttggtatgtgaaggttatgtgaattcaattgtaattccattaaagaaaaagcgaaccatttgttgagggtatcaaaatgaaatactccctctgtactcgtaaagaaagtcattgacgaaagtcatttaggtcaatgttaagtctaaccttgaaaatataaatcataaataactcttaagttgttgagtttgaaaatgtaaaaattatatgaatagatttgtcttcaaaaatactttcataaaagtatacatatatcatttttaaatagatattttttatagaaataagaagtcaaaattgtgttttggagactgtgtccctgtccaaaacgacttactttacgaatatggagggagtataatactgataaacattttgggacaagtgttgttatactactccctccatccctaaatatttgacaccgttgacttttttaaacatgtttgaccattcgtcttattaaaaaatttaagtaattattaattctttttctattatttgattcattgttaaatatactttatgtatatatatagttttacatatttcacagaagtttttgaataagacaaacggtcaaacatgtttaaaaaagtcaacggtgttaatcatttagggaaggagggggtattttcaaagaaacaagaagtgtcttaactatatttttgtccaagacagacctttatgccaaccaggagtccaagcatgaataccaaacttttggtgacagtgaccaaaccgcacgaaattcagtgtcaccacaccaaagttccacttgcagtttaggtgcaatggcagcagatttctccgagctgtttccactagtattattaattaattgttcttttcctacaccaagcctgtagaaaaaactcaatgtccagaaagtgacatacgaccactgcaccccaaacaacaattaatcattaatcagctgcatgtaactcgtgttaacgcatcgttgccaaatcaaacacctaccactaaaccaaaacactaattaaaccacataataatggagcacgtactgaattatagcttacaataagttaaagttgtgttttggagaccgtgtcgctgtcctaaacgacttactttatgagtacagagggagtatagcactacatacttggggggttcaattattatttatacactacttcatcgaagataccgtcatgatgatcttgcttatttgatcagctcacatggtttattagttatcgataaacttaaactatgtgcaaaattgttgaggtgcgaatggtatcgtagtaaaaggtagtggcagtaggagcaaaggaattaagaaagagagaacatctttctttgaagtgtgtaaagaccaaacaagcatagccttgcttagcacttactccgggattaagatcttaatggaatgttttgactaaataagtttacgggaatcgacgcagctgtcgccatgtcaactaagatccgtaaaaaaacatggagatgtgtatggtacataaacattgtcatttatgtccattataggatttgcttaggggagtttctgataactacagttttttctagaatctttagctgctagaaactccttcaaacaatatagattttcatacaattcctatgaagctgcagttgtaaaatcttagaaaattagttagaagtcagaagctaaactcagcttctccaaattctcaccaattagcttctaaccagttgtttctcagaatcttaagctcctaaaacaaaaccctaggatgaatcaaatttcattctagattataatattttaggacaaagatagtaatatcttctctactttatcccgtatcttatgtctatatgaaacattgcacaagtttgtttttgacagaaaacaaatattgcacggcacgtatatataaggctgctcaactattctctccatcccataaaaaaacaaatccaataaaagatgcaacacattttaataccataaatcttctaatcagtactaagatttgtcacataccgtattagattgtttttttatgggacggagcctagccgccattgattgacgccgacggcgcacgtaggatcacacgatccacaccacacgtacaccaggctcatcgtccgtcataattttttttcttaagccattgagtccgatttcacggataatttccacgataatttgtggggttggtggtggagaagcgcccacccgccggtggctgcccatctttccctttctctttttatggagtcgtgggggcaacgtcgccgtcggttcatggttggtgcatgcagccaaactccccggtacttgtccacttctaaattataatcttaagaaaaaaaatagaggctagtccacttaatttggtctcacattaaaaatgcagatatattgtttggcctcgcaaagatacaaagcatatttcttcaccaaccacacgagagtgtacacctaccgattcaactgggacagtgagagtggggcccccatcatcttttaaaggctaagctagcactagcactatcacatgttaactcgttgattagggcgtgccaaacatgggcatttttgttttagctacactttgtcaggaggataaatcgttttgctctggactagcaagagctaattaagtataggaatttagtttgggatgaaaaggtagaataattaattcttcatccatcctaaaatataacttcttcggtaacattctctttctaaccaatcgcaactctccactatttacttttttctcacataaatttacttcttaaccaataacaacttttcaccatttgattatatctattttttttattaaccgtgttcaactttaaaacttcttatattttatattttggacggaggtagaaggttttactaatgataagatggtttgtagctaggaagcctagacctaggcttgggtctggtgggcttgggctaggccaagttattggcctaaaagcgggcctatcaaaacagaagagattatgtttgaatgagatatataggtggtgtttgaatgtctaatgaagattaaggctctgttagttctggggagataggggggattgagtctcgttttccacgcgcacgctttttaaactactaaacggtgtattttttataaaaaatttctataggaaagttgctttaaaaatcatattaatccatttttgaaatttaaaatagttaatacttaattaatcatgagctaatggctcacctcgttttgcgtatcttcccaatctcctcaatccccttctcctcaaacacacccaaagtgtttcacgcaaaacgaggttgtaataacgtgtgattaattgagttttaattattccagatttaaaaaatagattaatataatattttagaacaactttcatatagaaagttttcgcacgaaacgtagtgtttagcagtttgaaaaacgtgccacgagtatccaaaatttaatccaacttttattggacaaaagaacaatgccatattctaataatataaatctagagaacagatatctcattcagctaaaatcctagaatattaggatggaaagagtacattatagatagatagctgttggcagtgtgccagtgtcaaatacgggtaatgattgataatcaaattgacttagaggaaaattggagataagaaagccgatgtttatttgtaatacgatcaaatcatttgaatagacagcttgttataatttcatataacatttaaattaggtagagtttcgttgttctctttgtttgtgagtcattaacgcgtgaaacctagtttgttggaaataaatcttgccgatctctaaagcactcttgcacacaaaatcaaaagagatagagcccgaaacctacatgaagaatatgctaatcagtaagtgaagaattggttatagtagcaatggaaagtgaactcatgtgtgtatcaatacagtccaggctccaaaacgtcaggaacggccagcacctatcaaattgctgttcaatcgggtagaaaagcaaacttcattcaagtcaatggaatgtaacctgatcgattcgatgagatggaaatatagacatactcccttcgtttcgttttatttgataccgttaactttttagtacatgtttgactgctcgtcttattaaaaatttcaaataattattaattcttttcctaacatttgattcattgttaaatatacttttatgcatacatataattttacatatttcacaaaagtttttgaataagacgaacggtaaaacatgtgctaaaaagttaacggtgtcaaataaaacgaaacggagggagtatttaatttacaccatagcatttctgatcccaaattaaccaccgaccacatggaggcggaggcaggcaggcacacatcaactcgatcattttgctcggcccaccgactgaccgaccgatcgatcgatgagatcacgcgtagaaagcatgtcgtcggcaatgatattatatatattcttccattttcccttgccatccatcgtccatctttccttgctcctctcactaactcactcactctcactttactaattagtagaaattagttgccatcaagtatagtattggttggcaagatctgcagatcagtcaacctggttgcagctagctgagctaccaccaaattaagtcgccattagttcaggcatgcacaccatggggggttggtggattctgctctgacggctcagtttttctcctcttttcctttctactggcaaagcatgtctctctcatttggttggttggttcagtcagatcactgaatcttttctttttgtgaagaaatttttatatatatacgctgccttggatctgttcttcaccaaccacaggaatatgcagtacgcctaccgagttgggacagtgaaaggtgcccggatattccaacacttcgctgtcatttttttgccaaactgaaacttgcatatggtcttcacactacctttcttggttggagatgatttccaataataaattcccgtggatttttaagtgcatctccaagggtatgatgggctaagatccacgagtgctgagagtgcggcccataggccagcaaagaatgtggctttcagctctaatttgagccttcatttcaggtggaagttgaactataccagagataggaaaaagtccaacttgactccctcaactatagccaacttgactccctcaactatagctcgaatcttatccctatatctccaaaccacacaactactcctccaactattaaaacatgtgcaaaataactccctcggcagtattaacggtcgttttcgatgatgtggcacgttgacacagtatttatcctatgtaacggctaacgtggcacttatgtgaagtcacaatcaacaaaaaagtaaaaataaaataaatgggacccacatgcattatcgatttcaataaaaaataaaaaatatgtggagcccacatgttagtcccagcatagggcccacatgtcatccgttctcttcctcttttctctctcccctccctcttcaccctttcctcccctggctagctagccctccccccctattctccatagtgacgaggatgttgagctcgatgactgctaatactagccgctgagcgatggtggcagcnataggcagcagcatggatggactatagtgcaatgagggtagcaggatgacaaccacccttgcctctacaccacatctaccattgggtcgaggtaccggtagtgcacagcgagttgatggtgactcctggctccagtgtggcgtgatggagggaacatgacaacggtggtcagtgagccccatcgaactcaaccttgagctaccgcatccaccattccaccgaagcttaggcggtagcagatttggaacacgccttgctcgagcttgagtaccacgcacatgctggcaccaccccattgagttcgagctctgcgggaaggggttgtggcagtggcacccggcgagccctgtcgaggtcgatctcgcccacttgtccgcatgaagggaggcattggatgtggctgcccgttgaggtcaagcagtcgagtcagatctaagcgcacagatgagcctgcgatgatgaagatggccgtgggcaggagggcgagacggtggtgggaaggtgtagatgtcctaactcatggcatagaggtttcctctttggctctagctcctgctccctgccacagtgctaccaccttaaagtttatgttagttaataccgaattaatcacactaattgtcagggttatggataccacatacctaatagtagttgactaaatctcagcaggacccaccacataccatgtcttatacggatacaaccttcggatataggaggagttccgcataaggaaggatgaatagagttctacatgaaaacgacaaggactactcggattgtatccatattggtttccctagttctacttggacaaggggacacctatgggtataaatacaaggccctataggaggagaggggagacggacaatcaacatagacgccacaaagccagaagccaatacaagccaacatacgccaagacgagctgccggatatcgacatcaaagatatgcctggatcgaccctattcaatacctacagaggccggccgtaaggatctagcattgtctctgatctcgccggacacgaactcaaggaggaagactaccctgttgtcgactacgagtcagagcttcagaccgccatatcgacaacagttagataggctaccccaaatattgtacaggtgtgattatggtgaataagatcaataccggcttcggccaacaggatttagggctattacctgacaattcaggggtccgaacctgtataaaattcctcgtccccgtctcttttactacaatctcgcatatatcctggtaccaatgatccccatactatgcaaatactggaatcgcgacatcaaacattgacactaatcaccccatttcgactttcaaaaaccaagtgtcagaatgcaaccttattcgaataggctcaacgtttgagctttttaatgacacgtaaaataagaaaactattagcatatgattgagtgaatattatctattacaaatttaaaaaattcatttcatataaaagtttttttttaaaaagtttatcaagctcattgaaactcagagtaaggttgtgttcaaaacaaatgttaccttcaactttttaattgtacatataatgggacggattatttgcgcgtgagaattaagtattaactatatgttggaagatagatttattttatatttttaaatacttttcaatgaattttttttcacaaaatatgtcgtttaacagttaagaacatgctcgtgataacgaggaagtcatgctgataaaaactcaacctaagctgattaataaccattttaggacctgttgaccaaggttagcagtaggggaacaaaaatagtgtattcaaacttagtggaagctacagcacttagcaactactgttacaaccgctattgacttactgcgcttaaataatacaagatgggtaccccgcgtgttgctaagggagaattgtgtgataataatatatatgagttctattttttttcttacctactatacgattttttttatgtgtttatatatatttttgtacctttattaattatctatagtttataaatgattgggttgtatggtgtgccttttgggggaatagatgtaatttatacccttgataaatcgtcaaaaggttaaacacaattgaggtgatatgaagagatgcaatttacacccttgatgaatctccaaaggcttaaagcaattgatgcgatgtggcttcatgagaggagagagaattagcattaactatacttaggctctgtttgggagtgagggctcactccccggcacacaaaacgaagcagcgttttagtacgtgactaattaaattttagtttattttttttaaaatagattaatatgatttttttaagcgactttcgtatagaaactttttgcaaaaaaagcaccgtttagtagtttgaaaagcgtgcgcgtggaaaacgaggaggaggagttgggaacctgtactaccgaatggagccttagatatataggtttccttatgcatgatagaaaaaacataatgtcatgtgttcttttatcttgataatatatatgtcattttgtaaaccttgaccggggttagattcgttttgggtggcggataatggtttggtatgtattattgccataaaattaaatctatcatagcatatgcaatctgcaatttgctacctacactaattcattaggggctaccagattgctatttgccacttattatcttggtgaggatggagaaacaaactcattagcatataggtattatctttctttttagcggcatagaacagaaagaaaaaatataagcttcgtgcataatcttcaaataatcaactcctaggacacgtcttcgccgtctgtttgatatattctatttgcggttcttcctctcttctttcttcttatttctcttatagtttttcttttggttgtgtcataagggaaataggacaccggccctatcaagatctaattgtctgcttttagcttgatgtcgatagccttcgagtcttcaccaggcatgagatagctacacaaacctcttctcggttcaagtcgatcggacgattaggtttagggttttagcaaacagaattgggtcttcattttcttcgtctgcgaactctcccttatgcagctcgggggcttatcttgtattaggattcgaaattagttttttacatgtcacacaaatcagttccttgcatggatatgtctcacggacagag

SEQ ID NO: 48467 - DNA, 33340 bp, Oryza sativa
  unsure (1)..(33340): unsure at all n locations
ctgttaggtggtaaaagaagtccacatttttttgtagtttaagctggaaacagtccgctaattttgattagagaaggggtcattaacaaagtctcttaatatagataggaaaggaaaaaggcagaacaaggaggccactaattgaacctccaagcttttgtctaatcatcgagctaaaatgatttaggggttaaatatataaagagaggacttttgtgagtcgttaccatttcaaaatgttccatgaaattggtatgcagctcagagcagccgctagcacacatagcacacactgaatgcagctttttttttaggtgaactgaatgcagcatttttagtggtacactggtacttctatatattcacgttgagaccattgctcaaagctcactgaggatcaacaaatgagtctataggaatatatcaaaggaggattcgtccttgtgaattttcttcctaacttgctgtagtttgaaaaattcttttggattacaatcctatatctcaattccaaaggaaatttacatgtgagctcaaaccttattttatttttcctttgagaagtccaatatgcatcttctgtctttatctctcacatctgtatataatccactaatgttccagttcacttttctatgatccatctttcaaattcatgtgtgctaaattctagtgcattgctcttttcccatacgtatacctctatttttataatcgtgagtttcaaagtaacatagcatacaatctagcacatctaaatatgagcttgcatggtacgacaaaacacagggggtgaaggtgagggtaaaccataatgtggtctagatgtgatgtagatattgaatttgttgaaggccggatatcaataaagggtaccgccaacaagtatgcgtgagttcgtcatcttctagatctaccttatccgttgccgctcccatgcaccttaatatttgtacaccataccaaccaaagttggatcttggggaaaaaatcaccagggtcacttgtgttgtatacgttgtaccatagagtcaatcttgttttcttaaccgtgactaaatgatttaccataaagtttatagaagttcactgggtcattagacccgttaataattacactttagctctacccttgatatatactctcacacctattacctctccatggctcgtgacactgtggctcatgctcgtgcctacctcgatggctgactgtccataggttaaaaaaaacaactaatgtatagtagcattggcatggctggctttagtctagttttacacatctacacacgttaagttagttattcatacttttttttattctctatgaaaaagtatataatcttagaaaaccatgatatacataattattgatggtctatatcgctcattataaacctgtcacatattatttttataaaaaaaatttaaagaatgcacatctgccttaaacaatcttcgaaacattgagaccgatagctagtaccacgagactctacccccttgcttcgttatcttgaaagataatgtatctacacggttgtctctattgggctatcatatttgtacttccatatcttaaaattgttgatccatctgtatccgtgtgtagctagttgggacagaggtagtactaggtatttttgcttgtatatgctcaattgctgaaacaatctctgttttttttttgaaaggagcacaacacgggaggcccccgctggtagaaagatttgattaaaaataaataaaaaagaaaattacaaaaaaattgatccaattcaagattacatccttatctctctccttaattctaaacagcagaaggaggatgtcaccctttaagagttgcgtccaagaattcaaggaaggaattttttgctcaaaaataaaaccattcctttatttccaaatattccaagtaccatataaaaatttgtccatgaagcactgtccctgataaagggattaatttgcatggcgcgacatactttccatgctcattgaagtatcccaataaataccaagaacattccaacaattctgtgtaaacgagcattgaaaaaagagatggatcaagtcttccatagaattaactggaaagagcacataacttagatcacagtcaggaggagcacaatgcttatgacccaacatatattttgtatttagtctattcatcaatagcaaccacccaaagactttaactttcgaaattgccttgcactaccataatcagagaaaataagaaggtggctgcatagctctaattaaagttcaaagcataggatttctgagaagaatacttcaaattaccccaaatgtattcccagacatctctatcatgagacagattcacatcatttaaaatgactaacaaatagttcagctcttgaaaagcttaatgagagaggggtaaatgaaagttatcctcaatatacgtagagagaaagttatgcaaacctttttcaccctcgctttcatatcaactacttcctccgtttcacaatgtaagtcattctatcattttctatattcatatagttgttaataaatttagacataaatcatatagttgttaataaatctagaattattaacaactatatgaatgtgagaaatgctagcatgacttacatcgtgaaacagagtgagtatattttagagtaagaaccacgtgatttcatgtcctcgaaaaaaaaaagaagaaaatccacatgctaacatgccaagttcaaaagagacgtacacttgcacatacattacatttcttttctttagaaaacaacattactacattcttttcatatgccctatacattgctccaactcctgtgtagcgttgtttgctccgctagccaccacacacacacacacacacacaaattaaaagaagaaaaaaaaacgcctcaaaatgtactccctccataaagtaaatgtagttttataccggtttattgtgctaacatttggaccggttcgctatccccctttcattttctccgtttatgtctaacatttgaccgttcgtctttcttgaaatttttttatgattagtattttttattattagataataaaatattaatagcactttatgtgtaactattttttaaaaaaaaatttctataaattttttaaataagacggacggttaaacgttggatacgaataccactgctgacggcggacacctcagccgatgcagagatctccgcacgaatctccacgcctccttatccccgacccaaacatcgtctggctcgcacccgcacccgtaccaaccccgaccgagcgagccgcatacgcattccgtcgaacacctcacccgcacccaccaccaccaacctcccaccccacaacccacatccatgtgcacgcgcgccctcctctcctcctccgctatatatcccctcctctccacccctccccaccactcccctctcctcccgcctcgccgccgcaaccaccgccgcctcgccgcagcatcacccgcagccgccgccgccgccgccatggactccgtcgcgtcgtgggggctgaccccgctcgccgcggccgacccgctcgtccacgacctcctcgagcgggagaagcggcggcagcggagcggcatcgagctcatcgcctcggagaacttcacctccttcgccgtcatggaggccctcggctccgcgctcaccaacaagtactccgaggggatgcccggggcgcgctactacggcgggaacgacgtcatcgacgagatcgagaacctgtgccgcgaccgcgccctcgccgcgttccgcctcgacgccgcgtcgtggggcgtcnnnnnnnnnnnnnnnnnnnnnnnnnnnnnnnnnnnnnnnnnnnnnnncacgctcctcaacccgcacgaccgcatcatggggctcgacctcccctccggtggccacctcacccatggctactacaccgcgggcgggaagaagatctccgcgacgtcgatctacttcgagagcctcccctacaaggtgagcgccgccacggggtacatcgactacgagaagctggaggagaaggcgctcgacttccgccccaagctcatcatctgcggcggcagcgcgtacccgagggactgggactacgccaagctcagggccgtcgccgacaaggtcggggcgctgctcctctgcgacatggcgcacatcagcggcctcgtcgccgcgcaggtataaaaatcctatccagtccaatcctcccacccccaactcgtctcgattagttgttgcatttcagaaatgaaaaatgaaatggggtaaaattctgtccgccggcatttgcttcgttgctgtctgctgtaaaggttggatttggggatctggatggtgagtaatcccgagttgggttttagagtgaattggatgcccgatctggggggtttggttgattggatctacaccttggtcccgaaatatagcaatctagtatcggccgagaaacattctaatactatgaatctggacatatctttgccctattttcggatggaaggactgggttagttgggtttggtggttgtatgtgattaaactatgtggtaactttagctttatacacatatatctataaggacctaaattgggtgaggggtgttggggttgtttggaataggcaaatcttggaaggatgtatgtctctttgtcttctagcttgttttgtttattagcaattcgatacaaaatttgagtctttcagtgtgctttagtgcaattctttaaatatgatagatctggtagtctgtggtagaggatttgttttcctgtgttcggtcatgcaacttgccgagcactctgatagtggatacacaatggaatcctagttgtcttcaatcaatttgctattttgcgctcgcccatctaatttgtttgttttgggtgttatagggcacaatatattcatttgtgacaagttgtgttttgcttcatcttatatatttataaacattgttatgaaacaatagcttttttgctgagtggtaacagatctctaaagaattatctgagtggatattcctgttagccataagaatacatgtttgacatattcctcaatttcttattacgtgcaccgatgctgggatataaagggcaaaatcataagatatactgttcattcaggttgtttttctttggtgtctggcatgtctgaactgtatgatgatgtattaatgttaattttagtcctatagtctctaaaatatgcttgtttcatttatttaggaagctgcaaatccttttgagtactgtgatgtggttaccaccaccacgcacaagtccctccgaggaccaagagctggcatgatcttctacaggaagggccctaagcctcccaagaagggccagcctgagggtgctgtctatgactacgaggacaagatcaacttcgcagtgttcccgtcactgcaaggtggtcctcacaaccaccagattgcagcccttgctgttgctctgcagcaaaccatgacacctggattcaaggcctacgcaaagcaggtcaaggccaacgctgtcgccattggcaagtatcttatgagcaagggctacaaaatggtgactgatggaactgagaaccaccttgttctctgggatcttcgccctcttggcttgactggtatgcagactgtttttgcattcttcagtataattgctgttaatttttaattagtgctattaaacttgtcctaatgttggtttactcatgtaggcaacaaggttgagaagatgtgtgacctttgcagcattacacttaacaagaatgctgtctttggtgacagcagtgcattggctcctggcggtgtccgcattggtgagtgcattccccttcacagaaaatattatcatgctaatgtagtaacatcttatagtccggatcttgctgattgctatggaattgattcatggttacaaaacacaactctgcaaaatcatgaattaatctgatgcgaattgcttcgctccatgtttcactacagagcctctgtccatagatgatagttatatcgaacacaagtgctactactggacctttctttgcacaagcaagtatctcagacggattctggctggttttcaggtactcctgcgatgacatccaggggtcttgtcgagaaggactttgagcagatcggcgagttcctccaccaggccgtgaccatctgcctcaacatccagaaggagcacggcaagctcctcaaggacttctccaagggcctggtgaacaacaaggacatcgagaacctcaagctggaggtcgagaagttcgccacctccttcgacatgcccggcttcaccctcgacagcatgaagtacaaggagtaggaaaacaaaaacacacacaaaccatggtcctaccgccgctaatcgtcgaccagctgtgctctcgtggaccgccgtcgtcgtcatcttcttcctcggcacaagctggccctgtgttacggattttgtctgcccatcgagatgataggtttcataaaacgctctctcccccaccctgctgctgcctctggtttggttgccaacctcatcccccatcggtttttttcctcctcttgtttctaatttctaggagctgtgccttttggaatcatggaatgtcaagtatttgccaataatcaatccgtttgatttctgcctaccttgtgttttctgtgggattgctaaactatcaaactgtgcgaagctacgaaaaaaagaaatgctggaatttttcagagttgggtacatggatgtgccactgtcgtgcagcgcattgccaatacgccgactgctgtagattgcaacgtgacggtacgcgtcgcgcgttggcggctactagcgtttaattgtgtagggatctctgtgcggcgttaggtctcgccatggaagggaaagggagaaagccattacactagctgtacaggacggtctggcctggcggtgcccacacatgctgtgaggagcgtgtggcaccgctgctgcaaccacaacaacattgatgtgcttttcacgtaacctttttaccttacgtgccgtccttttttagaaaaggaaaactctcataactttattagatcaaagagcagttacatcgctcactaaccgcttaattgaacctactggctcctccaaccaaatagatggtggattaagccaggctgctctagcaagctcgtgagaaactaaattagcctctctaggacagtaaaacaagagttaccaatgtagaagcttcagaaagaaccacacattcattatagatcgccccagctgctgtcgtcgagaaccctccattttgcatcattgtgatgacttcgatacaatctaacttagtgatgattcgatcaacttgttgacctctagctagtaaaattccattcctcaaggcatgaatctccgcagtaatactccatgcgatcatttgcaatgctatgtactctactttatcatcccaaagaacatctcctggcaatggcatctacattcaatttaaccattccctcttatggttgacaccatcccgatctagcaatgcctatattcctcgggttggcttttcaatagtttaggggagtacaccaatagccattgccgccctcgttggttcttgcaccttctcaccatgaaccaattttctcccaccaaatataccagatacctaccaagattagaatctgagcactcacataggcaatcaaacttgctttctcatcacaacataatagatattctagcgatgtcgaacctgcttgtgtcatcttttgtaggggtacactgtactttcaaataaccacgtagaattcatgttgttttctttgagattagatcttcattggtcgagactattgggagaaggattaagggtgctttctagagagaaggttgggaatttctctcctgcacacgtaaaacgtgatgactcattagtacatgattatttaagtattagctataaaagcttgagaaattttataaatacgatttttaaagcaacttgcctatagaatatttttaaaaaatacactcaattaaacggtcgggaaacgtgtacgtgtaaaataagaaaatagaagttgaaaacatgtagttccaaacacatcctaaacaaatattactgtcacttcatttccatttctctttgaaaatccttcaaagcgtgtagacggctccccagctcatgccgcgccagtgtccgacaggcgacagttttgcgactctttaacaaacttgtttagtcacttctgctaccattgaacggttgaacctgaagtaattttattactaatcacaaatttatggccatatagtgatgatattgtaggatcgaatcacaagaactaagccaaccagaggggggtgaatggttggtatacccaaaaaccgaaaacttttagcggaaataaaagttatcctcgaagttgatggattgcggtctgaccgaaggtattgcgccggtctgaccgcctgatgaacgtcggtctgaccgatgtagatcgatcggtcgaaccgccgagaagcctgccgcccctgtcgctgccaccggtctgaccgcccgtatgccgccggtctgaccgccggtagatcgccggttagaccgccgaaacccgatgaaacacaaatcgaagaactcttaaagtagatgacgactttattgattctctctgtgtttacaaagtgcaccaacagcactccttacaaaaatttcgactaaactcgaaaccataactcaaaactcaactcaattgctctctaaagcgataccgggaagcctcacactccctctctatatatacccgaggtaggcagcctaaagcccacgaaccaaactcatactaagagtcctaaacaccttaggaaaccctctagtacaagaaaaaaactttacataaccaatcgtaccaaatttggagtccttccaaattcgactccgcatctcatacgcacacaatacctccatcgtatgccatatggaatctccatcaaccacgtgcattaactctagcctaagtatctcgcatgatctctgaccaccacagacgtcgtcttatccccaagccgactcccggtccatcaccgcaaatactctcccgaggcatcgagttagcaaacaacagtattacatacgtatagtatccatctagaagccataatcatgaaataatcacggatatccaaacaaacaacccgaaaccgaaaccgacacagcgtcggtcggtcagaccgtgagctggccggtccgaccgctcgaccaccgccggtctgaccggcatgcacagcccggtctgaccggtcacatgaaataataaatcctgcgatcacctgtgaatctaaatatttccaaaaaccacttcgtgaataaattccaaataacaaaaccaataatctccaatgcccaattgttcatcatagaataataaccaaaaaaacacctttgattttacagatattcacataaaaaatattttaccccattgaaatgttcttgtaattctaattcatgttgctcatttacatctccagccaagaccggttttattgcagttgattatctagatgattatatgtataaattaaatattttgatgaatatacttaacaaatagcttaaaacaagagaactaagcaatacgataatccacaaaattaatccagtgaaatagctgaaaagaacaatactcctaacttcttccaacagttttcatgaaaattggttcaactttcatatgaactgggaaacaaaaatccagcgaaaccttcgacagttaggcatccacaatgtgatgcaaatatagtccatagataatattatattttattcagctacctattaacattatgtaactagtccatatagagaaaacaacaaaagatatccattaagcatatggactacccataaataaataatactatctatctctatttctctctcatctcctaagagcatccacaatgtgagccactcctagagtgtcactaactatgaacactcgtaggggaactcagctcacactgggagatacccctggatgggctcctcaaaatctgaagcaacccggtgaggatactatagcccacaatgggtgtcttggcccaaagtatccctagatgaaaaatccccaaataccccttcctgccagcctactctccttttccttctcttttcttccgccctctcttctcgcttcttttcgcttcgtcgtcgcccatctcgccgccaccaccacctccctcctctctcccccgccgctgctcgcctctctctcctctctctcccgccgccgccgctcgccatccactcttcctcgccagatgtggccggagtgcgagggagattagaaaggccgccgctaccgccggagcttaatcggcgagggcgacgaggagggccgcctactccaccaccggatccatctctctctctctctctctctctcgtcgtggggtcatcgctggaggctgtgtgccgcgccgccacccctcttcctctgcctgtcaccgacggggagccacgcgcggatctggcatgccgatgcggtggtcaacagcgagatgtggccagatctggtcttcttctctccctctcactgccgtcatttgcctctccctatccctctccctctctcccatcgaggtggtcaacggcgagccaccggtggcgacagcggcggcagatgaggacgaggaggtcgccggccgccggctgtggatgagggcgagggtacaaggggaaatatcggggtagggcgccatgtccacgagctccccacgcttcaatgcagtgcctggctcagaccccccacgaaaaagtaggcaaggcgcggagggagccgcgtcccctgcgaggcgccgcgctcccctgctagggaacagatcagcctcaaaaagcgacgggaggcggacggccgtgaggagagacacgggttgaggaggtgcccattgctgatggcctaatgctaccttgtatttatatacattgtggagattgctatagttaaaatctctttacgtgggtctatctatgtggatcactttagccatggcgatgccaacgtcattgacctgcgatacaaacacactgtgcaacagtcaatttcttgtcagggcagtagggcactatttggggagtgcagcgcaggccggtgggagaaatgtgggtagatgacatttgtgtgattgtgtcggtgcatccatgtgatctctgcattaaggattggtggctgactacaggtcagcatgtggtcttcttctttttttttttaactcaccaaaatctctgttctttaaagaatctccctcgaaaaaaaaatccaaattcatgtgatatctcttgtctgtagttacaatatctaacatagtagcacttcggagtaatgctcattgttttgttactgagacactcaagtagatgtgtgaatttatgaagcaacagtgccagtcataatctattaagagtgctttctgaatttattcagacttatacccttctcttctgtacaattcagtatgttcggaagttgatacacaaactgatgatttcctcaccaagaaaaaagaggaggaatcacaccatgaataatgaattggtgaaatttgagtctttttcccctgaaaacactgcaaagcaatatctttattaaacaagaacgaaccaggtttcatcacacgactagctattaaaaaaaattgaagaaacgatgagcatccgaaaagattcaacgtgctcaattgcgtataccaactttaacataccagtacaattgtacaaacgaagaaaaggagcaatttccatgtcaattgatggcatcaaatcttatcaatgccgacaatttcaagcacaaagcagcacacctcccctgatccaagcttccttataatattatagcttgcaaccagatcttacatatacatactcataagatctttgaacatgtaaatcatccatgaatcacctacaatgattcagcaaatgcagaacataaagaagaagaaagaacagaagagagggtaaaagaaaaacaaaaaaaaaataaaaaccaagatttgcatctcaggtagccactcctgcaattcctctcatggcaagatcatccagcaaaacaagcaggcagtgcagtagtaatcacggatccacatccctgcacctggtgatggtctcgcatccccgggtgtaagggttggcggtggtcatgatcctgcagttatagtaagggacaccctgcctcgagcacggcaccacgtcgctcctcagggcgtcgtagctgatgtacctcctgccgttgctgctgctggactcccacagcatcctgctgtgagcctctgaatccatctccatctccatggccatgtccaagctcttcaggcagtggcctccatggaggaggaggaggagcaagaacagcttggtggtggtggtggtgattgatggtggtggcattgttgatggaagagggagatctctctttcttcttgttgttgtttctttgcttcttctctcactcagggtctcatctaggagtagctgaattttctctctctatggggctctggagtctggatctgtatcctgtgatgtactccttccttgatggaggaggaggcagaggcagagcctctcttgtgtgtgtgtgtgtgtgagagtgagtgaggaggtgcattcaatgcagtgccagacagccagttgtaggcacctgccattgtgtcctttctggagctgttcaatggaggagcaaatatcgaaggagagtggcccaggtttaccaggtcccgttcttttcttcaattggatgaaaattaagatttttgtgacatatttttaaaaactattaaatggtgcgtttcatacgaaagctttatattaaaagttgctctaaaatattatattaatctatttttaaagtttgtgataattaaaattcaatcaatcatacgttaataccacatcgttttgcgtaaaaaacttaatcttcatcttcaggagaaaagaacatcacctaaggtggtgtttgaatctctgtagataaagataaagattaagtgttttacgcaaaacgaggtgataataacgtgtgattaattaagttttaattattacaaacttgaaaaatatattaatctaatattttagagcaatttttatatatatataattttcccacgaaacgcaccatttagcaatttaaaaaacgtgccatgagtatccaaaatttcatccaactcttgttggagaaacgaacgcagcctaaataagttcagatttaccattggttttggatcttggggagttctgaacatgtttggaaaaattcatggtcgatttctttctttctttattgtgaagctcatttgacacattaatttggactttggggagctctgaacatgtttggaaactcatttgagattcttggttttgtgcaattttgttgaatgattgaaccataggggtggtggggttcatggtggctcagatctggaccatccatttgctaatcagtggttaccaggggagcagcagagcatccttctctcatacgccatcacgagtctctgtcgctcatgtggtcacaaatgagaaaattgtccaattgccagcagtgatgctgcttggtgtaattctgggcatgagttcagtcagttccatattttctgggtccaatccaaacactactgaagttatcaggtgctctgagagtcacaacatggtagtagtattaaatgtttcaagctttcaaacgattacatcgagttaagcttcagttttacagtagtacttatgtaaaagactgcaaactatactccgtatgtaaaaaatgaatagcggcagttaggaattcctggagaaaaaaacacaaattacaagtacgaggtgtacctggctccagaaatcgtaccaaaacctttataggagtagcaaattacggcagtcattcagcaccctggcaatctgggatgctagaaatagcaaaattttgacaggaagatttacatgcataagaagctaaatatctaatcatatatacaagattcaagaatatttacaaggcatcaggagtttcctgcatgtacttttttcagctatcatgcaacttgtaaatctcgtcaacataatcctcaacatcccaaagaaaggaaccaaatgcaatggcttcaagcaacaatctctttagggatgacggatcgagtatcactgcctcatcaggctctaggaaatctttcatgctttctctgaacagtgcccaactgtgcttctcaatgagattagaagcttcgcatgagcgcagccttgcgcataactccaaggtctttggatcaaagcccatcatgtaactcttcaagtcatgcagatcaacaacagaactcggttttgaggaagatgatatttctgcagaacctccaatggactcttcctgttcttgtttctgggtgctattaaattgtgcattcagaaactgaattggtgggcaaaattcttgtgactgagcaagaatcagctccaaacgatgccttgtagtgacagatttcagaaagtatccgtacattattgaagcagaataaatccgactaaattgcattcttttgattctaagtgttgagcgattgatcttgggaccatttctatgtacccatctgataatactggtcaagtgttccctaattaaacctagcacctcaggtccatgaattgattctagttctgcctcccttggtggccatatttgtagtcttttattgctgataagctttgatagatttggaaccaatggaacttcaatcttgaaaaatttataaacaatcaaagtgtacatgatatcctcaatagcagtctggcactcatgctccttcatttcagcaatcctcctatttgtagaagtcccaacaaatcaattaatattcagatgcaaatacaatataaagataaaaggagcaaacaatatagactttttagtgccgaatatagatcacctgcagtgacaattatgctagctacatgaaatgatttggtaaattttaagtttttaacaatgaagcttgtgactcaaaaatatcgatgcagtatcaactagaatggattaaagaaagacctgaccctccatattcttccatgtagatttactagtatattataagtgacgctcctatatgattcatattaaaaagactagaaatgacgttagagctccaggttgtctcccatcatttaaccattgaagctagcttttataatttcaagcctcacttgcaatctacaatattcacatgatttcattaacccaacctatattttatttctgtaattagttgagaaattttctaatccaacatatatgtccaaataacaggtagcttatggactgaagaggtatcacctaattggttgttcttcatcagcacaacaaaataaaatgccattctaagtgaatgctgttttttattctatcacaaaagtgcaacgttgtctgtttaataattaattaatacaatttacgcttgaaatataacagagaacttgaatggggaaaaaataaggatagcagcatgtcgacctcctgagaccactaaacacttttgacaaagggcatttgtaactaacctgtgaaggcagtcctcaggagaaccgatgctatgttcccagcggatcaaggtgtcctttctttgattagatagttcttgaagttgctttgccgcagcaactgggagtacttgtggctggttcttcaacaaaccacacaagaagcttccttcccacgtttggggctcgagtggtgcattgacactttcaaattcagagtcatcaggctttgcaccagcaactgtagtccgtggacttctggtactgcatttagatttccaattcaacatacttccctgtgttgcaaagttgatagggcagcaattgttatgacaatattctaggcgaaacacacgcacaaatcaatgatgcaacaactagattaaactaatgcagagggcatgaataaatcagactaaattcggtaagaatcaaagatgcatgttgtggctgtggactagtgaatttttgaaatatcttgtctggaaaacaattttgacggtgcagtggataggatactgatagaagaaagacgacaactgacaaataaaaaaaaaagagaaactaaagtataagttttacttcacataaacatacactctaaagctataaaaactaagactactattgagcagtaacaaggaaacactaaaacttaatagaaacagacattagaaatttatctcctttcacacatctcagtttaagtaaagagctcgaatccagtttgaaacagcctacttgagaagtaaaacctctcatttaggcagtacaggtacgtcgtaaccaaagctcctaacttccaaaaacaagagtgggaagaattgcagcgcaggaggtcgtttgctacacctcatctcaaatcaatcactccggtatgcaaagcaccgcccctaaatataaaataccacgtcatcatcatcataatcatcatccgccatgaacaccaacgatcaatgaaggcaggaaccacgagactccacgcatcccccctagtggatttacacatcacgggcaagagaggaaccgagaacgtagagaggcgggaggtgggggggggggacctgcagcttccagcgggatgaggaggagacgccgcctcggcgtacggcgaccgggcgggcgactgcggcggaggcggcggcggcgcgggggcggagggccgccatgccgtggttgaggggggatcgaaggggataagagttggatagcgtttggggtgcgtgcggtgcggtgcggtgcggtgcagtcagcggcttctctctcgctcgcacgagtcggcgacgagtggtggagagactctcgtgcgaggggtggacacgcgtggtggctgtacactcgctctactcggtggtgtgggtgtggcctgcctaccccctgcccccacacactggcacggcacattttgacacgagagcccttgtgggagaaatccaaacacacggcacaaactttttgaaggatggaaaaagctataaaaaccatcagttttacattccaccatgtaatttatgccttgtttagttacaaactttttcttcaaacttccaacttttatatcacatcaaaacttttctacacatataaacttctaactttttcatcacatcgttccaatttcaaccaaacttctaattttggcgtgaactaaacacacccttactttgttataaatacccaccactctacttggtttgaacacacggttcaaaattttcaatgatggaaagttataaagaccatcagtttggcattccatcctgtaatttatttatttttcaaatgcccaccactccacttagttttgatgtaacaaccacccagtgcgcactggcttaccaaatcagctattattgctactgtagaggtacccccagactaagctagctgagtcaatcttatcgaggtacttgtatttgatttattctttatatttcatcgatttttttaccgtacatagcaaaaataagtgagacattgtttaatctctcatcaacaattttatttatggaatctcaaaaaaaaataaagtcaagattatactcctaagggtgtgtttagataatgggaaataaaggggagattgggattagaaaataaatgaagggttaggattaaatggaagagagagaatgaatggttatgatttaaagatgtcttttggtgagtgggaaatcatttccttatcccattagccaaacagtacctaaaagtatttaggttgttttctcttggggtaggaaactttccccagctcataaacggagtggtagattagcatatgattaattaagtattagcttgaaaacttaaaaagtgatttaatgaaaacttgaaaagcaactttcttatacgattttttttggtaaaaaaatgtatcatttattagttcggaaagcgtgtgcatggataatgagggagtagaatttaggaaagtgtagtgccgaacacagccttagctttgattaagatcacgttaactgctcacaatttatgaaaacaaattgattcggttaaatatgtgtatattagggaggtttttgcaacaaatgatttatgtgggggaacgtaaaacttcaagtaattttatggggtgagttttgcaaattttcctctaaagaattagtagatatatgatctaggagacatttccctattttctccatcccaaagtatagctatctttagaggtatatatggagattaagaaaacaagtatagtgaagtggtacatggttgtgattggttgagatggtaaaaggtagctttggacaaatttaaattgtaaaaaacaattgtatttaaagatggagggagtagattcataataatattggtcctatgtggtgaacttgagaacttgatattataagaagtagcagatgagaattaaaaatgctgagtttgttagcttttggtttcatagtttattttactgtgtggagcggagtggttcggattttaaagcaatggtttactagtgtgaagatatgggtaaaacagttgtgcttgcaagactatgatcattcctactactcctatattctattgactggcgatcgaaatcaaagaaattcttggaattagattaggcctggtaagatccattgaaatcaatggtggcacactggcgataccggtcctcttttttcctcactcgatagatttcacacgaaaactccagtcctaatctaatttcaacagactcgataattttttaaaaaagaatatatattgtgttgctgtaaagaacttattgggttatcttcttttgggcttatacttcttccaatcaaatcaaaattatttcctttttgttttgaggggaaaataactttccttatgattgcaataaacttgtgagaaggactaacaccatcattcctagtcctcttgccctacatcacaaatcaaccaggaaccaacaattgtgagaatttcatgatttaaaaccgaaaatccccctttcaaattggccaatcacaaattgaattgnnggtccgcctgagctcttgatgcaatctacagatggatcaagttactgtcataatcagtattaccctttggagagaaaccattggtagcatcatctctcttttcaactttttttttgacataatcagttatcactcttaccctttcgagacacatgtacgttaaagcgatctttaccaattttaaataactgtgtgtatccataattgaaaccgaacattaaaagagaaacagaaaagctaatatttatcaaaacgtcggattgaacagagcagacatgtacagatgtaattaggccctatttctttcaacttaggattattataatctagattattgagagtaggctgaaagaaacaaacaacttattgaagtagcttattataatctagagcccagcttattataatctgataagctcatttaggtaagctttttccagattattgggtgaaaaattatccaccatgccaccccactccctatttagacttaaaaacccaataatctaggctctaataagctaggaaagaaacaactaaccgcttattctactatagattatagcaatctagcttatagtaatctaactcaataatctagattataataatcctaagctgaaagaaacagggccttacaagaacacgtatatacacttcacactttacagtgagtttatgggctacaacgcctatagacacgacatacaaacaaacagaaaactactgtgagctagcaaagctatacctatataaagaatgaatcaaatatttgatcaattgccgccgccgagcaggtaacccttgagcgctttcgcaatggcaacggcgaccctcgtggctccagggaactggccggcgacgggtccaagcagcacaaaccacaagccgaggaggacgaagaagaatgcaacaagggcatatgcaggaccgtcgatggcggaagggtctccagcagtgtggaaaactatggaggacccggcagtggcgacgaggaagatgccacagttgatcagtagtctagcggcaggagggagctggcggtttgcagnnnnnnnnnnnnnnnnnnnnnnnnnnnnnggaacgggcattggtggatcagcggctgccgggttcaccgccgcgcgatctcccgtgatcttggaggcgcttctttgtgaaggctgtgagatttcagaatcaaataaacagggcattataagattcatcaaaaacaaaattaaaccattgaaaagcatgcatagctcaaagcagggatacaaacaggcataaatgtttgatactttgatatgaacttaaaatgcacagctcacttgttaataacgttttttatgcatttggtaacctactcctaacactacacaagcaggagtattgcatatgtgacttgtgatgagataacaataacgtgtaggtagcaaatattcttcaaaatgtagatacagaaatgataatgcattgcaacaatccatagaattagatcactcttttctagcattatgcatgtaaatcgcccatggggctaaactcttaaatctatctatcctgagtggtgtttcaggatgttgtaatcccttgattaagtttcttaggttgtcttatcagtaatcactgtcacgagatttagcctggtttccttttttgaaaatgatatacgtatgaccttgttgtccggctactgtgtacgaccatggccacaatgaaaggctcagacggcaaatgtctcactccgtgatagaatctgacatgcgcaggtgatgccgtaacggagtcggacatcagtctaacgctagcgtcgtatgtatagcagcgttcttaatttttctccctttccttttctggttgttgactcttttctggtcagttcttcaaagctgatcctcccattctatgcttcttctttcaccttcttttaatacaaagaatattgaactgcaattttcagaactagcaagaatccatgacacatgtaaaccatctcaatatagtgttccccccaacagggcatctttcagtcgaagaattcaattagcatagtttcatccaaaatggggggaaaaatccagttatatcagttccctgaaattggtcttggtttccacagaactcaaccgaacccccaccctctttctagtcatccctgcgctgcgaagagaatgcacctcgagctattacgtaaacctgactgcaactattccagcaagatctgtgaatcccttcgagaagggaggcacgaatttgggatgggaaagggaatccgaatcccttcggattcgaggagaagggcacgaatggggagggggaagggggggaggctttaccgggaagccggcgtcgcggttatcgaggccctcgccggagaggacgtcggggggcaggatgccgctgtcgtcgtcgtcgcagtcgtcctcgatcgcgcggcggatggcccccgcctcgaactcctcggcgccggagctcttcgcgataaaactggtcatcttcttctcgccctcggccgccgccatccctcctatcgggtcgcgggcggtggtcgctccccctcgcgtcgtcgagcaaaccctacctctcgccgcggcggcgccggggggagcgcggtgatcgatggggatcgattgggtttggggggatctggcgcgagcggggttgggccttcggatggagcaggctgggctggggactatatgtattattgggttatttgagttggaggaagaaatggaggcattgcggacgcggtgtggccgcggtgtgaaaaaaataaaggttaaaacttgaagccaacagagtggctatctcattcttcaaattaaattttgatatttttgaatcaaaatcctaatccaacaaacttgccaaccggatgaaaaccatccgactggccaaagtcctctatgcgttagctaaagttggccaaccaaaatgacaaagttgtcttaccacgcatgggccccacacattttcccctttctcctttcctgtatgtattgtctttccatcccagatcgagcaccctccctgcgctcctagatcgagcacgaggccaccacccccttcccagatctagtgtgcgattgagcgcacggccatcgcccccttcctagatccaacgcatgaccctattgcgcgccgccaccggcgtctatctgctacgccccttgtccatcgccgcgccatcgtccactgttgtggccgccgccatccccagactgaaagttgttggccccggatcaagcgctcgatgctaccgtcgtctctccggtttccaccgtcatcaagagccctgccatcgtcgcccaatccacaccgactcctacagcctacaggttaataccctcttccacaaaaatagccaattttgttggagatgctcttattagagcaagtaatatgctatctaaactaatatggtaaggtggaggggagaagaaaagagagagtaggagttacaacttaacttacatggataaaattaggggtggcatttgcctcttctataaaacttgctcatagacagaaatttttgttaggctcttcaaccaaccgaaattaatttggttataattcggttagcactctcgattaattgacattaggaaatagacctaattatgtatcttgatcggtgttaagttgtaagttaaatctagtcaaaagccatgtgtgttgctgcggcactataggatgaacatatggaaaaatattaattatgctccacaacactcaatattgtacactaaatgaaaaaacatactccgtaccaaagaaacaaaattgattgtggataacaaatctgtgatctatataacccatgttcttcgttagggctagctgattcttgtcctttcatatatccttttcatatccacatcattacagattaaacaaaaaattccctgtcaaagtttagtgcattagccattaatgcggtaaaaggcaaactaccataataatatcgttgaccgttgtaaacatgtaagaatggttgaaaaatatagtaaattcaaaattaaaatgaattgcatgggacagacccaaatgttcgtaccaaaatgtaaacctacttgatagagtgtgttgcacttaagcaaaatgagtaaccgcacaaaataaaatcaagcaaccaatttgccaaagaaaaacacccacgagcaatctcaaatggggagaaaaacagaacatctttaaaatctgagactaactcaccaaatcaatggtatcgtgtgatcgaattgatgcatatataatataaaagtcagacaaagaacacatgtactaacattgaagggaaagcggagggcaatatgtggtttgaagtgagaagtttatgcaatagtctaactatttttatagtctaagagatagaaaaagtaactgcaatctctgaagatcacttaatgaccagaagtattacataggggaaagaaggcagtttcagaagaggaaagaaggcagtttcaggagatcaattgatcatctgttgtaatggttgcatgcatgcatgacaatagaagaggaaccggccggtgtaaagaagtgtagatgggctaggcttggtctaacattaacagaagatcaaatatggctggttgctacttggtgattaggagctaatctagacacacaagttaaatccaacggttagcataaagtaagatgatgtggctgcaccatagaacaaaaaattggtactattgattacaccagagaacaaagaattggtattgattacagttagtggggatcaattgtttaagtatactagattactatgattgatgctcttgatgagttgatgtgttatatgtgctatttaattgtcaacatatatgttctgcagagagaaaagttgctacaattttctaccacacatttcggttatgactaaagaccggaccgaaccaaccaaaacataactattcattcttgagttttttaaaaatgtaatttgatattgagttttaaatgactgaatttccttaaacatgtcatatacttgcgtgctatactccttttcctaacttatgtttcctcgtttttcgtgtgcacatttttcaaattgctaaactattaaaaaaattaggaaagttgctttaaaaaatcatattaatctattttcaagtttgtttagttaattaaacttgtgctaatgagtccttctgttttgcttggaggattagttaccaaaatgcaatgccagacattgcctaaggtttgcgttcggaactacaagtttccatcttctaatatctcattttccgtagcacgttttccgaactactgaacaatgcaacttttttgcaaaataaaaacttaagtgaaattgtttttgaaaacttatattaatccggtttcaagtttatttaagttaaaacttagttaatcatgtgctaatgagccacctcattttccgtgtatgaaagagaagttcccaaccttttctctcgaacgcagccttaagtggtgctcgaccccatatcttcttttcttgcctcgcacgggaacatatgaacaatttgtatgataaaagcatgttagcaaaattttgtaataatatcgtgattatattgttttagcttaacacacataaaaaatggatctttgggagaggacctactcaaaattgtgctaattggtcattgacacaatccccatattcttattctcaagagtaaataggcacacctatcacaaaactactggctaagcattttttacataaaaccctaccgttgggggcatgttgtatcctacaacccatatttctttgctctcctcctgccaccggttacatgacctcattccctatttccacaatgaggatgcacttctctgtgctctccgcatcgtcgctaggcgtgaagtattggcgccaacctagcatatttcctgtcatttctctgccctagcccaacagcgcagtacgtgatttaatcgatgcctaatgaatgatcaaggagacctatatgaagggagaagagaagcctgttctgaacttcgcagcaggtaataattcttttcccccacttatttaatgcagatttggctatcttaacaaaccataattgtctatatggatgatggatttgaaatttcccctctaattgcaagtactatgctataaaagtacttattatttatgttacgtagcatccactaagctatatactctgaagacatccaaataatctaccatatcttaccatcctaaaaaattggtgattttctagaaacttttgcacataacaatatataagaatatttggcattggtagcaaaccaagtaaaacccacacacttcaatcctaccaaattttggtgttgaaaggttaattctagcatcaaactgaacaaacccttaatcttttaagttgtactctctatggtcataaatatttgatggtacgaagatatcatcaaagttttgaaatttggccatcaattcatattacatctaataatttttaatgttatttaatattttttaatataatatgcttataccattttttttaagaactatgcactttgagaagttattgataacataagccttaaaagttcgccctaacctattctaaatatcaaatattttattatcactaaagagaataatatgtaattataataattttcattatttactcaattaataaacaatatgaaaacaaattctattacttaccattctggccctattgtcccatatttccgtaacacaattttaccggtataattttcatgcaataattccacccatctccagcctatatagaggttaaaaaaaaggggaatatttgcccaaccctagtaaaacgtacaaaaaaaaagcacaatatcaaacggagtctattattcctattccaagtacaaatagagtggtattatttcccttcttcttcttttattcggcaacggattctatgggctcggccggccccacccagcgtgcggcccggaccatcacacccaatcgtggccgtccacacctccgcatccgacggctcctccgccctccacgtgtccccacgcagccctcgccctcccatttctcctatataataatatcccccacctccccacccacccccaatccaacccccaatctcgccgcaatccccatcgccgccgctgcgaaagctagggtttcgtgcgattcacctcctcggcgacgaccgagaccgcgagcgatttcggagggctcgatcgatggcggctgagggagagaagaagatgatcaccctgaagagctccgacggggaggagttcgaggtggaggaggcggtggcgatggagtcgcagacgatccgccacatgatcgaggacgactgcgccgacaacggcatcccgctccccaacgtcaactccaagatcctctccaaggtcatcgagtactgcaacaagcacgtgcacgccgcggccgccgcggcctccaaggccgccgacgacgccgcgtccgccgccgcagccgtgccgccgccctccggcgaggacctcaagaactgggacgccgacttcgtcaaggtcgaccaggccaccctcttcgacctcatcctggtataaaagcccccccctctccctcccccatcgcgcccctaccttttcttgatggggattcagatctgcggttattgctagatctggatttgttttcttggtcaatagctcgaggtgcattctgttccaagctttttgggatgtatttcatccggtatgtttgttactgggttggatgtggtttccatgcatcacgcattcattcatgtcagttgtggaaatcatggttgcgtgaatatcattagggaaaacaagtgtactttgtgcagatggggtaacggtatgattctgtatcctcatctgtatggtcgatgattgtatccatatgattggataaatgtgccctgctatttgtttgtttcatactggtaattatgtaaatcaggactgcgtagatgtggtaattgatattctgcagattttttggtatgatcggttgatgtattgctaccatgggtttttattaaatacaacatttagttaaagaaatacataaagagctatgcagttttgcgattgtatatatttgaagtatgaaatatgtttctagtgccatgttgtaataaactcgtccccttctgttttgttgttaactgttacacaattccttccctgttcataaggattttgtgcttctctatataacaagcatgatatagtatgaaattgattgtttagatgcatgcttgccaatttggtagattaggtcaagctttaaatttgttcccttctgtttgttgttatacattatttcctttcgtgttggtaagaatttgagattcatatatcaagcatgatatatgtttgtagttctatgttgtaataaattctctcccttctgattgtaatgtttttctttcctgttcataagtcaattgcttttgttatgtccttacattgatgcagcctccttatgattatgttcataaggaaattagggctgttacagataatgatcttacattgatgtagtcttgtgatgcatcttttatgtatgattgactactgtattgctaaaatggtgaagcattatcttaagggatttagtacttgttctgtatctctaatttatgatgtttcaggcattgagtaattgtgtctctgtatcttcactgtgatatttctttgatatccagtaataaattcattgcatactacagtttgtgatcacaaattcgttcttctcttgatcaattcattgcatactacagtttggggtcataaattctctctgctcttgttcatgaattgtaaacagttctgttattttgttcatttattctttctgctcttttttcatgaattgttaacacttctcttgatctaagagaaatgatggcagtctcatttttttctttgattgtcacaagaatttactatctaaattaagttgcttgatggtggtggactattaacaacactgcaattttacaatgagacgggttatggggtatcagtgcatgttaaattattgcaaaacaaaatgtatcatgttttaacttgttgctcaagtgtttgtataccaacttctttctatggagggtccttttttttttcttttttgtaaaatgccgtatttgttcacatgcactgttttatttgtgtactccactattgcggatctaactttgttgtttgtttctcatcccacggtgtcacgtacctatttctagtatttctgcatttcaatttggatttgctacacactcgccttttttcttgaagtttttacatatatctgttatttctaactttgttgtttgtttctcatcccacggtgtcatgtacccatttctagtatttctgcattttaatttggatttctacacaatcatgtgctaaagtaatttgtttcagttcatagtgttctcatttctacatttatgctttcttttatattccaaagttgaactatgtattccttttgtggctgaatgttgatctgtgctttagccatagtgattactgcttcttataccatgtttatttgattctcaaatcccacaggccgcgaactacctcaacatcaaggggttgctggaccttacttgccagactgttgctgacatgatcaaggggaagactcctgaggagatccgcaagaccttcaacatcaagaacgacttcacccctgaggaggaagaggagatccgcagggagaaccagtgggcttttgagtagaaggcatcaaggcctctgatgtcttggtgcttagatccttactccgtatctacgtatgctctgcttttatatgtcgtgctggttgtaagtattttggagtccgatgggggttcatgtgcacgtttagttggttaaatggttaagttctatccaggaaaaaaagaactgatgtggtcagaactactgaacctgttatctgcattaattaatactatcaatctgcagtgaaatgctttgctgaaaagtatgtcatattttttgtgcgaccttagcccggtggagtggtggagttacgatctgatctcaaatggcatgggtcaaatatcatctctttgccgtagcgtctcttcgcctttttgcctgggctgcatggcatctcgttgcttattgactgtctttcctaaatagtgttaggttgaatttgggttgttgtttcgtggacattagtattctcaggagataactacggatcggggtatgattctctgcagcttgtatttttctctcctctcatgggtcgggttgcctcacttctatgcaaactttttttttaaatctagttttctaaatgattgatacaatctacaatccgattacgccgttttattcattttcacccttcaatttaaatctttataagcatgaccatattatgagaacaattgataatattgttaattgaaacatttttatatactatatgaaacatcggggtgtaacgattgaaacatcacttaatatttactgaaacatccaaataatacaaggtgcaacattaacaaatgaatcaacaaaatatcaaaataagtcacatccacataacaccacgtacaacaatagataaaaattgattataacatgaaaaattaaaaatgtccaacatatttggattccaactaaaacattcaatgtgcaacatatttggattccaactgaaagattctcttttcttttcacacgtgaaacatcgaatttgaacggtcgaaacatatatattattttgacgatataatcatgttagatcttgttatgaagtttaattgtaattagtacgatggtataaatagattcaagaaaagatgagtaatttaaaagaaaaaaagtatttaaaacttggtaataaaactttatcctttattacacataaggcacatggtaggttgcacgtgtgagcagaagcacacactaggctgtaggtgtgaagagaaaaaaatagaacacataaagtataagtagcatccgattttttccacaataaagtatagtagtagaccgatttaaagtattttcggtattctcattgaccgttttaacgtattatgtaatatagtagtatgtagtatcactattggcaatgagatctagtgggtgagtcaactatatgacacttccattcacacttcctcccatatatgagcgtttgagaggagataagaggattgagaccattaacgcatgattagttgagtattaactattttaaattttaaaaatagattaatattattttttaaagtaactttcctatagattttttttcaaaaaaatacacggtttagtatattgggaaacgtgtgcgtggaaaacgagatgttctctctcaatctcccaggtctcccaggaacgaacaaagcataatgctcaagtgaatcatctgctcgtgtcaagccgtccgcggtttagtcgctacagtcataattcagaatttgttctttatttttttttaaaaaaagaaggtaagaagtttgccttatactagctctgtattaattattttaatagtagatgacaacgttggttttgaaaaataatgtttggctgttcgttttattaaaaaatataaatacggtaaagtgtaaatcatatttaaaagtttatttaatgataaaatatgtcacaacaaaataagagatatttatataaatattttgaatacggcaaatggtaaaactggcgaaagtcaattatgttgtctagtttcttaatataaactggcgaaagtaacatttgattatttgttttattaaaaaattaatataaatatgctaaagtgtaaagtttatttaatgataaaacacgtcacaacaaaataagtggtatttatatattttgaatacggcgaatgttatggcgatgccaatgatgtcatctatcaaagagacgtagaggatatatatcgatgaaggagatattctgaccagaattaccggaaatggaaggaaaaaagggccaattgcatatttgccactagtttgaaccggtatcgtggatttgccactgtaaaaagtgtaattgcatatttgccatcaaaatggttggaattcaatatacttgctattggactgacagtttagataaacaccattagaagattggtttttatgaaaattaggacaagaataccccttcccatgaaattgaaagattaacacatcatatgattcattcaaaatcttgcaattgacaaccctgactacacaacagaacattgctacgaggtcacaaaatcttcctagcagttcctgctgctagtgatgtagtatgtgttggctttgttgctgctgcccaaacagcctgttaatgctgccgccattgccgcccaaaccgcctgttgttgctgtcatccaagccgcaaggcacaaccgcttgctgctaccgtcggcccaacccgtcaccgttgcctgctgttgctggcttgctgctgcccaagctacctgcaaacctgaccgccgcagcgcctgcttctgttgagaataacatctccatggtaggacaagacgttgaagcataacagatgttattctccaacccctttggagatgttaccttaaaccatgtactttacttctatctcagaaaaaaaagcctgagagttccaccctttgtaagaagccgccttttgctcttgtatgttccttgggttttttttcctcccatttctggtaattcttacttcatctgaattttgactcttgcactctttttaaggcatagttcggtaggatgggttcccaacccatctcgctcgtgttccgcgcgcacacttttcaaattattaaacagtatgttttttgcaaaagttttctatacgaaagttgcttaaaaaatcatattgatccatttttgaaaaaaaagcatatacttaattaatcacgcgctaatggatcgctctgttttccgtgcgctggagataagttcccaactagtggtagcgaacacaatctactatactactccctccgtcccagaaagaggcgatttctggaggggaggatttgtcccacaaagaagcgattccagcctaaaaaactagatattttatgtatcgcatctatctgtgggccatagtactgagggcggtaacctttctctcctctcacaccacagaaaccttcgccttgtttgaatcctccgatctattaaatagccctccggaatcttgctattaaggagtattaaatatagattactgacaaaacccattccataacccctgggctattttgctagacgaatctaacgaggtatattaatccacgatttgctacagtgatgctacaataatcatatgttaaccatggattaatatacatcgttagattcgtctcgtaaaatagcttaggggttatggaatgggttttgtcagtaatttacgtttaatactcctaaatcgtaagattccggagggctatttaatagcccggaggatccaaacaaggcccttatctcttccccttcccggaattgccacctctctctcgcgtattcctctctctcgcgtattcctctcgtctctctctcgttctccgcacctccagatgtcaaatcgaagccgcaagcttcccttcctcctgatcctccccgcacgcccctccgtgctccacgtcgcttcccctcgctcccgcttctcccttcgatgttctgcgttcaccaggatgcggccgctcggatgtggtggcagacagttgcgagggtttagatccgataaaggagacagttccggtgggaaggattttgctcggtagcaacgttcatgaaagtagggctgggcaatcggttataaccgaaagttcgggtcgggtagttcggtttttttaaaagatcggtctttgaaaatagatgaccgaagttgtccataaaaatccagaaaccgacaattcggttaaccgagctttcgggtcggtcttcggtctcaaccgagtttgaccaaacactacatgtagcgcccggagcctaggtagctggcggagagaacggcaggcggcagccgggaggcacgcgtcgccgcgtcggagccctgaagagcagcggagaagacatcagagggcagaccggaggcacgcggcggcatgggtggaaagaaacccttcaacaggcacgagcagtgcagagcctcggtggggaagaagacaacgattggctcgaggaagagaggacaacgacatcgacgagctggctcccggagggcgggacgtggtcccgtgcgcggcaaagtcggatgctccgattggatcacggccgtatgtcgccgttgt

SEQ ID NO: 48468 - DNA, 3444 bp, Oryza sativa
ttaccaacctccttttctaattccggcgccaatagttggggacattggcggcgatgaggtagacaatccattctgctaccaaaggtatctcccgctccatctccctgccaccaatacgttcttctcatgcaatgaaaactgctttgaatggcattgaaaactgctttcaatggtggatgtagcacatatgcacggcgggtggttgcatacctaattttttgtatgaaaataactgttaggtatagtaagtactagaacattagcgtgccggttggcatgctttctttatagcagttatttcaacattcatgttccatcaaatattgtattatcttgcatataattacgagtatatataatctcctgcaatgttaatatgggattaattatatatgtttaaagcaatctatgtttccggtgtcgattaattatatatgttgagtttctaccaatttattgagataattgatattagaaagtattaagaaagtagaaagtaggtggagttaaatattagaagggtctctgaaaaaatattagaagattgataagtttttttttctaaaaaaaatgactgattgtaggcaaagaattcatgggaagattgtaacttacaaagcttacctcgataatccataatactctctatgtccacaaatattagttaagttgtggcctatgggcggtctttgggttcacttcacccctcatttttgtaggtcactataccatgttgccctctctttttcagttgagctgaaactaatttacaggagtatactggtgtccatgaatgcagcctgtcacacttgttttgttccctcgtgcatgacatgacatgattaatttgggacccctgctggctgcagctaactagctagcggctgttgcttgcttgacctgtttattttaaaactactagtaacagtaagagtagaataatcagtaaggagttctgaaaccttgccctgaacagcttcagcttgctccaacagtccaactgcacccacgaatagtaggagtagctttttcatatattgccattcttaactagataatccccgcaaaaaaaattaactagataatcttgctgttgttatacgagaaatagcatggatgcttaacatttattgagcgcaactctttttcgaaggttataatacaagtccctggctctgatccattaactaggacacacacacacacacacacacatatatatatatatatatatatatatatatatatatatatatatatatatatatatatatatatatatatatatatatagagaaaatcccttgtatacccttgaaattttaactaatcccttctatgcctctgaattttgcttactttcttatatacccctaaaatttgattttgatcccttccatacccctcccgtcagttgattgttagttgaccgtctaatttctataaaaatgaccattttaccctttggatgaacatagaaatttatgaattacattattaaaaatgtaaaagcttctcacacgagactattatagctatgagtttgttgtgcgatgcattatttatcccaaaaaatatttttagataatgaaataaaaaattgtgtatttatttttaaaaaaagtaataaaaaaaaggatcattcatacaaagataggacaaccaattttcataataatttttttatgaatgctcccgatcaaaaaaaatcattgtcctattaaaatttcaaataaaaattttaatttattaccttttttatttccaaaatttatgtcaaaattttctgcactaattatttagtctcattagtttcataaaatgcacgtactgtgcactcaaacaaaattttcaatcgcttttaagcttatattcaaacctatagcatcaagggcaaaaaaagacatttgcaaccaaatgtaatagtgaaataatggaaaatgtaacggtaggggcatggaagggatcaagttaaaatttcaggggtatagaagagatcgggtaaatttcaggggtacgaaagggactgagtgagttttcaggggtacacagggaatttactcatatatatatatacacacacactgatgtactctgatttttagctatcattgccatgatcagtccctttggtctttactacattttagacattgattgattcggtgatagattcacctttacatcacaaatcgaaatactttatttatatgttgggggtctgtcgcatctgattttcgttttaggatttataaattatttaataaattatcattagaatttatattaaatgttcattaatttacaagtgaagttaaatgtgggaaataaaattccctaaatataaagcatgactggatttaatttttattaaattctccataattaattatactatctggaattttctcggattttttcagagctcaattactaattttaataatacaaagattttttcagtaattagttaatcaataaactaatcattaaatgatctatatgtaattttgttaaatgttttggttgtttaaaaatccttaaattataaattgagttattataaatgatcttaaaatcctaaaagaaaagctctaagtttagtttaataaatctcaatgtaaaaatggtctagataaaactttggtaaatatttctcttgtttctttagtttctggattttttgggatttatttgagccaaggaagtatttttaataaatggaattgcattccatgaataaatttaaatagaaaaggtttttaaaatctcccttttggctttgggccgaaagtcggcccagccttccctctcttatccccggtcacgtgcgctcggcccaagtcagcccaggccaagccgcccctcctcctctctctcagccgccgacatatggggcccacatgtcggggtcttctccttcctccagccgctcggccgagtccgagccgctgcgcctctctgccaaattcgctggcgaccatgatgtcccaagccgcagccggtgatgatgtcatgctgacgtcataaagccccttttcccttctaaaaataaatcttaattgtgtcataaatcataaatccttttctgtataaggttaaaatcagattaatcttaaaaaatccatttctaattcattgtaaatcagattaatgtgtttcaagttgcaaaagtgtataaaataaagatctatatattaaaattatatataaattgtgttataaatttatttaatcttttttaaataggtttaattgaattaaatcctgtaaaatttatgactaattcatatgaagtcagaatgaggccgttcaagtctttaaattcatctaaaatcatgatctacatgtttgtttactttttatgtactgtttatttggtttttattagtccttttcctcattttgcgtgttagcttgccgtatccgccgttgcgaaggttc

SEQ ID NO: 48469 - DNA, 3797 bp, Oryza sativa
  unsure (1)..(3797): unsure at all n locations
atttatttcaactgtgcattttatttcgaatgtcatcggggtggtgtgaacttatacctntgctatggccaattttcattgattatcctatttcttgataccttgggctataatttgactagttggactttatatattggttcgactagatattagtataattgcttagccatgcttagaaacattagcacatgattgggatgattaatgtttcactattacttaatgatggatatttaatggtagctcacgatggtcaatcgtgattggttattaattacttgtcaactaaaacttgattaatggtgagttgtaagcatatggttttgatggttgtgctcatgacaaggaccggttcgcgagctactgttgtgagacattaaccgtgccaaccacaagctagcatgggcaacggctggacactttgtgtagcaaggctcaccgtggtgcaccagactgtgaagcggcgagaagtccgtgggggtcgctggggagttcatgcctctggttattgaggaggtgattatgatccaggaaaggtgcgttgctttgagttgagttatgcgaggggtcttgtcacaatcactcgccatggtgacgtgtctgcgcggacacggtgacatgacaatgggttgtgtcttgtgggtacagtagtacatctctggccagagtaaaactattcgaatagctatgcccgtggtcatgggcaagttgagcaatgtttttcgtgattagtcccacactactcattaatgataataatgtgataattaatttggcttctggtttggaatggcttattcctagtttggaggtttgatctgtacgaccagggttggttgtcaaggtttggttgggcctgtgcagcatgggtgtgctattcagtgttgattaatattgatgattaattactctactgttttacaattcttaaatgtttgctaaatgctgcttttgcaaatgagcctatattatgccatcctttggtatatttttgcacttgcatatttgctgtgtgtcttgcggagtattccatgtactcaccttgcaataattaatcaaaccttagttgaagaaaaaggatctaaaaggagcagacatttagcttatacctcagttgagctgcttatgggagtggagccggagcttcgctagaccgttaatccgctgttgtttttcttttcttttgtaagtatgtaatattattattatgacggatttgtatattaaattgtcagtttgtgtacctcggctgattcctggacaaggattttatgcacaaattagttcagaaattactagtgaattttcaagtgtgacaaggttcatgtctctaacaactgatcccatcttgtattggtactgtgttttatcctttccaggacaatattggaagacgatagcgaccacaagctcctattgagaaggcactcatcgggcaaatcaacattgaggatatgagtggaaaagctaaggatgtgattagtgaggaggggagcaccaaggagatgaaggatagcgacgatgatgttggcatggtcattgggggatatgcacaagatctatacaatcatagcggcctagaagaactcatgcaagaccaagatgcgttggaaaaatcggtaaagaattttccggaatgttttaagagcacaaaatttagatgaatgattaaattatgtgttgcttttatgctggtttggtggttatgaatgatggcctaacatagtatcttgaagtgtttggacttttggtattgtatatggaagcatgtgtaattatggtagtacatgagtggtgatgaatggtatcctgcaaaattattttaaaatatgatcgtttattgtggtaaatgaaattaatatgatgtttctaacattacaaacaatatgacgatgatgcatgcaatgcttatgaaactcaagaatgatacagcttcccacatgacatgatttactcctaatgctgatattacatcgtcatatatacaacctgaaaactgcccaaaatatgaaaccatgataaacttcccatattacatatttcaaaagctgaaaccatcataaaacttctcacattacatggtttgttgcatttacttgcgtaacactgatcttaacttatcatatatacaacctgacatttaaccaaaagttgaaaccaggatagtgctttaccatattgcatgatttactgcacttggttggctaatgctgttcttaccttattatatagctcaaaaccacaactaagggtattagggagaatgtctagacgctctagcctctctttacccatatgagggatctcgtatccatttccaccattagctttcataacctctaacaagcaagattgcaatgttaggaacaccctatttagcttgttctcatcataggcctgatgctcagcattatctattaggtcatccatattcctggatatccttctatatgttaatgattgtagagacgcaaaaaacccaagatctagtgcattcatatatggggaattaggaggctgatgcatgagtcggatgtcaaacccttttgggaaactgcataggcaaatcgaggatcatccactaggacatgagaaggagcattatcctactaaatccatatactgttgtgtgtttcttctcgaggccaacttgctattatagctggtaggagtttagcaattagaaatgaccttacggtatctcgatcaaccttgattgtcttggtgactagagtcccccttggtctattatgacttgtcctttgcggtggttcctaagtagtacaataatcaagttagattaacaattaatttagataaaatcactaagtaaaaatgcatatatgaagaggttatggtacctttctggtgaaaggccacaagcctatcttgccgtcaaaagtgcagataccttcttcattgtatctaggcctagcaactgctgccaagaacatcattttatcaatagaatttttgttttggacaggtctgtatggatcatcctcccaatggaccatgtaaatggttcttgtccttttagttgtattgaaccattttttatctatgtgtacagtgtttcgcatatcaatgaacttgggttcatttggcaaagtatgccaatctaacatggaaagacaccaccgcagccttgatggtttattctcttccttcaacaatggctttagtgtgtttgagtgacatcttagcagcacttctttcaacatcctatgcaacatgctctttggtataccagaggctgatgcaaatgaccgtaaagtgccccttagttgcaagggaacattagcaacatctgtcatgttgatttcattctttttgcaaccacaattcttttttttcctagaccttacatcgattggtattccgtgggcaagacattgcttcactcttcgccaaatagcttgcactctagcccttttcacattaaacattgctgtaacttcagttgtactacctctgtttcaggttataagactttctagcattgtccacattcatatagatgttaatgaatccaggcgcatatatatatatttctagattcattaatatatatatgaatatagacaatgctagaaagtcttataatatgaaacggaggaagtaacatttttttcttagggttccattgttagtttttccagcaaatgcagcatatatatgttgtctttgtattttggtcagatttttgttttgatgttcatcttcctaacctgaatcatccaactcctcttgttcgaaaacaaccttccacattacccgcatacacgccgtac

SEQ ID NO: 48470 - DNA, 13008 bp, Oryza sativa
gaattttaatattttattgtcatgtatcaacattcttgcaaaattatggcacaacttttaggttcaccacgtggttttatttgtaatatgatttaaccatacatattagatctaagtgcgacagagagacattgacacaatttagtttatgtgctttctttcagattgctgtggtagtgaaccaattgacatgacaattgtatgtaaatacaccatatcaatgtatttattggtcaatctcattattatttgtgatttactatgtgctgaaatgtctaatttacaatccttaattgttattgcaactaatacaaccaatgacatggctagacgtactattgtaggtagttggcatgatataatattactaacttctaatttaaaacatggtttcagataaataatattattcttcaatgatcctttgggtaaaaccacattttatcattttttttaagtctaatattcatgtcggttaaatgacttacctggatgtatttgtaggtcttcctcatcggcatcaaagttgagattaaaaggaaaggcattatggttgtgatctccatttacttgcagaacttgatccatggcatcagcatcgtttacaataacaaataccatgtgagtaccatgtccaaaaacaatactttttgccatgcagattattctatatttgtccatggttccatgcagattattctatatttgtccaaggcgaagacgacggccttgtccgggaaggaggagagccacgtcgcgaacctctcctccagctcgcctcgcggtggctccggcaccagtggccccgtggcgagcaccggcttgccatactgcgccgcgatgtagtcgatgtaggggccttccatctcgtggcaggtcctgatgacgagcgcgtcgcaggcgttgtggcaggcgacggagcggtcatgcgtgctcggcatgccgtggaagctggtgaaaatgtgggtgaagtggccggcctggtaggtcggcaccgtggagagcggcgacgacggcgggaacccctcgggcgccgacgcgagctcctcggcggtcgggcgcgcgccgtagaggccgcgcccgtgggccatgaagtacgcgccggagaccgcggggaagatcgagaaccgcgccgacctgacgccgagacgcctggcagcgtcggcgacccacggcgtgacgaagtcgaagagcacgacgtccgggcggagcctcgcgagcagcgcctccacctgcggccgcgtgccgtcgagggcgagcttgagcagctcggcgccgtccgcgtcgacctccgccgtgctctctgtgccctcggggagccccggaacgcgcggcagatgcagtgccacgacggcgacggccgtccgcaggcagcatggtctcgagtctcgacgtgggccacgttggccgccgccgacaggaacgtgacacgcaccccaccgacggcgaggaggctacgggccagctgcgcgaacgggttgatgtggccgaaggcaaggaacgggaacaacactacgtgcaacgtttcgccggcctcgtcgccgccggcggccgtggcatccacaccggccatgcttagttcgggactgcttttcagtgtgaagcatttgtaccccattaccatctatatatacgcggatggcgcatggctaaatcaataattagcacatatcattaacaattttgttgtatttttaaaattaacatgcaagcaatatcaaatcattattttcacattatttaaatatatattatagatattagagaagttatctgtcaattttaggtgaaatgatctttcagaaattaaaccatccataaatatttcttccacttttttgctatccaatgccgtcagcgcatgttagatatacacaattagcatgtagctatcagtttaggtgaaatgacatactctagtacatatactgtatgaacgccttttgttgctaattattacgtgcagtgataacacagcgtacaaaagtaacgcattgggtcctaaatatgatagggccaaagtatttcagaaagaatcctggttgttcttgtaagagtattagtaacttgcgcatgcaaatgtattttgcagacttatccacatgcgtgtttcccgctatatacctttgcttcaagctaacatcttgcagactcaatatatacaaggcaattcattcgcatttgcagaagaataaagaatcaagcttcattaaaatttcgttcaatcttgaaagtgaatgttatagataagacatcattaatatttttttttggctcggcgagacccaccatatacaagtcttacatgaaatcatacctcacctacggacggtgttccgaataaggaaagagaagcaaagtcctacttgagcacgacaagcaccactcttatcgtatccatacttggttatctaattctacatagacaagaggacacctgagggtataaatacaagacccccagtaggagagacgacacacacgggaggcgaagaaaaaaccaatacggatctaggcaagccacacaatacaatttcaatctcgccgtgtgatattcgaggaggcagaatacactagccgccgaccacatgtgagagttctatgttgctaagctgaccgggactagattaagtcctctccaatattgtactcgtgtgatattgatatataaaaggcaacaccggcttcagccgataggagtagggctattacccattagttacgtggtccgaacctgtataaaagtccccatctcctgcctcttttacctcaatctcgcgtataccatgtcactaacaatttccatattctacaaataccgtaggcggctatagcccgtcgaaagtggcgtgccaggtagggggatatggtgcttcaaggtttcgatgagatgggtccaagaggcgaatcgcgtgaacaaaaaatcttcgacgacttcagacctaggagatatgactcgactgaattacacaccacttcaaatcggaatcatcattatcccaatctttatcatgacaccgctgctatggattttccgatgacaaagaatcgacgacttggggtttattacaatatttcgtaaccatcatcgctgtttacggtccttaactaccaaatttgaccatcaattcatgcataaattttaccatagtctaccactaaatctagcggtaggggtttattacaaaccacttccacaagtgttggtgaatatttgtatgcgggtgaatacttgtggaaattaagagaaaacgcaagtaagagaaaacaaattccagccaatgagagaagagtacatgaatcaaagggcccacaccaggaggtgaaccgcctcaacgtcgtccaaacaccccaaaccgtcacgtggacctaccaggcagtgacccagataaaaggcggcgcgagggggcttagccagggttcggtcgaatgaggggtggctcccctctatcacaatttccacatagcatcaattatctctctcctggagacgttggtgcaaggctcacggtgagtaaccgctatagaatgtcggtttgaggacatgctgtggcttgaaaggagttggaggaggaatattctctcaaatcacctccacattataaataggcctccattccttactctcaacacacaccaagatataaatcattgctacattccaaaggtgaagatctacttagctagttcttagagtagggagtaataagagaatgtctggagaagtgccaggctgggctgtcggcattcttctcctggggaagtgcaaggtttgtcggcactcttctccaaacttgtcttcatataagtaagcattcatgacttctttgttgtatttactcttcttatttaagtaagatattttctcatagttgcggattcattgctctacttaggtagagtactttagtcttaagttggtaccgagattagagtagtaatcaatagcatatacattgtgtctaggctggaggttacatttgtttgttgtgtgctccacgggttgtaggggtaggcggtaggtgatgacaaccctgtccctctttcctaatccttaacattcggatacattatagagttgtaagccagagtcttttaggtaactaaaagattttaagcactaatcatcaaagttaaagggagcatccttagctggcaagctggtgaggggtctagctactaaagaaaaatgattaatgaaccgacaataaaaccccgcatgacccaggaaactacggacccctttaacattataggaggtcggagttgttggattaccacaattctaactttgtactcctgtactgctttttcggagactcgatgttcgagcactattcctagttaagcacaaaatccttttcacgaagtggcacttttactagttctgaaccatgaaatgacacttttcctagttaagcaccaagtcctcttcatgacaccgctgcaagactttgtccaggttctccaagcattgatcaaaactctttctatagatggataagtcatccatgatgatttccatgatttcctcaatcatgtcggagaagatagacatcatacaccgttggaacgacacgggtgcattacacaaccgaacgacatccgctggtatgcgtacattccgtaaggacattgtaacatcctcaaattttaaaactaaaatttgactgcatcatgctggcttttgattaatttagtgtgttttaaaaatctatttgattcctaagtggttcaagtattacttctttagaaccctactaatttaccctaattataccctttattccgaaccttactaaatttgagcaaattctctcaaatttcaatctttagattatttccttaatttaccctaatattagtaaggatttgctatactccaaaccatagtgaaacctttccaaattcatagtttaaattcaaatcttctcaaggaaaatattcaaaattgttgaatttcactgttcatcgcacacaaggagctcgatgaaatgcctagcccagctaactcagcccaatctctacccaatcttttgcaaagtctatgttggatccttggggaccacatcccactcaaaaaccatggtttagttggccttctcctccccttctcgcgcgctgcctggcttcctaccttgccgcgcgccgagccgccgcgcgtcggcctcgggacccgtcgcgcgtgcccgattgccttggcgtgtcgtcgcccgtccgacgccctcaggccgccgccgccgcaccaatcttgacgacgacaaagccgggatgacctccgccgcaagaaatcgccgctcgatgccgtgcgttcccgtccaaagccgccgccgagtccgattttgattctacccagggtgaatcgcgccaattcttgccacacggttgaattgaagatagaaggtggtttcccctctctcattcaagccattcacccccaagccgaccgttttaaccctcactaccggtgcgcgtcacgcccggattggcgccaacacgtcgccagccgtttctactcgcggtcaagccaatccttcgctggtaagtattcaaacgtggcctcccgccactcatattgaccttggccaccctctcacagcctctgccacctttgacatatccaatccttgagctcatccatggcgatgatggcgtccgaactcatccacttcccctggccctataaataggaccccaaccctttccttgtccatcatcgatcatcaataaccatagccccgcaactccgaagctctgtttcaccaatccattccatcaaccaccctcgtccgtcgatcgaacaccttgtgcgcgatcgactccacacccctccatccatcctccaccttatataccccttagaacacctatatcctaccatgttttagcatactagatcctaaccgaagctctgcgtcgagttttacctcgccgtaccaagccgagcaccgccgcccccgcgctgctctgttcttcgccgccacaaagtttttccggccgcaacccgtcgtttcaaccgatctcggtgagttctttcgttttaaccatctatgtactccctagattctattttagcaattggtttgctctaccatgccaccctctgggctgccgacgtgagcacggccaccgccaatggaggagctcgtcggcaaatatattccacaccttgccgaaggtcggcaagctgcttaaacccttctaggtacctgatagatgctctagaacccctccccgagccatgtctaactcacataaccctgatcaccttcacggcttaactatgccaccgccgccctagccgctagctcaaccacataccaaattaacccctccgccgccgctcaccgtcgccggagtaccctagctccctcccatcctcggccgcaacccctcttctcctccatcaccgccgcaatcgccaatcctagcaccgccagccgtaaatagggatcggctggaggtagaagaagagaagagagagagagagagagagactgacaggtgggacccgcacaccgtgccatttcacatttaattgattttcaaactttagaaacccatatctttgaaaatataggtccaattccattgaaacttggaccaatattcttctaaaatcattctctatcttttgagacccattttgttatttttctattttattttattttccctatttttcttatttttggattgtatctgaattccttttgaatttgaattttatatgtctaaccctaggtcttgaggaatcttttgacacactagataatagcaatcaatctcaggacatcgagcaaggcaagttaccatataccttttgatcatttaagcctatattttacaaattatttatttatagcattcttttcaatattctattttatatgcataattcaaccatagaaacccagataatttagtattgcttactttgcttacaatctgcttaaaattccttaaacttagattgggacagtacgtaaggtttggttgatttctgggtggctagtactgtctcgatcgatatagtttttaccaggtacttatgtcgaacgaacgggtacgaccacagtttctagatggggatagacctagttattatgttaattaacaatatggcacctctgtatagtggttcttatttttaagtcctcgcgcaggaggcaactatagcagcgaaaggcaacttttaaccattaccatgtacaggtaaatggtttgtgatactcgagtataaattatatggtatatttctaaaccctaatcgagatgacgtggtgtcatacgattagttccccttaaatatctcgggaacgccagaactcctcttgctgctgttaacaatacgttcagagcatatgaggatataagttcatggaataggtgccacaattgttaataacttaatattgggccatgactatagccgatgattatcagcaagttgtggattgcgggtaaagcgtacatctactgcagtagaatatctttgaaactattcgaatagccgtactcatggaattgagtaccaggactcatatgttaccctggttagaaatttaaagtctatatatatatttataaattcttgctataactcttctagattgtttattaatgcttttcacaaagaaccccattatatgccaatgcataacatatttccatgataacttgctgagtattgtcaatactcattcttgctcttatagccctttttcagatttgggtcaagaggaggacccctatgactattactacgatgaccctgataatttagaaaatccctaaaggttatacctctctagtcagaatgtatataaacttccgctgtgtattaattctagttaattaattaggtgagtacctattattgtaaaacccttagtattgtagaactttaatgtatgcaattaagaaccagttatattgtatgtatcaatatttactgatccagggattgatacattaatcatagtcggatccaagtaattagttctgggacccgacggacatgtaaacattgtcttgctttgatcatcggcatagatgggaatttgatgatttcctagctaatccagcatctcatcaatgaaaggtagcgggaaatggtctttctttgtagctttgttgagctttctgtaatcaatgcacatccttcatcccgtaacaatgcgtcatcgaatcaattcattcttcgagttttgaatgaccgccatgcctcccttcttacgcacaacctgcaccaggctaacccactctctatacggcataaaatatattatcccagcgtgtaggagtttcaagacctattttttcacgacttctctgatcgcactatttagcttctgttgcggctcttgtgcatacgtaggggtaacgccccagggcctgaaaacgtatcatcccgttatagtgcgttgtcggatcaagtcgttcttcaagttttcaatgactgtcatgcctccattcttagtcacagccttgtcgcgcccggaaaaataccttttccagaacactagtgtattaatacccgtcccaggaaaagccgggatacaccaaacaaatatgatacaaaaagtacatatttattatattgataatatttacattattacaaaggcacttcaggcctgacaaacaaaaataaacagcagcggactagcgagcctacgactccatgttcacaggcgctcaactggggtataagccatgactccacctaggacttcttctccaaagcttctcttactgaaggggggaaagatagagcaagaatgagtacaaccacagtacttagcaagccacaccaggagatgcatgattaatgcaagggggtacaaggggataataataggggttaagtttggcagtaaacagcatttaaaagtcacttagttgcccaaagctattttgtaaacacgatcctagagctacacaatattattaatcaaggccgtgaacccacatgaacctgccttaacccaaggcctacgatgattcagaccgaactggcaacctgacctggtcccaactcgtcccaagccaacccaggccaaccattccacattttagttgttaagcaagttttaagaattaaacaactaacttgggtacattgctaggcttgcccataaccaagggcgcggctattcgaatagatttactctgatcagaggtgtacatctttacccacaagacatatctttactccacattccatggccttggaactcgtcgtaaacatgtgacataacccttcacccatcctagccgtgaacaaaagtaccgacccaaccctgcctacggccagtatcctagataggcaggccaggattgagcccctagcaacaggatctagaccgggtgcgccacacacataggggtgagaccacccgcgtactagtctagtgccatggcatctcgactaacgggcaccgacccgtgtagcattcatttgtctagacatctcgattaccaagccgcagctcacgtagccttcatttgcctcagagatatccatcgtctcaacgacttcatccatctctatccgtgtccttttgttcaggactagactgagcaccgagttaagccttacccattagacatatggttagtacggtagtgctttgcaacagaggcccgaagaccggtccttatggtggccgaggtgctcctagcaaaaccatgcacctcgagcccagcctacaaccatttaggagtttgaatagagggggaggtgtgtgttcaattccatcacaagccaaccattccataatgtccaaatgatatgagaactaattaatcagttataaaaccatctagtgtggcataattaatcagcgaagcatctacctaaattcatactagtggaaccattaatacagtacccactagttggggttttgttttcctagggtaagcgaggtgataataaacaatagtaatgataaggctataacaaggattaataggtattactaaaaacagtgataacgcgggaatttaaataaagcgataatgcaataatttaaatcaaaataattttataaactgggattcaatatgctcaaggatgatgcgacttgccttgctcagagagaacggccttctgaaccttcggcgacgaccacgagccacgcttcgggaacctccggaacgaaagaagctacacgaagcacacaagcaaagctacaagcctataaagaagcaataacagtatataaaaagaaagcatagggttctttaggttataacaaacattaaaagacttgaacgggtcgattcggggttcgtatgaccaagatatggtcattcgaagtttaatgttgttatatggagattggcggattattataattaggctttgcaactataaaacatgtgtaagcgctatcctggaaaagacaggaaggctgtgctgttgacatgcggaccccacatgtcaacctaagggaccacggtagaccgggtacacagagacggtccacgggtcaacagaagcggaccccgtgtgtcaaccgaggtgagtggccgacaaacgtactccactagacaccacgcgggctgcacacgtggaaaccacgcggctaccgagcgggcacactaacacggtcaccacacgcacatacgaacgactaccgacaccgatacatgggtaccggggtcgacaaccgcacaacgggcacggggcaacaccgaaaggacgaggacggggcagtgggaggacggacccttaccaccacgcgacgaggcgtgggaacgacgacgacgaatggctcggcggagacggacggaaacgatggagacgaatggacaacactttggcggcgatccttggacgaaggcgagacgcagccggcgcaacgcttgacgacgcggagccaaggacgaagacggcgacagggctgcgacgcactcttgacgaaacgcgggcgacgaacgagcacggcttgacgaagggagggccgacgacgagcgggaacgacgagaggacgacaagggcagccggcagcagctgcacggagacgagaacggcgtggaacgcgccactgcattgccgacgacggaggcggcgccatgggacgacgagccgacggagaggaacggccgaccggaggagacgttggcgaggacgaccggcgcggtaggggaggagggggaggcgacgccgaggataaccttgccactgcaatgccgaaggtggagacggcgacgtcggccggcgcactggctaggcggaaggggctgccggagtgggtgccgacgagaacgagggaggggcggcgcggacgacggcgttcgggcgaaattcgggcgaggagatggtaaggccggggatgaggacgacgccgcggagctgagggaggcgacggcacggccgaccgaggctcaggcgcggcagccgaggcggccggaggcggtgtagtggcggcgacgccactggacgtcgacgaggacgcgcctccggtggtcaccgtgcgaaacggagggcaggctgggggagaggaggcggttgcgatgccgaggatggcgacgacacggcctaccggtgcacgggcgaagagggggaggcggctggaagtggccggcggcacgggagagagaggagggcggtgggaagaggcggtgcgaccacggggagacgcgggaggaggctaaaacgagagaacggtggaaggggatcccattttatagcggaggggagctagccgggcacgggagagggcggaacggcgccaaaaaaggcggacggctgccatggaaggtggccggggatggcgcggccgttccgggcgattgagggcgctactcaagggggaaattagggggaattgaagaggaaggaattacggagaaattactcaacgtcgccgcctctgcctcgccgtcggccgtcttccgtcttccgtcgtcgtccatcgtcgcgccacacctcggtgagttccccacgtcgtgctcttgtcttcatataagatgcagtgccgcgacggcgacggccgcgggcagcatggcctcgacgtgggccacgttggccgccgccgaggcgccgacaggatcacaggaacgtgacacgcaccccacggacggtaaggaggctacgggccagctgcacgaacgggttgatgtggccgaacgcaaggaacgggaacaacgctacgtgcaacgtttcgccggcctcgtcgccgccggcggccgtggcatccacaccggccattcttagttggggattgcttttcagtgagaagtatttgtatcccattaccatattacgggacgcgactccggtttcgcgcccgatggaaggggattaaaatcgggcgtcgatttaaatgcaaaattattttaaactgatttttctcttaaattatttatataaattataatccgattgcaccattaaattcgttgtaattaaatcttcaaaacaagatcacacatgaatatattccgatgaaaaaaatagcttattattgaattattatttttaaatattgcattatgttccaccagtatatcggaattgtttcactaagtagattgaaaatgtctcaatcgtttaaatcgggtgttgtttcaccttatataaaaataatgtttcagcaaatagcgaaaaaatgtttcagatcacatttttggtggaaaaaaaccaaattaaacatagtgaaacatttttggtggaacaaaaaataaaccaaattcccttaatagagggtttccaaaatatgtgggtttttttgttgtaaaaaatattttaattcactgcaacattagatatataaatagtgaaacattgtaaatacactaggtgaaacatctttttggaaaaaggagagggacaagtgggtgggtccaacagatgagcacgtgggggagggggagggaccgattttcccacctcccccggtcaaccgatgctgggcattctcctatattaagggcacggctaaatcaataattagcacacatttaatgggccgggtcaatgtttgcttggcaaat

SEQ ID NO: 48471 - DNA, 9913 bp, Oryza sativa
ccatttccgtcgaaacaagatttcggcaatactaaaaggggtgccaatcaagcttgaaagtggatgggttagaagataaatgtttatacaagttcaggccttctcaatgaaaagtaataccctactcctgtctgaggatttattccactgagtgtattattgatctgacaatctgggagaaaagtcatgtcctaggagccccggacccctccttatatagggggaggagcagagattacaatggacaacccatataccttacggactacgggatacttccttatattcaagttaacataatacacgagtccttttctaaacatattctatctatataagctatctactataaccaatcggatatacatgccatatgggtatgcggtacccataatctttccaatttcattctagctctgcccctgtctacaatgtgggtcttaaaagacccatagagttccttatgatgaaccttatacattgtgagacttaaccatgaggcattgaatattaagattgaccttaagcttgtggctcacctttaggaataaaataattggataaataaactgcacacgtagcgagtgagagaataataacaaggctctgtcataaaaaacgtgccatttcttaaaaatggttggagaaaacaacggaagaaaaaataacttagtttataaaaacaagccgcttcgaaaaaaccataaggaaaaaaaaccgtttataaaaataccggatcaaagaaacaatcggactcaacgcgagaaaaaacccgcaacggtttgagaaaccgtccgacttagcgcgaaaaataaaaccgactgtttctttaaaaaaaaagttagagaaaaccatatgactcaacgcgagaaataaaaaaccgctcaaaaaaagcagtctgactcaacgtgagaaaaaccactttttataaaaaaaatggttcggcatcgtgcaatgccaataaaatgtctgatttgaaaagaaaaacgttcgattccagaaaaaaaaaagattcctaacgttgtgtaatccatcgtctatcatgtcgatttggttttttcgaagcgtcgttggttgaatgttctgacgtccgaatcttagtcttgcttgtcttttttttttacaacgagataaaattaaaattgatggagtggtttttgtttcctcatctattcttctgtattggaggccctacacatcacgattatcagactattttgttaagtatagctacttttcctgataacatattatataaaaataatattaaaaaaatacacatatttttaattgttatttggagagtacacggtggctttattttgtgtagacttgaccatgcgaggcagtgtaagatttgattgatcttattactggttgcaagactgagattgaaagagtattttagactatatgctaccacatgaataatccaattcttttgggtaaagcaagcatccacaattacattaaagatgttctaatttttcttatgatatgtcttaactgtaacgatctatacagacattatcattgacatggttatgcataaaaagtgtatattgatattggattgtttttcgcccgttgcaacgcacgggtatttttgctagttactataaagttgatgctcactactctcctaaaactcaacatgtaagtatgtcatatcatcacccacaagcaatatattattatctagagtattttaaatcatatacaagtatgtcacatcatcgtattttaaatattatgtcaatatgacatatcatttctaatgtatttttaaaattaacatgcaagcaatagctaaacaatattttcacatcattatcacattattgcttgcataatgtttaggtgaagttatatgtcaatatgtttaaatatgacattaaaccatccataaaattgacatatagagattagagaagttatatatgtcaattttaggtgaaatgatctttcagaaattaaaccatccataaatatttactccatttttttgctatccaatgccgttagcgcatgttagatagacaattagcatgtagctatcagtttaggtgaaatgacatattctagtacatatacgtagtaatgtatgaacacctttggtcatgctaattattacgtgcaggtgagaacacatcacgcaaaagtaacgcattggatcctaaatgtgatagggccgaagtatttcagaaagaaccctggtttgtcccttgtaagagtattagtaacttgcccatgcaaatgtattttgcagactcatccaaatgcgtgtttcccgctatatatctttgcttcaagctaacgtcttgcagactcaatatacacaaggcaattcattctcatttgcagaagaataaagaatcaagcttcaatgaaattgccaatcgatcttgaaaagtgtcggtgttataaataagacatcactaatattttttgttaggctcgacaggacccaccatataccaaattttatatgcaatcatgcatcatatacgaaaggtgttccgaataaagaaagagaaaaaaagtcctacttaagcacgacaaggactactcttatcgtatccatacttgttttcctaatacaagacctcctagtaggagaggggacacacatgggaggcgaacaaaagcaaatacggatctagacaagccaatacaatacaatttcaatctcgccgaatgatattcgagaaggcagaatacactagccgccgaccacatgtgagagttctatgccgctaggctgatcgggactagattaaggcatccccaatgttatacttatgtgatattgatatataaacggcaacaccaacttcagccaataggagtagggaaattactcatcagttaagggatctgaacctatataaaagtcactatctcccgtctcttttacctcgatctcgcgtataccctgtcacttacaatccccatactctacaaatactgtagggggatttggtgcttcaaggtttcgacgagatgggtccaaaaggcgaatcttctgaacaaaaaatcttcgacgtcttcagacctaggagatatgacctgaccgaattatgctccacttcaaatcagaatcgtcatcgtcccaatctacatcaagacactgctgctacgaattttccgatgaggaagacatcgacgaattggggtctgggagaaatgacccgaccaaaatatgttactcctatatatcgtaaccatcgtcgctgttgacggtcctcaactaccaaatttgaccatcaattcctgcataaattttaccaaagtctaccaccaaatctagcggtatggatttattacgtactaaccaattccataattattggtgagtatttgtatgcaagtgattacttgtgcaaattaagagaaaacacaaataagagaacataattccaaccaatgaggagaagagtacatggatcaaagagcacacaccaggaggtgaaccgcctcaacttcgtccaaacaccccaaaacgacatgaggacccaccaggcagtgacccatatgaaaggtgctgtcagggggcttagccagggtttggcgaaccaggggtgttagcgccgtcaacgccggagagcttgttcagggacatgcgaggctcgtccgtggcgtagactcatcaggctggtcgagctcgacatcgatcgccagttcatcatgtaaacccgccgtgaatagctagatttactgctggtcggagagggcttcagacatttagcatgcgagcgtcaagaacatggtctggtaggcagccaccgtggatgtctgcatcagccgcttcagttcaccgagcgagttgcagtggatcggtggaccgaattggccatggcagaggtctttgaactcatcccacgtcggaggccccttgtgaatttcatagtgaaagtaccattcctgtgcgttgtcggcgaggtggtacgttgccaacccaacacgatcactgtcatgcgtcttctggccacagaagaattgctcacagtggttgaacctgttgagcggatcgtccttgtcatcatacttggggaactccaatttgtagaaacgaggaacgctggtagcgctgcccgtatcctgtggtcctgtcaccaatggcggcgattggcccgtcacggcaggcgtacccaggatgccactgccgcccaaacaaggtgcgatctgtggcgacgatgatgacatcgtgccctggagttgttccagggatgtgatgcgtgatgtggccaccgcaacggtccgactgagatcagctagatcgtgcttggaagccaacaatgatcacatccctggaaccttctgacatttggtcttggagcttggtgggcgagtcggtgggtttgagaatgggttgtttgtggatggagagatcttctgacaccatggtcttggagcttggttgttacgagctccggtgtatgatctaatggggtaggagtgagtaatcggtggctgaggtttcggcaacttaattagaagatcggcgacccgtggtagtggcacagaagaagagatgagaaaacagagaaagagatgggaaacaaagtggaatcttgcaagctgatttcaatcccaaatgccctgtaaataggcttacaaatctaacttaatgcctaacaaataatgaggaaaatgtggagataacaatccaatctcaattaaacttatcattggctaggagtgtagctgtccgacacggccgctgttaggcgcccgtgctcgcgtcgcctgctcctgtgcgcgctacaccttccgcgtcgcgtgtcttcctccttcggttgcagacgatgtgtcacgcccagaaattgctaacctgaattttaagcagaatgtgtattaaatatctgtccagggccagccacgtcttacaaaagtaataaaataaatctaaaaaatgcaacggaaaaagcaaataaacaagacttaatcttcacgaccaaaagtatagcttcctccataaactacaggcaatccttgacgtccggaacaagctcaatcctcagagaactcatcatctgaaccaatttctgcctctgggtgggtgggggtgggggggataaaacaagactgagtaccaaccactgtactcaacaagtcataccaacgggaaggtatgatgcaaggtattctcaaaggagtggctcattggatatttgcaataaaagcaacatttataaatcattattttgaatgagtaaaaacagtgtataattaagtagtattaaatcatcattgtccaacgctaaatccacgttgcaacaggtccaaccaaaccacctgaactacaccagttctataagtcatattattatagtgggactaatcacggtgaactggttgaccacccaataaccgcaagcacggctattcgaatagttttacctctgatcagaggtgtacaactttacccacaagacatgattccacacatgttaccatgctgatgttgactagggttcccgatcttccgaaaggttctaataggtagtcgatttggacggagtcacgacacagttcgatccggcttctaaacaaacacgctcttgagccccgcaatcgcagcaccacgtctcctctggttatcacccgtgttgaaacacggatgacctcgccgagaaggcaaatccctgtttgcgaatcgaagaacacaaacaagaacaaagaagaatacaaccaaaattgcaaataaatgataaagctcacgagttggggtcttacaaaccgatctagcggcgaaactgttcttgacagaataatctaagcaaaacccaaaccctaaatatgacgacgggtattgatatatagaatttagggtcgtgtaaacaacccttgacgcaaccctaatgggttccaacacgatacacggcctaaacgcccaaatacgatgacgcagcaccggaatagattatggacgttaaattgttcggtcgattcccgttgacttggaaagaatttgaacgtgggaccagaaccattggaaaggttatgttctaagttttccatccatataaggaacgccccaatccgtgcacatatgcgacttgggcgcctgttttagtgcagactggtcctggactctgaatcgtactcgaagtcgacctggtttgggcctccatattgacttggacgtccttgatgatcctccatgcctctaagtccctctctaagtccttgtcctctcctttattcctaatcacaatatattcattaggtagcaatctattctcaaaatcatataaagaagaatataggaacgagctcacctctaaattcaattgtcgcgcacgagctcttgttattggtccttgaatgaccggtggaggattgttgtatgtatctgaaggagtgatgtcctcatcacatgccctgaagtaccgccacgatactgcaaagggggaaatcgtgacaaaacccatcatataactctccctaaccaaacatacccatctcaggtttcaccccctccttatgccaagtcgggcaatcccctctcgtgcctaggtaaatccggaaacaacagagacaattatctaggtctgaaccgcacaatcgcctctacccttgccatggtatgttagctaggttaagttatactctagattaagcctggagcccatgctggcatgtgataagaacgagtatatcttccatggattcccgagaaccggtccttaattgtcatgggtacgacttccaaaatcatgcatgtacccacaacccaccattaaagcatattttagtttaattaaaccgtaaccatggtggtacatcatcatacaattaaggactaaattataatgaatcccattgtgagctaattgatctaagtatggctaagcattcctaaaccaatcacctagtcaattataactcaagttatcaatggcataagatattcaacatgctgagtacgataggcatccatcccacatgacattctaaaacaatgcaatttaatagaaagtaggggattttgtaaaatagactcaacatgatcaatgatgtatgtatgacttgccttgctcttgagctgactgaatctcggcaaccacttggaaataaattggatctccggaactgacggaatctaaacgacaacaaagcatacaagaaatacaagcaataaggctactgaaacagcaaaataaaccaaatttttttatcttgttctggacgtcgaagattgcatgtggtttatggtggaagctatgcttttggtcgtgaagattaagtcttgtttattcattttttccgttgcatttgtgagatttattttgttatttttgtaaaacgtggatctagatagagatttaatacacattctgcttgaaattcgagtaagcgaatttctgtccgtgacacgatgccaaccatgacacttcggtatcatctcgtatgcaacgtatgcccgcatacatgttcatatatatgtatagttgtattggtcggctctgataccatttgtaacgctcaaggcccgaaaacgatgtggctcttaattttggatatacttttgagtatgtggaaggaaaatggagggagtggaatatttagagaattaattatgggctaaatgaggttttggatttgggatgggaggataaaatatattttcttgcaattattctaaaaatattattcttctgccaaggttggagtcaagctatagaaattaaattacagactagataggaattgactattggaatatttatataaaaaaattggatagaggagaattagagataactctagatccaaggttttggttaaggattaattcgaatgaaatcagaattacggtggttgaagttcaagggcaatatcagaggatttcttagaccataattcatacaagtaaaaagtttttcaattaaattaaataaaggaattttagtctaaaaaagttttgaaattcgaaaataaaattcaatcacaaaattcatcaatttagccaaatatatttttaaataaaaaacacaatagaaattaaatgttggttagtttgaggaggttactctaattattctcctaggtttagaaggttattaaggtgctgaattagaaaataattatttttaggatgttacaacagcacaggcgtggttcgagttttcacgccacgtgccgtcgaggcggtcgaagaatgcgttgcggctcagcaggagctcgcgcggagtcaacacatcagcgtaaatccaaattggcgcgctagggctagtcgacatgtactcgcactgtgaaaggcgggcgtaattaaatagaaggaaaactatgcaggtaggaaattaatcaccgcaagacaaagaataaagtagtactcactccgggttgataataattatcgttttggacatgagcatggtcttaaaaaaaattaaccattattttttattttaatatgtgtaaaatttttaacaaatatgtgattttattaaagtatttttttaaaactaatttatatatgtagtcactgtatttgaaagataaatattataaaaatgatttataatcaaagatactaaagtttgacctaactcctatgtaaaataataagtattatcaacccggagagagtaggttttaggtttcaaatcatcatcgatacaagttccaggttgcagctgcgagaagcacttatatgcgaatgggccatgcctgggccggcactgcccggcacgaagtgccgaccgtaccgtgccggcccgatcactggtgggccgtacctagcgcgtgcttgggccgggctgtgccgtgccggacgggtcctgtggccatctatatatgcgatatgcggcggacagtttgagaaaatgacaaaagtatgatgtagcacagtattacacagtgatatgtactaatcataaaaataatttttataaataagacgttaagtcagacgttggatataaccagtgcaaaactgcacttattttattttatgacggatgtagtactccctagagcgagaaccgcgatgcagtatcaagcaatcacagccgttgattccttctcttcacagtcttcagaacagagtccgattttcttcagagttgtgacagctgtcgatctgattaacgacgcgtgacgttccgttttcagcccttgagccttctcagctccgccacgaactcccgcacgaacctcctctgcacggcgtcgtccatcaagaactcccgccatttcttctcctcgccgccgccgtcttctcctccggcgaacgccgccgccagcgcgtcgcgcacgtcctcacgcccgaaccacccgtcgcgggcgcggcgcgcgacctcggtgcccacgcggagctcgcgcgcgaacagcgcggcgttgaggtactggtcgcccttcatcggcagcagcacgaggcggcagccggcgacgagcccctccacgacggagctgagcccggagtggttgacgaagcagcccacgctgcggtggcgcaggatgtgctgctgctgcacccacccggtgtgcaggatccctctccccttcaccctctcctccaaccccggcggcgtgagcttcctcagctccgcctcggcgtccgtgcccttggggaagttgagcactgcgaggaacggcagggcggtggcctctagtccgaggaggagctccgtcgcggcggcgtgcagcaggaaggtctcgctgccgaaggaggcgaacacgacggagttgtccgggaaggaggagagccacgtcgcccaccgctcctccagctcgcctcgcggcggctccggcacgatgggccccgtcacgagcaccggcttgccgtgctccgccgcgatgtagtcgatgtaggggccttccatctcggcgcaggtcttgatgaccaggcgtcgcaggcgttgtggcatgcggcgacgcggtcgtacacgcacggcatgccgtg

SEQ ID NO: 48472 - DNA, 20936 bp, Oryza sativa
gacgtccgggtggagcctcgccagcagcgcctccacatgcggccgcgtgccgtcgacggcgagcttgagcagctcggcaccgtccgccgacacctccgccgtgctctccgcgccctcggggagccccggcacgcgcggcagctcgagcgccgccacggtggacgtgccgccggtgccgcccagcatggcctcgacgcggggcacgttggccgccgccgacaggaacgtgacgcgcaccccggcgccgacgccggccatcttccgcgccagctgcgcgaacgggctgatgtggccgaacgccaggaacgggaacatcaccacgtgcaggtctccgtctccaccgccgccgccggccgccgtcgccaccggcgccgcaccggcgcttcccatcgtcactcacgacgaacgtggattgcaatcgagggcagtgaacggagacggttggcgaggactttggcattggttctcgcgactttaaaagggagatggagctgttcggacacagtactgcggcttctgttcggacacaggactgactcgtgctcgctgctcctacctaaccgctcggacatttttgctgttcttttttttttacttactagcaaaaatgcccgtacatttgcaacgggtgaaacaattctaattacaatatacgtttttcatgcataaccatatcaatgataatatttatatagattgtttatagctaaaacaatcagaaaattagaacatcttcaatgtaatggcccaaccttgatgatgacaactttaccgatgctttgctttacctaaaataattggattatttatatgacaccatgcatataatttaaaatactcttccaatgtcattcttgcaaccaataataagatcaatcaaatcctacagtgcctcgcatggtcaattctagacaaaatagagttattttgtacttttctctaaataacaattaaaatatgtttattttttaatattattttcatataatatgttatccaaaatagtagctatacttaaaaaatagtctaataattgcctacagaatatgtagggttttcaatacaggagaatagataaagaaacaaaagctaggtaggtaggagatgaaaaaaaaatgatggatcatatccgaccccaagcgtccatcaatttagcattttctttacagttttttcaagagcaacttgttttttttatgaccgatgtttttttttcttgtgcggtattttcaaaccattttttagaaatggcgcgttttttcccttttttctatcagttttttcctcgcatgttttttttgcttttttttacaggcaatggaaatatttttttcccgcgctttttttatggacaacggaaaattttttctatcgtgttttcttttgctcttttttctaactttttctcacgcgtttttattttctcgcacattttttctgacttcctttttaaatagttagattatattagattagagatagagaagagatgataatgactattaaaacgaatagaaatcggatttttttttgccgcgccttttttccgccctttttactttttttttctcacctttttttttgccactttcttagggagtccgaccttttctattttttttattttttacgatttttttcttttctccttttataggaatcggatttttttattgctttctccaatttatggaaaatcagacctatgtttttcttttcctttttcaccacttctgttccccttttataggaatatgattttttttttatattttgccgttttaggaggaattggatctatagcgtgttttttttttggctttttcgccactttgggaatcggatatttttttcgctgtttttttattttgacggacgacggaaacactttttattttttaagtagtagaagagactagcgtaatgcctcccgttgcaacatgtcctaaataacattcatcaacataaataaaaatcctaaaccatatattacaactgagcataaataataaaggaaatataatcatagaaataacaacatgacactacaaataattttgaccggaattattaatataatgctaaagtccccttttattcatatagctataaataattcaatgcgaaggaaaaatataagtttcaataatttttattggatcaaatagtaaaacaaatactgtaaatagaaaaacaactgaaaactaaatttagctagaaattgaaaaaacttattttagcccatagatgaaatattaattttgaacgggtactcgtttctttgacatatattaaaattttccaattcaccaaacggtagcgaggaaagtgtccggatgtgttccacgatgtgactcgtccatagatagcggtggttggcaacaaagaaaaccaaaacaacagaaacgcgaccaacaacgatgtggtcctaacaggattagaaacgccaacaacgagctctagtggtgaacacggccgggtgagtgcgttaaaacacgttcgtgaatgaggtgattcctttttccttggacgtgctattgttggcatcgaagaaaactgaattaccaaaacaatgggaatgcgggagccaacgacatggtcccggtagagaaacagcaacttgacgagctctggtggtgaacacggacaggtgagtgtgtcaaaacgcgttccgagatgaggggattccgttttccttgaacacgctgcggttgacaacgatagcaagaacacgagtggcaatgaagtggtccccggaaaacaacaacaacgatctctgatagtgaacacggccagatgaatgtgtcaaaatgtgtttccgagtgaggggggttccgttttagttaacacgagggaggaacgaaagacaaacagaaatcaactaacaatattcatcatcttccctagcgctgaagccagtgtgcttcgggaggacgcactggcgagaagggatggagggtcgggagaagagtggcgcactgggaggagatagctgctagaagggagggggcgcacgggaggataggagtgctgggacaatggggcaacagggaggggaggcgccagcagaaagccgcgggagaggaagggagcatggggccggattggacacgtatgcacgatgtatggaaaattttggacggacgaactaatttttggttggaagcagattttaatcttttagattgcttacggtcgttagcgatcagtttcgcccgtcaatattaccaaaataaaggagaactaagtcatgcttgcaatgcatattgtgtcaaaataagatatattccactagaactaggatttctaacctcttgcagagaataaacataaatagaggagattcgatagcaaaaccatacaatagatcaatcctacgctgtcgagaatcagacttgaagacaaatgggctgagaacaccaaatttacaagacccaggaagaccaaaattcacaagtctgcggagaggagcggaagaggaggccgcctgccaaagtttgggccgattgggccagcccagggttcggccgaaccagccgtaacgccatccgatgcagggtttggctggatggtctggattgcttccctatggtggttggagggtactaccgacctttccaaccgccataaatgtcattaccagcctataaaaggccctcactccctctatttcaagacacatctcaagcaagaagcttcatacattctctcaagtttagtatagtctctagagcatagtggaatagaaataggatagaatcttcagtccccggagtcttcggaagagttcgggtatggctctagtagcttttctttcttttgtaagacttgtactatttatagaatattcttctcaatatatttacagtactttacttcactgtgattatttgagtaccgactttataagatattattcgagatataattgtctagctagcttactcgggagatgcaatggtgtgggtataatgttcatttatatgaatactcttgagtcacgacggtgattgtagagtagtatttggtagataagcgaggtgcataggctattgaatatcattatttgcggttatatgctgtggatacgtcaagatgggccgttgatggtgacaactcagtacgggtattccaccgcgtgtgtatataatcctaagttactttcctggggagggtacttctccgtatttagccctggttggatgaccatgacgggttgtcgcaaggaactcggcaaccaggggtggtatctcgaaataccaggatggcatcgtaaggggtattggctatataatcatatagtactacctccgtcccaaatacttgtcgctttgattttgtttgtaacttttgatcattcgtcttattcaaaaaattatagaattattatttattttatttatgactttctttattatcaaaagtactttaagtatgacttatcattttttatatttgcactaatttttcaaataagacgaatggtcaaacgttgcataaaaaagtcaaagtgaccactaatttgggacggaggtagtagataatatcgactaaagtgtgtatgtatattagaagtataggaaatgattttttttcatattttttccacttggcctagaattagtatgtatgagaatagtgaatgcttctgattcgtgtcaccctaccctttgaattaaactgacccatgcctagactttgattattacaagtaacatataaatattagctcggttctctctattataattttctctcgggattaaacacatacgatacccttggaatacttttaggtgaaatgatataattgtatatccgcacgcttgcagatgaaattgtaaccataatataccacgagtgtttctgcgccattgctggtaattatatttctagtaatgtcgttaagaaataccaacataggtaaagataaagacaaataaaaccctgtcacctgtcaacttatagaaggaaacccaaataacaatagatatataaacttaacgaacaagagaagataaaataaaagacgagagtcgtataataagataggagaaggcacctacgccgatggataaacaagcaaacacaacaacacccccaaccacttgtggagagagaagtaaggggttgaagaccatcaaatcgatcaaccattggcggaatggcctcattcgattgttcaccctgcttttgcttgatgaggacgagtttgcactcccagcacttctgaaaaccagtttacgtgagactccagagttatatattcacccctttgaccttgccaatcttcctctcaaacggttctaggggagaacaccgtagcgcagctgagaatgagaaaaggaagatccatatcacttcaattgtttttaactcttagatgattaatatatggtccaaactatcttcctaattttcttctctcataaagtcatattatcttacttttgcatttgaatcatcattctatataccacttactactattgtgcaactagtctatatagaaaaaataacaaaaaaaatacttacatacatatggactatccatatgaaaataaataatattatctatctcgactcatctctttttttctactaatgataccttgtgtctatatatattgtaaggattgctataggtaaagtatacttagatagaacccatctatatggattattttgccatatacattagtgatgttctaaagaaaaaccatcaccaatactaccggtctggtttttaaaccgatatctctaatttattatagacgcatatttttaatttattattaaatccagtgcacggagacgttggcaaggactttggcatagttctcctgactttataaagatggagctgttctgacacagtagtgcggcttctgtacgagaggactgccgcgtgtgctcaccgctgctacctaaccgctcggacgtttttttttttctgtttcttctctctttctggtctatgctataaaataaaatattcttacctcaccgtgggatcgcttgaccatataaggccattagcaaggtggtcgatttttatgactgacaatatatttaatggggtgcgcaaaattaaacagagatggtgacgtaggtgtttatgatggttcaggtccttggaaagagataataccctatatccagtgtcctatatccagtgtgtttttctctgtacctatgtggaaaaatgaactgagaagccaagaagaggagatatgtcgggttgtggagatgatccgacctcctctctcgggacccctgccccctcttatataggatgagggggagggttacaagaaaagtatctacaaatctctctattctatatctataaaagatatgcaggatccctaagatttatatcttatctagggaatctctctttctttatttacaagtacgtcgcatgggcctaggacactcgacccaccccatgaggtgcggcccaaagcttatcgttggatacccgggtaccgtgtacctcacaaaggtgttcagggaagttgtgataaaaaaattatttgattacaaacttcactactatgtaaaagattcttccttgcataaaaacaaatttttacatgcgggagggtgacccgtatgtatctgtgaaaataaaaattttgcatgcgtgtagaacaagtgcatgcgaaaatcggttttttaatgctaacgcgtaagcggtctgattgcttaaaggaaaaatcgcaaaaagaaattccaaaaatcaaaaccctaaccctggaatccaaatgacaacgttgccgctgccgtcatcctcatcatcatcgtccttgcatgaaaccgccagcaaatccttgcgcggggggagggggaaggggagggggaggggtcggaggggcggcaggatctatgtgtaagggggagagggcaatgtgccggcaatccccaaccctaggtcgaatgatttcttccgcgctgtgccatcaatgcaataggtttttctttctataattctcgtctggtcgtgtattgctggtctggctgcaccagcaagcgtggacttgttggtcatattttgataaatcgtccaaacgaattactaataatttagtttaaacaatacagtattagttattattaataaatctatctattatataaagtacattaaactttcattaaacttttcagaaacgctcctaaaccaccacgtggcgtcctaaaaaactcttaagccgtcaagtggcactctaaaatataacgaataatttttctttaaattggtggggtcaatatttccaacattaggtctaataaacacctgtccccacctcccctcccagtacgttacctaatttcctccggtaggtttgtacgtactccctttcccaatctctaatttcagtgttaaatttaagtcacatgttttactttttattgttgttatatttataattaaacaatgtccatattgttgattcatattgttctatatatgggccatattctttgcatcgcaacaaaatataaccaggaaatattttaattataaaaagttgacaacatatattatgtcaccttaaataattctacaaacacgtcccaaattatattgatgatatccaatctatctattatatactaaaaatctattatacttcctataaacgctcctaaaccgccacatgccacccatataaacgctctatagcgtcacgtgcggctctaataaattagaataaaatttaggaattctaagaaaaaagaaacaaatagcctttgattttcactaaatataatagactcaccactccaatccattggattacatttttttctctttcttaataataaaaggtgtccctcttcccgtggatgcagggtgtgtgcggtttgcacattggtatgtacctcctctccgtttttctctttacgaatgtttctttaatttctaacagaccaaatttggctattctttataagaaatattttggatactttaaataatcataacatcttttaacttttaattatacgttctatttgtatcattacgttatttatgcatgattaaaatcacaaattaaaatttgatacacctgttgactataattgcacttgtaaaaattgcattcattttattttgaccctttgcaagtcgttcaaacatagtaccacataaagagttgaaataccctagcccgtttaatccatttattctttacaaacactctcaagccaccacatggcactctaaaaaatagagaaattccaagaaattctaagaacaaacaaaatatttatcccatgattttaacttaagtcggtggacccactattttcatccgccagatcaatttaaacaaatccttccacctacaccattgtcccgtaagtagccatggcaaccgatactcctataccgccacgtggcatcctacagacgctcataaaccgccacgtggtactataataaattatataaatttataaaatttctaagaaaaaacaaaatatctatccactgattttcattaagttaggtggacccttattttccaacaataggtttatctaaagaaaaatcctacctaaccccaaaccggggtataccatgggcctgtacgttacatacgtttcttttataggatagtacgtacttccacccatacttccctcgatttcttcatattttttacatatttattatcctattattagagtttgaaaaaaaaatttttttattaaataattcagcaattataacacctaaatcaaacaactaatatttatccgcttatatctttaaaattatttatgattaaatcttcagctaaagaccaaatttccacaataatttaactttgaggaaaagatgtcattttggattataattttagacttttgcatgccattcaataaattgtaaaaatatgaaataataacaatattatacacttcataataattaaatgatatctacaatcataaacgtaaaataaaaataactatgagtaatgttcccaaaatatttagttagaaagcaagagttatgctaaaaaataagcagctataccataaatcatgggatcccctaaatcatacaagtaatatttttcttatgtcttttgattattttacatttaaagacccatatttggggttatattttctgacttttgcatgtcattcaaacaattataaaattatgaaaaataatgatatatgttttatcattgtatataagttcacaataaagtaatgacaaaagtaaagtaaacctaataacactgactattgttccaaaaaaattacttctcccattcggatagtataataaatcaataataaaattagtagatttgtagtgttcatattttgtcccatttgactttctcttcatctcctctctcactcaactcatctgtcttataatttttaactaattaacaacataatataaaaatgatcaataattggaaagctaaataattatgattcttatgttatatttgatttttagtttatttgaattgttatttatttataattaaataaataattcaagatccatatcactcatatttcactttacaaaaataaagaaatacacaatttgagcatacacacctatcctttgcatgctaaccaaatataaaaaaacagagctttgtaaaaaatgacaataagtattgttgactaaatctcgacaggacccaccacataccatgtcctatacggaaataacctgcgaatataggaggagttccggataaggaaagacaaccagagttctacatggaaacgacaagaactactcggattgtatccatattggtttccctagttatacttggacaagaggacacctatgggtataaatataaggccccctctaggaggaggggagacaatcaacagagacaatcaacaccctccacaatctacggaacaacagaagccaacatacgccaagacaagacgccggatatcgacttcagggataggcacggctagtcccctacggtgtctctggatattgataggaaagacattgcgctgtctctgatctcgccgggcacgaactcgaggaggaaggctaccctgttgttgactacgagtcagaccttcagaccgtcatgtcgacaacagttagataggctaccccaaatattgtactggtgtgattatggtgaataagagcaatatcggcttcggccaacaggatgtagggttattatctgacaattcaggggcccgaacctgtataaaaatcatcgtctccgtctcttttacctcagtctcgcgtataccctagcaccaacgatccccatactatgcaaatactggaatcgcgacatcaaacgtcgacagtggcgcaccaggtagggggattttggtgcttcaggatttcgacgagatgggtttaagagatggactctccgacaacaagctactcgacgactttagctgtggggagatccaacctgtctaagtacatctcccgacgagatcggaaccatcgtcatcaacaattcgatctctcgagatcgaccaagcctcaagatacgcgacgtaccaaaagatgtcagatcgcatgatatcgaacgagtacgtgacaaggtaattgatagattggttttttaaattgatctactaatttcatagatacatccggcatgtatctacaaaggtacacaatattttatctgcaatttatcatacctattcagatcatacagcattgtcagatctataatttattatgtttaattacctaaagcatgttttttatacaatatatattgtgcaagtgtccccgatgttaaatcgacaacggtttaatgctgggggctcgctctattttcctatgtatatatcatgcttatttacggtttacataatgccctgatatttaatctgctcgttatatcctgataatgctagaagatccatgcagttttttgagtacatactcgatattatctgctatatatcttgtcttctagaaaatattttgcaggaacaattgagcactcgagtaggttgtggtcaagtacaccgcattatcgaggacgatctcgacaaatgcagagtcgtcgtgcccaacctaccaacgaagaccgatgacctatctcatagcaccggccatggctggactatttgagaaaaagttgttaacggataattccttgtgaacgttgtcggtttgatcacccgacatgattgcgaacggacatccggatatgctactagttgggtgtgtgagtcatgctggccacatgagatgcacatgtaataaaccaactctaacgcttccattggtgcaacctcagatggtcgaggtatgactacagcaataacgcagcggtcctcgtactacgacttcaaatgatcgagagatacctactcactgttctcaactagtcaatcgtagcgatctctcgtacatttacttctagtggttgagttacgactactacctggttcttgaccagaggtgtagcgattctcccattacctctacttcaacaaagttgatatcaggtgccagtatcgccaagtgttttacccagagatcccttaccacaaagacacctagcgttgaaacctatcctaatgtccctttacgtcgtcctgacaaggctccgaggaacctaagggaactttggttggggacgcccagagcggataaggccttgtcggattcttcagagacgaaagaccatgtaagatctagtcgtgtaagagttctcgccgtgcgtattaaccaagccgtgtaatcggaaatagattttccaacttcatggctgggggctaggatcagtgcttgttcaaccgaggcaggtcaaaggtccaagagcctcattatccgagaacgattctccgatgacaaggctgggggctagggagagtgtataacttaacaaactgactgatcgaagtcggtagacgctcatatacaaaacattggaaaattctattcgacattatcgaagactccatgtctctatggttctacaccaagattgactaaggcgagtacgacaaatgttgacaaggctccgtcgcagactctacgcctactcgattactcgagaacggttggtggatctcgacaaggagtacggaatgaagagatggtgtacccgccgagataaaatttcttgacttcaatccaaattctcgattacagcaagacgggagacttagtcgtatgctctctactttcttagttgacatcagagattgactcagacaaaccctttaggtgcccgcacgaggttgataaaggaagtctaacgttatctctgaactcatcgagaacggtcacatgagctcgataacagttactccaaagtctgcgcgtggttgagaatatgaattcgttcatttgcattgaagtcgggggctactgtcaggattatggataccacatacctaatagtagttgactaaatctcggcaggacccaccacataccatgtcctatacggaaataacctgcgaatataggaggagttccggataaggaaagacaaccagagttctacatgtaaactacaaggactactcggattgtatccatattggtttccctaattttacttagacaaggggacacctatgggtataaatataaggccccctaggagggggagacgatcaacatagacaatcaacacccaccacaatctacagaacaacagaagccaacatacgtcaagacaagacgccggatatcgacttcagggataggcacggctagtcccctacggtgtctccggatactgataggagagacattgcgctgtctctgatctcgccgggcacgaactcgaggaggaaggctaccctgttgtcgactacgagtcagaccttcagaccgctatgtcgacaacagttagataggctaccccaaatattgtactggtgtgattatggtgaataagagcaataccggcttcggccaacaggatatagggttattacctgacaattcaggggcccgaacctgtataaaaatcatcgtctccgtctcttttacctcagtctcgcgtataccctagcaccaacgatccccatactatgcaaataccggaatcgcgacatcaaacgtcgacaagtattatatcacctcaaatcaatgtacatcttctgtagcacacttaaggcatcacgtgttatgtcttaattaaaaataaaaccttacaaattgtaagaaaagacatgtgaccatcaatttgtacttaataggtggatccattatttttaaccaatatatataattttagagaaaatcttaagctgtcatgtgctacatcttaaaatttagaaaaaaaggatattagaaattttgataaaagaaacaggatcatcgattttcacttaaatcattttgaacaaaacaccccctccacttcgccctcctctcacatgggcacaacagaacactagccgtcccctcccctctcagcttgtatgaatctgaaccaacaaaaaagagaactaacttgatggtacaaataaggaaagcatgtttactaataataatagttatttaggatttgttaaaaaaggctaccaaacattcaattaaacaagacaaaacattttactttttagtttacgtttaattatttgtccgacaagtttccaaacaatctaaatatttacttttgaaacatggttggtatttatacagatgatagataactatttatacgaatgaattaaatatatattttttaaaagctaacaaatagtttagaaaaattatgtagaaatagtacttttgaaacatggcagttatcatcctgttgatatttcgcccatctaaatttttcaaacgcatcctgaaatacatgcccgcgcaatacgcgggttcccttactagttaatgaaaaattagaaaattgccgttgatttatagactaatataaaaagcacgagttgttaggtgcaattaataccgcgattacaattagcgccggattaaccctgcaattagcgcttctcaatccctctcctcgccaaaaaaaaaaaaaagtcacccagaaccgccgctgcgcctcctcctccttccgccgccgctgagccgctcttgctcctctatcgctgcgccgctcctgctggcccgcatcaccgacgcgcccatccacacccacacctcgccagtgctgacacccctgcgacattgccgccgccccccgcgatttgccgttattcccctagatcgggtgttgccacatcgccgtccacgcctgcggttcctcccctctccccttccgtgatctccctctccacacccacggttcctccgctctccccttccgcaatctccctctccacgcccgcggttcttctgctctccccttcagacgccatagccgatctcctcacggccgttgccatcgcgaccaccatcgattcctgaccgccaattcggggtcacggtgaccgagcccccgccgatcgtcccatcacgccaccccttcgccactcactgccaggtcgtcatccatcgttcctcctctactcacgatccccaacatggtccatcagaatcgtttgtgctctccgctctctccaaggtgagtcatggaaatcttctcttgtatcaatttcataccgttatgtatctcatctctcaaacgatgaacttttgttcatctcacgatgatgaacagtatggtcacgaacagttatgtacctcatatctcaatggatgaaattttaatgccaataaaatatacagatcgataaaaaaaatgccaattagtaaatagaatgctgcatactgaaattttgcactcgatatataattgaagaatcacatgattttaacaaaatacactggagttgagggatagttcaaagcatgtcatttgagagatgaggtaattgactgaaagccggtagcaaatatcatatacttgttttagtggataggtagatggataattgttgggtgcgggtttattctccactgtatttgtttttctgaatttggcatcgtcttctatatgaattttatatccttggacagcaatgtttctaaatttttttaaaggggaccatgtgtctgaaattgaacatctggagaaaggttctgtcattgcttatttgccagccttctagcaagagttttgctgcgagttattgcatgacataacggcagcttgcagtatgaattggaacacacaaagtcagaataaaacaatcaaactttatgctcatgattatattcccatttgtagatactatattcccattggatgtgggtaagatgggattcattttttggtccattttttaccattgaatggtgagcagtacttccttgttgattcctgactcccatctgaacacagaggacttggagctgctacattacgttgacagcgactatgctttcacctcccgccttcgtcacggctacttagcaggaaggtcttcccatggtgctcgatcacatcgccgcctccgcgcacttgctctttccccgacggtcgatgctggcaccgtgccgctccacctcaggcagagaagattagatcgcctccacggctccgccattccgaatccggccagttctgcaaatgaggctgctgacatcatcgatccgccatctcgcacagcttgatgggcatcatcgctcgcctttgcctcatgacctttccgttgccaactatcgaagctgcctaaatttactagcaggttaataaattcatctgggtttctttgctaatcatctttacctaatatatattggatctaattctttgttgctttggttatattattgtattttcaggtcatcggttgaaaccatccatgtgctgaataggtctcaagataggagcaagttccgcaagacgtgcattggacacagccgtcgcatcgctcctctgcagcagatccacgcaccggccaccgccttcacaacatgatttggaggtggagaagcttggtgtgccctcgacgagttcttccacaaatttactaccctcgatgatggcccaggccgcggcggctttgtcggcttcttcgacaacactaatgtctaccttgccaacaatatgtgagttaatttcttcctctctgctttctgaaatacttttcaatgtgaacactagcaatgtgaatcatctgatattaagaaggtcattactttcagaaatacttctataaaagtttgtgtgcatggattgttctaaatgttttgttttgtagatatatacaattttcatcaatacaaattgttagttagctcatatgctccttgttgatgcaaattttgtcatgtaagtactgtattcatggttgttggatgtaggtatcaattaaaccatattctttattatcaacgtataaccaatttaagctcaattttatggtttgctgccgttggtatagaatatgcactgtttaattaaatatataagtcaaagctgttatctatcagtttgtatgtttctattaatgatattttgatgcaatggataggatggctgttacggaatgtagcgaattcttgatgaaatgtactttctaatattaattgatcaaatttgagtatggaggccctttgcttgtcgactaagtgacaacgtcatggctagggatgcactggtgtttttatatttggatctcaagccctcgtatctggttctccagctgaatgtgttgatgcgatgactgcagcttaccaatggatgactctgtcatcttttcgctggcttgaagaactctgcagagaagcagaggtaggatatgttgacatcaggtgcttaactgaaacccgaatagaatccatttattttgacttcaaactgatgttcagatctgacatttggtgcacaacatgcagttgggggttttgacgtttcttaagtttttttcattgaacttgatcagccaaataagctattttagacgtgattcatgacctgttagtctgaagcgaaagcagaatcagattcaagaaatgcagatgtagaactatccaatcatatcgatcgagcacaatcttgtcatgccattgccagacatccattcttgcacaaagcaaactccactcaagattgttagataatgcatgtacatcaaaataaagatatatgcttttctctgctgaactgcatattctggatcaatcatccatggtcatccatactcaaaaattttgttggtatatcagtcatggaaattacattttattttttcttccttttcacctaaactcacagtctgcatatattttatacggtcccttcttaatgtttggggcttagctattagtatttacaaattcatacatgtgagtgttacctcaatatgtattatctgatctatacaagttcatactgaactggtattatacaatgtacacaaactatttgattctataatggacttagtagatatgtacttacaaaatccaagttattgtctgaacatgcacttgaaatatatttaaattcagtgtggaaacatgctctagaaatatttctaacttaagtgtgtgaacagacttttgcaagtgttgttttctcccaaggtgccttgcacgtgcacgattactagtttattaaaaggactgggctcgtatagccaatcttacaggacaaccccttttgggtggaagcagatcctctgacatgcagttgagtcactgatatgtgggtcctactttgctatggcccacacgtcagtgactcaactgcacagcagttaagtcacagaatctctttcccttttgggtacagagaacatacataaaagtcctgaatttagcaaacgactatagaaaatctgtacacttaacatcaccgctcctaccactaacatgtgggtcccacaatctatagtgttacaccacattttagcgagtacttccctatttccctattgactcactccaaatttcaaaatcacctacttgttcaataagaaaaatcatattattacttagactaaataagtgttttattaattgatttaataagctagaaactcaatttattttccattgcaacgtacgggctctaggctagtacaagaaaagcaatcaagtcctccatgcatgccttgctggatctgtcgtcaaagatgacttgattgcccatagcaaagctgcaccagattttgccttggctcaatccctcaacgaggttttggctttggcaaacctgatggaactcagccttaccacagaaatacactgtcagagtctcagagataaaaagagaaagcaacacacctggatcagcctaggagctgagccatagctggggcctccaaacattggaggtagaagcttcattactgcagttttttcaacgtagaagcgtgctatggttgccacctttaattcttgcatgccggagagggacaatatggtcggcgttaccaacccttgatccgatctgactatgacccaattgacgatagcagcaagaaaggtagagacatggtgagcaaactccggcaaaaccaccggaggcagtcgcgatggcgctatgatgaggacgactagcgtcgactacaacctcgagcaccaaaggaaactctcaactacaagaaaatttgacacacaggacaagtccgacgacggatctacaaagaaaaggagcccccaacctctcttcccccatcgccggcggcgaaccaccggagacgaggagggatcggagagggttctgagaggagaaggagaaaggagttatcgttgggatcaacatatcacttcctcgagaagatttttgtttaaaaaattatgtacatggctactggctacctttgctgtcttgcagatcgaattgtcacataaacgccacgtcaatgccacgtcaaatgaagaccgagtcaaattagcaacgtaggcgtcacgtcagtaaaaaccgccgagggacctcatttacactggttttaacaattgagagacgcgttgtatctggttttctggttgaaggacgaaaatcggattcgtcgacaagtttacagatctcagatgaacttattccattcacgaacggacgaacctcctagcagatcggccgagtcatgaaatggtaccaaagggcccagtggcgacgctgggctgggctatcaatcttttctgtcctctacctgcaaagcgtttgttaaatgcttaatatctttttacagacgcatatgcttccatatacagaaaaacacacactaattaatatacctatgcacgctctacctgtggaaactcaatatacacatgtacgctctacctatagaaactcctccaagagattaatccgggatattttgagattaataaagtcatcggagatgtttcattatcgatggctacgtcggcaaacacggaaagaatgaaaaatgattagttgtacatgaaagcatcagtgttaaatctagtacttaaatttaagcacataagtttcaatataagaaatctaaccggtttagtttaatatgcatgtttgcacagtccggcttacgaacactaaataattaattaattacaattgaaaaataatcgaatacatagattgccccaaatctgacagcgcttaaatgtgttaatagtaaccatccttttttaagcctctacttaggataaaaattcctctgtttagaccctccttaaaacactagcacaatcacaaaactaattaatggtagagtccgttttaactcattgaacgtcgcttaaattccatttttcaccataaactacaaagccgttttttatacaagagtaaaaaaaatggactttgcttaaattacataaagaaatggactttgacataacggcattagagggttattatgctacacgcatcgcacatacgtgcacgctagagggtctcaaaaaatatgttatgccaccatctttgcttttattcctgggagaaacatcatgcaggtgtggttattttgtatgagacattacatgaattgcatcgtacaaatatgagtggagtaatttttaacattgattttgagaaagcatatgataagataaaatggtcatttgttcaacagactttgaggatgaagggtttctctcccaaatggtgtgagtggatatcctcttttatccaagggggacatgctggtattaaagctaaggatcaaattggtgacaactttcaaacacataaaggtcttagacaaggggatcctttatcaccaattctctttaacatagtagctgatatgttagctttgctaattaaaagggctaaagatagtgattttcttaatggggtaatccctcatttagtatatgatggtttgtctatgttgcaatatgcagatgatactatcattttcttggagcaagatttacaacaagcaaagaatctaaaattgatcttatttgtgtttgagaatttatctggcttgaaaattaactttcataaaattgagttattttgttttggccaggcaaatgagtgttatgatcgatattctagtatttttcgttgtaagctggggttttttctttttaaatatcttgggatttcaatgcattttaggaagttgagtaacaaagattggaaagtattgagcaaagaattgagaaaaaaaacttagtagttggaaaggtaaacttttgtctgtcgggggtagattggttttgatcaattcagtcctttcaagtttagctatgtttataatatcattcttttagataccgaaaggggttcttcaaaagattaattattttagatcacgtttcttttggcaaggggatgatcataagaaaaaagtaaagattaactagatgagatataatttgtcaacccaaagaccagggcgatttgggtgttcataatttagagattcaaaagaaatgtctcttgagtaaatggttatacaagttaattaatgagaatggtgtttggcaagatttattgaagagaaagtatctttataataagtctata

SEQ ID NO: 48473 - DNA, 3073 bp, Oryza sativa
gctaaagggagttgtgttaactaaacataatctagcaagatggaattttaatgggagtaaacatgcactttctgtatgaaaaatgagactattcatcatttgttcatagattgtcattatgcgaagtttattcggagagctgttcagttttcttttggattataccttcctagaagcatatctgatattttttatggttggctttgggggtggacaagaaaaagagtaaactgatacttgttggtgcctctgctttatgttgggctctgtgtttgagtaggaatgatagagtttttgataaatcatcatctgtttcctatatgcaggtaattttcagagcaacatattggcttcggctgtgggctcaactgcaaaagtgtgaggaagatggagagttcttgaatgttgcatgtcgtaatcttgagacgacggttatgcaacttttcgccaaccatggctagagattcaccaacagactcgagtagttctctttgtcttgtttgcttttcttttattcgtggttggtatatttgctttattttggactaagctcttttagtgtgctactcttgtaataatgggatgtagctcttttgagcaaaggccgggatgtttcattccattatcttaaaaaaaaaatcttgccagatttttttgagcaactttcactatcaaacatgaattctaaatgaaaaggggcacttttccattctcagatatacttatcaccatttctttttacaaaaaaagatacttaccagctaccaccacactatatatttgcatccaaactttatagctaaattttattaatgaggttacgaatattttaaatataattgttgaagtctgttgcacgatatagcggtatagctatatacacaaaccttacttaggccccgttcggtagtgctccaaactccaactccagtgggagctgtgttgacggtccttaaatcataatatatgaccgtcagtacttgcatataatgaaataaaacatggtatccaacttagtggtaggtattattactaatcatttccactagtgttggtgaaatatgtgtatgcaggtaatttgaggtgaaaacacatccgtgatatgacaaaatgcacctctgcatatccaggacacgtttacacggattagaggctccataagccaataaaaaccatttagaattgggccaaaacatagtgcaggttattgggggcccattaagcaacctaccggccaaaggagaggccgggaggacactttttgggttcggccaaacccgttatgcggccgttcaccgtctgcttccacgtggatggcttggattcctcctctatggcggttgcagggtgttttggtcatttcccatacccctaaccatcatttggagcttatataaggaggtcttcactcttattccaagacacacaactttgagttgaattacaagaggctctattgtatcttttgtacattagaataaggtagagagtggggagaagcaccggaggagtgcccggaagtttggcgctcatccgacttctacctcaacgagtgtagcttcctaggaggaattctggaggagtaccggagctgtcggtacactctgctccgggttcggagaacttcttctataaagtaagcattcgtgttcctttcttatgttattaattatttagtctgagtaagatatatttccatctttgcgggttcattgtttagtattcatactaagtgctctagtactaggactctggatagagaaggaagttcttgtgcaagtattagagtagtaattaataacttagacgtgttgtctaggttagagattacctttgtttgttgtgtatcccatggatttgtcagatgtaggcggcaggtggtgacagccttgaatcccgtccaagtaattctccacgttcggatacatcatagagctatagccgaaacaatgctagcagactagcaggggtcggcgcccgaagcaacagataggaaattacctttgcttagcttagataattaggtagattacacacgttccctgagttcgatatccttttggggtcacccgaaggtgaagtgctacagcggtattccgtgcgcttgcggatttatctatgatcgtaagaaataccaacaagcatttctggcgccgttgccggggaacggttgctaatttatccgagtctaggtcatactcgtatctttatttttatttcttcttctcttattcctttccttgatggagcaacccgcaattcaaaacctttctgctcctcgggctgatctttgtgagccgtcctgttcttcaaaaccaatcctttctgatggctacgaaatcagtcctggccttatagccatcattcgagatcaaaccttctctggtagtgttggtgaaaacccgtacctccatcttcgggactttgagctagtgtgttcatgtctatccatcgtaggcatgacacatgaaactctaaagtggaagttgtttcctttttctcttagagatgaagcgaaacaatggtacactttgtctgtcaagaaattccacggtaaatgggaggagcttaagtgtagattctgccttgctttctttccattaacccgtgtaatcaatcttcgattagacatcctttcgttctgacagaacgagaaggaatctctcggtgcagcttgggccaggttttcactgttaactcagtctggcccagacttgtctctacccgatcatgtgttgttacaacattttcgatacgggttagataaggagtctgccgcaaatctcgatatttcccccggaggatcgttcgcacacaagacaactgccgaaggaagagaactcttagatttgatcttagagaacgattctttcggccaaagcgaagccatcccggagatcgagattatccatgaggatcctctgcacatggagtcgaaacccgactcaactgtcgaatcctcattccagtcgctggagccggaggaagaagaaattcattccccggaaattccattccaattcaggggtgatctttatgaaaattatgagaataccctgaattattccagcga

SEQ ID NO: 48474 - DNA, 16807 bp, Oryza sativa
  unsure (1)..(16807): unsure at all n locations
atcatggtaagtttctttaataataaaagcaagaaccagttcttaggataatatgcaccttcgggtattcttggtcactaatcatttcagattgagattaagaacgagggtcatgcaatgcctaagaacacggtagctacatcaactgtacactttggtgatccttggtattggaacacactctataggagaatccgacatcacacacttggttttgatgtcttgcgacacaaaagtccaagtgtgggggggaaggtcgacgagcttttcatgacgagttccatcaactagggccatcttagtttgaagttggtgttagtcctagcttgctaaaaaaagataataaaacaaaggaggagaaaagagagacagaagaaaagaagaagaaaaaatgggagaagaagaaaagagcaagagagctgacgagctgcatttggatcaaagaccgcattatgtgcgtgtctttgaaatatggcgatacacctcgctagtagcaatcatgctgcctactcccagtccctctctcaagctcatgtgccaccttggtttagactttatccactcctagctagctgtgcacaacttctcgctcccgcaacacctacacgcatgtaggcaagaggagatgccctcttcttttctaggtgtttgctgctccactctagttggcacttgcatatttgcccagaaatagatgcatcctacgtctctgtgccaacgaatcacgccttcaaggcataaggttcttgcacccgaggtgtgtgcatgaccaaactgcttgcctgagttggtatggtcaaagcgccttcctccggtacaatctgcattgaggtggaggagaaatcaacaatcatatgtggccataccaccgctccagagatttcaacatacacatcatgttggcagtaagtgcactcaggtatacgaaaggcagaaaaattcaccacatcttttactcatacttatctctctttgaatgagacttgagtatacatggttatgtttcttatgtctttttgcgtatgctctgttttgggtgttttcgcgagacatccataggctttttaaattaagcatggtgcttaggttaaactagtctactttaatcaaattagacatggagtcgagtttgattaatgaactctcatagttaatttgttcatagacattggatatatatcttctgtggactaacccctgcaggaaagttttcaaattgatgggtgagtcctcaagttcaattcacaatagaggtaggtcagggccgggaacaaatcaattgctaacatgcaaaggagacacatatcacctatcaaggtgcacggtgcgtatattactaattgctcatttagcatgatcatgcaaatttacctcagccatgtatgagttgtgcttaaatgaaaatttggtgaataataaaaatttgaaaaaaaaatgtttcagaataaaaggactgtctctcaaaataaaataaaatcttggcaaacttgtgggatccatgcttcttaagttttaaatctaatttcattttagcatggatatgaacaattaatcttgaggctatgataaaatctttgtagtgcttcgagtattttttttttgtccactaaccttttgcaggaaataaaatgacaatcaaggagcagtgtacaataacttcaaacacttatatcacgctcctttgtccatgggaaagagatgcacatggaaccaagcagaacatatgaaaaacagtttgcattcaattgaggttcaaagcttggtaagacctatctgataagaatcctcaacaacttgtgcatcctcatcccatgttttcatcctgccaaatccatcgttgccataaaaaaagaaaatacaagaaaataaaacaaaataaataaatgtggctccttggtcttccaaccaagtgagtcctttttgcttcactcgtctttgtttttcttttttgtgtccaataaagagccccaggtacaaagacatgtgtgggggtgatcttgcacatcaacgccgaaaccaaagcaagatcaccctaggagtgatcagccatgacgaaccacacaaggggaattgatgcagtcagaaccaatgaggggacagtcgaacctccagttcaactgaaccacctctatcatgaatcgttctctgttttatacagggctcaggtttgcacaatttcctcgggacatccattctatcttgagtttaatttgattatcaattctaaaatatcgaagataattaaactcaagctagggatggtacaattagagttcatggtctccctgaaaataacatgcatgcctattattctttgctcattacttgtttcttgtagtgacaaatccaatagggatcccatgctatcaaggtaattgatgaatgtgatatagtctgatgatagaaatcttgctcttcatgttgtacacttgggaattttataaaaagaaaaaaaaacatataatgatgctaaattcctcattgatctttttattcctattagagccataggttgatcattcatgattagcttgctacatacgctgcttgtcatttcataaagcgttgtcaagttttgtgaccctagtgaaatgcttttcatactttcatggtcaagatcacacacaccccacatacacgcacatatgcttgacttatacactggaagttagcattcctcatttgtcattcatttcatccatagtccacaaaataaatactccatgtcatttgtgcctcttcctccaaagttctttaaaaaaaagagagagagagaggggcatggctatgaaaaaaaagtgctcatacaagtatggagcatgatgatgagaaaaaaaaaagaaaaaaaaagatagccatgcactctcccaaatttcaaaagagaaaataaatggaggaggaggcatacaaaaggagttattttcattttcctttttccactcacaaatttaccatacacatacacatgcacattcttgaccagaaagtatgtcttgtatttccgtggatccattattttactttgcaatatatgtgatgcaagcaatgctctactcttttccataccctgaactccacataagccttattagatggtaggaaaagaaaaggcacaatcatatgcctttgtgaggaatcatacactttgagtgatcgagagaatcaatggaggagcaaagcaaagttataatattcgtcttacttgaaaaaaaccccaagttgttcttcctgaaaagttagggtgacttgaatcaagattgttccatttctcaattgcccaggactgcatggtagacactacaaagatccacaagtacaggtatgactttgaataatttgtttgcatgattgttagtaaggaagtcataactctattgtagagtccatagccttcactcgggatgagcaaaggttaagtgtgggggtgttgttgacggtccttaaatcataatatctgaccgtcaatacctgcatatatataatgaaataaaacatggtatccaacttagtggtaggtattattactaatcattaccactagtgttggtgcaatatgtgtatgcaggtaatttgaggtgaaaacacatccgtcatacgacaaaatgcacctctgcacatccaagacacgtttacacggattagaggccccataagtcaataaaaaccatttagaattgggccaaaacatagtgcaggttattagaggcccattaagcaacctaccagccaaaggagaggccgggaggacactttttgggttcggccgaaccaaccagttcggccaaacccgttatgcgacctttcaccgtctgcttccacgtggacggcttggattcctcccctatggcagttgcagggtgttttggtcatttcccatacccctaaccgtcatttggagcctatataaggaggtctgcactttcattccaagacacacaactttgagctgaattacaagaggctctattgtatcttttgtacattagaataaggtagagagtgaggggaagctctggaggagtgcccggaagtttagcgctcatccgacttctacctcaacgagtgtagcttcctaggaggaattctggaggagtaccggagctgtcggtacactctgctctaggttcggagaacttctataaagtaagcattcgtgttcctttcttatgttatttaattatttagtctgagtaagatatatttccatctttgcgggttcattgtttagtattcatactaagtgctctcgtactaggactccggatagagaaggaagttcctgcgcaaatattagagtagtaattaataacttagacatggtgtctaggttagagatacctttgtttgttgtgtatcccacagatttgtcagaggtaggcggcaggtggtgacagccctgaatcccgtccaagtaatcctaatcctccacgttcggatacatcatagagctatagccgaaacaatgctagcagactagcaggggtcggcacccgaagcaacaaataggaaattacctttgcttagcttagataattaaaactcatagaaaatcctctctaacctagcctacctaccatcagttgaaaaattacctttgcttagtttagataattaaaactcatagaaagtcatctctagcctagcctacctaccatcagttgttgtccttggatagtcttagccttaggtagattacacacgttccctgagttcgatatcttttttgggtcacccgaaggtgaagtgctacagcggtattctgtgcgcttgcggatttatctgtgatcgtaagaaataccaacagctggatccaatagaagctgaggttggtgtcaaagtgtttggctagatttgtcagctccacgccacgacctcccttatcgacattttatcgaacaccttgtggcgcccctgccgcacgcacgccgccaccggtccttccacacgccgccgacgtcgctccgcactcgcgccgcagccggtcagccggcacacctccgacgtcgtgccgcctgtgacctcgcgcgccgccgcccgggccgccgccgcctgggccgccgccgcctgcgacctcgcgcgccgccgccacctgtgaccctgtgcgtccccgtcaccgcgacctgctggctgctgccgccgtgtgccgcttcaccactctgacgcgcgcccgcggacgccgccaccatagccctccgccggtcgccgcgtcgggaggaagacggaggaagagagagtggtcgggaggaagatgtggaagagagagaacgagggagaggtgtgtagaggggtagttcagtggtattttgtgtaaatacattgaaaaattaaagtgttgtgggtcttttggggtgtagtcgagttgtggagcagcacaaacctagctccacccccgtagtacaaatttatggagcaactctgctagctccactctgaaaaataaagaatatgtaccatttggcacagctccaattctaggtaagttggagttgggagctggagctgtgccaaacggggccttagacagtgttcagtttccttcaaacttctaaaaattccgacacatcaaaagtttggacatatacatggagcattaaatgtggacgaaaaaaattaattgcacagtttacatgtaaattgcgagacgaatcttttgagcctaattataccatgatttgacaatgtgatgctactgtaaacatttgctaataacggattaattaggcttaataaaatcgtctcgcagtttacaggcggaatctgtaatttgtttttgttattagtctatgtttaatacttcaaatgtgtgtccgtatatttaaaaaaattggcacacaaactaaacacggcattatacgagggtcaaagttaccaatggtcaaagttttaaaaaaagtcaactctgtcaaaattacacgatgacggacagacagatatcaacttttgagcatccatgcacttttccctgactgtacatgtgtgtagacctgctgttcctatgcaagctaggacacgcatgcacaggccaagtttgcattcagcaagctgcttctatgtgaacaacaacatgcatgattggtctgaccttacgtcgacagtagatatagcctacaataatcatgtaccgcaaggtacaccaataattccagcaataatctcttttactcatcctatttatgcaaaaatactacgaccatcctaaggccagccacctttatagggtactggttctacaatatatatagggtgtccttaatagatccaacaaacagctttgcatttttcagaacttattgtatgccatattctagttaccagtgcaatacaataaaggttgaaaaattatggttgaaaattcaaattttgactgataaatataagcataagcgaaaagatgaggccgcaagatatcactacgtataaaatacaaattgacagcatttttaatgtcaaagaagagagaggatagattttatagaggcattaaattgcactaataccatggcgaaccattgtgaaagagagaacacaaatagggttccaccaatcctccaacttaagaccacacggaaaaatcattctaactttctctgcacttaacatctcaacatcatctccatcttatttatacgtgccttgtgttacttatataagctcggtgtagattatctacgagactacaattagggcatgtaggcgccccaacgagggtttattcatgcgcacgtgtgacagggagttgtcaagtgtgcaaaattcacaaaactacaaacattttatcaaaaataatacttaagtgtaattctaacttaatatccacaaaactacaacaataacaaacaatttttgttatgaaagcagatgcacaatggagacacattttttatgtgaaaaatccttacaaaaaacaagggcatgtcaaccttaaaaaaacaagggcatatcaaccggcaatgattaatatagagaagataattacaatgcatgggatacaatggaccattgtaacctcccatgcggcgccggctcttgcaaaagatatataaagaggaaaaaatagtaatgctagtaggtaaagaactattacattctaaaatacggatcatatatttaatgattttaatataaaactgtaactttgccctctttttatgattgatatgtggactcaatcaatcaaatggataacattatagttcctaataaaattgacatgattttgtaattggagccttggaagcggcacaactcgtgcaaaatgcagattagcaacaggtgtcgtaaaagcccaacaccactgataatgtttgcaggaggagcatgctgagctgctgcccagggccagcagtgtccagtgtcagcgggaacagagagctcactcacttctgaggctgagagagagagagaggatgggcctggatgatgataaagaaaaagccttcaattgcaacagagaggtgcttccgaaaaggaggacacacagtgatgcacaaaagattagggaggatgaagaaccaaagcttggtcccttccttgtacccttttgctgcccttgaattattgcaactgtgagacatgcagagctgaggggatgcaaggagcaatgagaagtgacagcaaatgctgccttcagagttttgttctactagcaaacaatgccattttgccactccctctgtgtttcagataattgtcactgccattgtgttaagactgtaagaattcaggatgaacccagatattgtaactcaaaagtgatcaacatggtgttgccacgatgataattttcaataaccaaaaaaaataaagcctaactcagtactggttatcttcgtacgttccaattggcttcactattagtatattagtaatagtatatgatgcttttgtacgaatttggtattacatgcaattgtactatattcttagaatcggttttcaaggatatacttttttatctaaagtaaaaaaaaacttattggctttgtttgatggtatagtccggtgatataaaacatttgaactatataaaaacaaagtgatcaatcaggagcgcatttgctatttgagaagtcgggtcaaaaatatgtggattttcatttaggatgttaaaaatctttgcgttgaaatggcactgaatctgcataaatcatatgagcaagattggccattcttgttttcagaatttatatatgtatatatatcagttgagcacagaaagcaaagaaagaaatgatgcatagcctgccttttgcctccttgaaatctgaactagacaccaaagccttacccatagtccctcccatggagaaatttacacaaagctaacaaaagtaacacacacccaattaagctttattacattgagcatgccagagtgacagccctgtaattaccagacccaatctctctgaaaccattgggtacacatatatcatatatctacacaaacttcaaaaaagaaaaagaaaaagaaaaagaaaaagaagaaaaattcgagcaattaaaaaggagcacaaatacagtgagcaatccattgctggttgatgcaacgcattgagtccatggtggattggatggattcatcgccattgctggtgtttcttcttcttcttcttcttcttcttcaacctttggtgcttcgccggatcannacctagacaacgcggccaccctcctcagcaccttggagatcttggccaggctcgcttgccgccgccgccgccgaagctcatcttcctcgtcgagaacttgagagcctggaggcagcagagctgcctcaccgagccttcctcctcgtcgccgtcgtcgtcgtcgtcttcctcgtcggcggtcgcgtgttcttgcttgcgttcgacggtggctcgttcttgcttgcgtttcgccttgctggcgccgcccttggtggaggtggcgccgccgccgccgccgccgacctcgtaggcctcccagagcatgtccatgttgtcgctggacgactcgacgacggcgcggtcgcggcggagcttgagctgcatccgttcctcgtagagcttgcacgccaacgtccgcttccactccttctccttccgcggcgacccctcgccgacgacgaggaggtgctccgacgacgtccgcgagtgcacccgccgcgcgatcgacgtcgacggccggaggggatcctcccttggagattcttggtccgccgcgtccttgaactcctcctcctgatcatcgtgcgattcttgcagtcgcatctcgtgctcctgcgattcttcttcttcttcaggttgcacgccattgtccaatcttgctcttgtaactgttcttcaggttgtgcatcattttcagaatcttgttcttgctgttcttcttcttcttcaggttgcagaaatttgtactcctgatcctgcaatctttgacaggttccacatctttgtactcctgatcttgcatttctggctcaggaagaacaattttgaggttctcttcttgccattcttcttcagactgaaccaccactacgcctcttcagattgctggtccttgctgcatttctcagtgcaggtttcagcttcagattgcacgcattctttcacatccttgaatacttgttcttcttggtgcatgccagactctgcaacagaagcaatttcttcaacttcgcatttttcagtgtaagctccaccatccaatttgttgcattccttgaaatccaggaacgaggctttctccaaactgaaatccaccgaattctcctccatttcatcaagaactttcttgaaattgccagaagcctgcgcctcccactgcaagattctccgagaaaccgaagaaagcgatttcgcgggaggctcgcatttcttgatctccactgagacagggtcacactccagtctcttctcctcaacgccatcactgaacccatcgccatctgatgacgaaccaaagctctgtcgctgaatgtcttgcaccgacgtgtcgctcctcgatgaacaattctctgaagaaaaatgcggagcacttagctggtttagatcctcgagaacgaccttcttctcctcgattccgtccttgatctcgtcaagaacctcttgatccatggagatttgggcgtcaatggcggcctgatgccatgggagctcgagctcggtgtggtcgaacagcacggctggcttgtgttctagaatgaggcaagaatcgccggtgtcgcagagctcacccatgatctcgccgacgcggagcacggaggcggcgtcgccggggccgaggacgaaggagcagagctgggcaaggagcgcgacggcgccaccgccagcgccgtccgggtccggcctgagctcggcgcggagcgcgccgacggcaatgccgaaggtccacccgagcgagcacggctccggcggcgagtcccccccgcggcgggcgccggcgcagggggcgacggtgacgaggacggcgaggaggagcgcggtggtggcgaggagcggggagaagaagcaggcgagcgcgaggaggtggcgcgcgaagaagagcgcgtacgcggcgtggagcgggtgggacgcggcgaaggcggccacgccgagcaggtcgtggagcacggacagcgccagccgcagcggcgcgtcgcgttcgaggaggtcgccatcatcaccgccatcgccgccactgtcggcgcactggcgcggcgccaccattgtcgtcttcttcgctcggtggggcgtggcttggcttcgtcggctagtagctgctacctaggcgcggccatgggtgccacggagcttggcctggacgcgcacgcaatcagtggaggcagcatggcgcgttgcggcgtggtgccatgtggtgtcgcacagtggcgatctttggcatggagggggaaagagatgaagaggagtaaaaaagagaggcaaatttgatgatgatgatgagatgagagagagtggctgtgtgcgggtgggttttgtggtgatttggcgggagggtgtggcagtggcacgggttcgcgccatgtgtaattatacggaaatataatactactagtaataataaggattacaaatggttggctccaccatggtttgaatcttttgggattttcggatttaaggttaccccgagtacatgtaagaaattccactgtagccgaaaatctccacattgttcgaatttaacaggaagttgtaaatttcaagaatttgcacgatgtcggatactcactccgttgaaaattatagaggtgtattttgtgttgttacaatctctccggctatagccatttgtaaatggttctagctatttgctctcatgtacaattaagctgctatatctgtttgagaaaactaaccgctaaatgtcttattccgctatttaaaacattgttacgattaggctttgattaataattactttaaatggacataatttttgttgcataaaaataatgtcattatttagaattatttaagattatgttttttataattggtccacgtctcgtccaaacgaaataaaataaattaaatacgtcttattttcatggccggagggattactattttagacatcagagtaactgattttggttttcctttgctcttgttcaggacttcgaggtttgccttcattcagcagtaggaattgcgtagctcaaaggccacgaagctcttgtacgcaatcccttcacgacaagacttcgtcgttcaaaggtcaaaacgttctactcctaccacccatttgaagtccaaattttaaatggtcctttccgtttcgagttccaaaagattgcaaatctttattttcaatgaaataattgcaatttttttctatgtctgctttataacttctgcattggcgcccgaattacagcacttcataagacgagacttatttaattcttgtaaactattttttttttggtctgaagctccatgtgtgaactacaactacaatgaatgctattactgtggaccagtacaaagtacagacactattacgggagtacttttaccaactgagacagacaaatgggcccaactgataagccgccaaaatgtttctgacagttcgtcaaaacgctctaaagcaagatgttttacgtacttatagtaattaatggtatttagtgtttgctagtatcccatggtttcaataaaggtaagtctaatggcgggtgttcgtagaccgcgaacacgttgcgatagcccaatccattagcccctactcctctctctgccttatcttctttacacactgttttctgtggtgacagggacaatgggaatggcgaagatatctctgacgaactccctctgctccttctctcgtgttatccaaacacaaattagcttcgatttcctattcctccaccatcaccgcctggccttgctggcgtcgaaaagcatcaatgtgtcggcacggctctgcctggtcggcctcctcccctacctgttgactcgctttgccccccacgtgcgaccgacccaaggctttggtggcatcgccatcgccattaccaccgcctcgcctcccacccttcctgacaccgactgcctaccacttgtgcgccatctcccatgccatgcttctaagctcgatccaccacttccacctcccagctttcccctcaggccctcccccctccacctccttgaccctaacactaaccctaacttcctatcattatgcggttatgtagtgtttgcaagatgccaatcacgtgcatgtttatgaattaggttttctttagcataagaatatcctagaaaaaaatggaggaattcaatggcgaatattctagggactgtttcaatggatcctttgtagcacatgaattttctcttagttcttacaggattgaactaatccatgtgaaagtcctgcaatttttttttggtaaggtttgtgttcctaaggaggccaagaagatcactcctttctacaaatctataatcttctttgaagcactgccaaatatttattattatcattagtagaaacaatttaaaccattgatttatggctattagtgccagcataaataaactattttactactgttaggtgatatggcagtgtagatagatatgtaccatatatctagaaaataggactaagattgattctactacccattagagactgctaccaaaattgttaattttcttatatttctcatgtaaagcattcagacatattttcagtaatttatacggttcagtttctcttagggcgttcacagtgggaggatgtgtcgttcagccttgttgccgagaaccgaatattcgacgacacgtcagccagccgcggagccaaaactggtcacacgaacttcgctggaatcgaggtatgcggcacggggagaaaggcgggggcgcggcgttgtggaggtcatcgcctcgtcgctccgtggtttcgcgcgctgccatgatgctattcccctccaacgttctcctcctctcggtcaccggcgaggccaccgccccgagcaaaccgcgccgagcccccaaaatggtgccactcgccagatccggtgaacttgaggccggatttggtgagcttgatggggcggcgccagaggaagaggaggcggtggcggcggcacctaacctcgctgttggcgccggaggaagaggaggccagatccgccccgccgagttcctgccatctctcgttcgtagcgccgtcgagctcccgcgtgtcgtccttcgctcgtgtgccgccgagctcccgccatcgctggcgccgcttgggctgcgccgccgccgatacctacagcgctgccgagctcctgtcatcttctgctcgtgcgccgctgcccgttgccggtaccagcgtcgctacgttagcctcgcttcctccgctaggggaaggcgaaaagaggggcgaaaagaaggaaggagagagatggtgggacccctggcggaggcgaaaagaaggaacttgagagagatggtgggacccgcgacaataaacctgcactgcgaagggtgtggctaatagtgttcctaatctaggtggtatttgaggaacagtgaaagtgggtgacgctctgtgaacgctcttagaattcagtatgtcagtttcgacatggcctaaaggtgctattaactcacggaggaaaaaattacagtcaacaaagtcacttaccgcgtgtcattacactgtcaaggtacatcacctgtctgtctgagagagagagtgtgtcacttcaatgtactgccatggtacagtagtagtaacagagacgctccaaaatataaaagcagagaaaaagaaaaaaaaagtcatcagaagctttttgcttggccaaattgttcctcattccaatcctcattcctcaactaccttatgcaagaacaacttggacagaacaacaaagacgaattaacaccaactaatcaagcccataatgctgccataactctgcattaaaatttccctagcattgtcaaaaaggcctagagccgtgcaaccaaaaggcaaaaggttagtggttatagggttacatgttgtcaaatttcatttcccagagatcacggtgatcagtacctgccgatttggagtacacagagtagggtgataattgataaggtcacccgtaatggttatttataggctctctacaagagattcatatcagcatatttttctacttggaagagattaaatgaagagagagaacaaagctatctactaacctggagatagtctatagagaaaaacgagacaatacattagagagttatagatacccatgtagacatactattgaggtggtttactattaatctagtctattgctgagatgtatatattttatagagagcactttaatttatcattgtgggtgctctaagactcttgtttttctgaatttcgtcgctaatcagtagtactcgcttttatagatttgtaccctctgcctctaacctttttgttttccgccaaaaaggtcaatatcaaagcaaataattgaacttagatcagtgaagatttcgagcacatgtcggcaacagttagcgcctcacaatgtgttacacttcgtcgaggtcgggtagttcttttaccctaccgaaatttgataatgttaaaacctttatccatgtatttcttcttcttgtttttttttggtttgtatgtactgtcaccaactcaccataaaccccagatcagatctatgagcaagaaaaaggaaatgtctaaaacagtgtcttcacaatgccaatagcaggaccagcaggcaacttacaaacatatagcaatgctccatttcctgaagagaccaaccaaaatgcatggccgtattgggaagcagttcctccgacgtagagtaaagatggacatgtgtcactgtcacgtgggacccaccctcgtgagcccacacgtcagttggcagaggcacaagtccctctaattatggggccggccgtatggtgtgctacatgtatccgttcccacggcttctcctgcctgtgtgaccactgacgcacacacactgttccctgcagcttcaataatgcaactacagatgcagtgatcctggaggtgtgcctaaccgtagacccaactgacaaatgtctcaataacctgttggttcatttcgggtgtgtttagtttctaaaaaaggttggaagttcgaagaaagttgagagtttaaaaaaatttgtgaaagtttatgtttgtaggaaagtttttatgtgatatgatgtgatgaaaagttaggaatagggggaaactaaacgcatatagttatctcaaaatatagttattgtagtacagtgtgctattttaaaatagagctatttcttttatttacttcttctctcgataaatcataaccattagccatttaattgtttttatctattttttttcttttcaaccaattatattgtttctctaatcatttctacgtattttttttaacatccgtgctcatctaagaatgtttgtattttaggacgtgggtggtagtaggctagtgatgacctgactgttcagctgcatcaccaatcaatcaacaagttcagttatgtgtaatggagacttaaccaacctaatgatttacctgaccaaacagctttgatagtatttgtttactacctacattgttgggtagagatgtcctgatgatgtgtggtcattcagcaactaaaaatcaatactcaggccagttttaaattttttttttccaaaaacatcacatcgaatctttggacacatacatgaagcactaaatatagattaaaaaataataattgcacagtttccatagaaaatcacgagacgaatcttttaaacctaattagcccatgattagccataagtgctacagtaacctacatgtgtaaatgacagattaattagacttaataaattcatctcacggtttccagacgagttatgaaattagttttttcattcgtgtccgaaaaccccttccaacatgtgtaaatgacggattaattatacttaataaattcgtctcgcggtttccaggcgagttatgaaattagttttttcattcgtgtccgaaaaccccttccgatatccggttaaacgtctgatgtgacgtctataagttttctttttgcgaactaaacaaggcctcaggtctctaaacatctcttggtgaattgaaagagaggacaccatcatgggccatctcatttggtgctggcaggtaatataatcttcttgtttctaccacatttattcacatttgaacagtagcagaggagaattgtttctgaatctgaagaaactagcaggactgatacctcagggccacagttctttaagtatttcacctatcaatccagctctccaactt

SEQ ID NO: 48475 - DNA, 15273 bp, Oryza sativa
  unsure (1)..(15273): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccctaagtgaccaagtttaaagaggatgcggcatggcagtttatctattaattaggaatagtttgttagtttccttttatctttaggaaagtgtgtttagtgtccgataaggactttacattttccttttatctttaggttagtttctttcttgtctgacaaggacttgtatcaacccatgggtataaatatgtacacccggggtctatgtaatctatcgctacgatcaatacaatttggcgcatcgccaccttttaccatttctacttttgtttttatgtttcggcgtgacttggcacctgatgcggggctgcatcggtgttcgatctccagctaaggggtaagtccaatgttccgccggcccaggcaattgtatcgtttacgtcggcgtcgttcaaggctgcatcagtacattcgacctcttggattgctctggtttggatgatatattttcctacctatttatcatatgtctctgttaatctagtcttagcatatcaatttagctctatcggctgcttctcgttttagggtttctgccggtatcggctaaatcgcattgctagattagattagcttagacatctaccaccctgaaaactcagtcaacggcttgattgtctagatatcatgtttcttttcatacttagtgttgcatcagttaagtttgatctagtaagtcatgcttagaaccataatctctagcctacttcttgattgccaataagggtttcatcggggtttcagccggtgagttatctggacgttgcatcggctcataaggattgcatatacatataagttgtattgagccgatgacaacaaaggtttcactgtttaatctaatcttgtggatttcatgacatcggacctccagccgatgtgtgatttaaccttcggatcgatgcttatttatcatatcattgctagccgattggtttatattggattatattgttattttattacatcatcatcagccgattgcctttatatcattatccacattgtacatatagccgattgcctaaaccctatcgctatcggctggtatcggcatcagctattatcggctatcggctggaactactccatcggcttgtcagccgattggctgctttgatctactatttgcatatctgcaacttgtcagttgcaggatcaaactgactggcacgcccgcatctcatcatatttggacctgcactggagttaagcagatctccaagccggtgtgttcgattttttcgtcaacactttccctcaatacaacccccccccccaaaaaaaaaactaaatcagatgcaacaatcctaatctgacattgtccctgggcttcactgagcccacggccccgaggcccggaccaaaactagttgatcatctttccgatgtctccaactcagtctgcttgctccttcgcggttgccggagagagacaagcgagcgacgagccaggctaccaccaccagcgccgccgcggcgatggcggtggagatgatctatgatgtgaaaactcgcccatcttccgcttgttcctcacccagaggcggcgcttcgcttcctccaacaataggtaagtgatgcccccccctcccctcattccttcttccagaaccataatcttttgcttccgcaatgccctattgcttcaaaactcaaaaatccttcctgtcatgtcattggaagtattaattttgttttatcaggctgacagttttgcccaaagcaaaatgttactccctctgtttcaaaatatagtaatttatagctatttatctagacaagcatttcagacatatagctaaaaattactatattttgataccaaggtgtagttaactgctaaacggcatgacatttcataactgtatacacaatggtacatttcagatggttagtaaatggcaattgcttttgtgaccgaagagtcttttttaatacagtatgtgataaagatgaatataccgctgacgggttactaggtttgatgacgggggacctttggttatctacgtgttttgagcatcgtacattcttaaaaaaaattaagtttgaaagatactactttatataccatctgactagaaaccctatcttgatgctcacatgctgtagaaggaacatgccaaattaacggttaggtttatatacatgatgttctgttggagggttggaaacctctctcctctgcacgcaaaacagagcaatagattaacgcatgattacttaaatattaacttaaaaaacttgaaaataaattaatatgatttttaaagcaactttcatatataattttttttcaaaacacgtaccatttagcagtttgaaaagcgtgcacgcggaacaaaatgtgtactatgttttgagaaataacatgtttgaaaagcgtgcacacagaacaaaatacgtactatgttttgagaaacaacatgttttggcaaaagctggttgtatatgatccaacacggatttgggcttttgccaactaaagggctaaggccagccatacaaatgggcttctctgcttatttttcttcaaacagtaaggttgttttgggcagaaataagttcatccgaggtcccttaacttgtcaatgaatctgatttccgtccttcaaccggaaaaccagatacaaaaccagtggaaaataagtctcaagccagtttagacagcggtttcagttgacgtggtgctcacatggctaatttaactcggtatttatctgacatggcacataaagcaaaatttaacaatttaataaataaaacaaaatatgtgggcccacatgtcagtcaaataataagattaaaaaatagtggggcacatatgtcaatgggccccacttcctccacctcatcccctctcaacttcttcctcttccctagatgtggcaggcacatgcatcgaccggcatgccagcgagcgatagcggaggcgtggggaggctggcgagcgggggtggcaccgggaggcatggaggtgggcgagccactcaccgtgagatggaaggcgggcacgacgactggggaagaagacgaccgctaacacaactccaccgccctagacttgagtgagggccgcacttttgctccccctcctcccctcttcgttcccccatccacttctggttgtggcccctgacgtggctcagtcccctcctccgcctcctccgacgtacggtgagggcggagctggagcctgtctgggcatcgcgccaccgacgctctcgggcttgtataagggaagaggaagagaggttgccatcaatgcgagcgcgaccgacagggtgcggccgaagaacacaacggccaagatgggacgatgcatcgctcaagctcatcagctccctctccctcacctccatcctctcctcatcgaggaacctggccaccgaccgtcttctctctctaggcgtgacgcccatcgtctctacttgctcctctcctaacggccgctttgcaccaccccttctccccactggccaccgccctttccccgccgctcgtcagccgtcgtgcctagagagaggagaagagaaaggagaggggagagagatgaagagaggggagatggggagatagaggaggaagaagcccgccaggacagaggcgatagaagaggaggtgccacgcccggaaattcactaataatttccgaactaatttgtgcataaaatcctcgtccaggaatcagccgaggtacacaaactgataatttaatatacaaatccatcataataataacgttacatacttacaaaagaaaagaaaacagcagcggaataacagtctagcgatggcttcagctccactcccacaggcagctcaactggggtataagccaaacgtcttctccttctggatcctttttctttaattgaggttgattgattattgcaagaatgagcatatgacatactcaacaagccacacagcaaatatgcaagtgcacaaggattccgaaggatggcataatatagggttcatttgcgaagacaacatttagcaaacatttaagagaagtaaaacagtagagtaattaatcatcaattttaatcaacactgaatagcaccccaatgctgcacaggcccaaccaaacctgaacaaccaaccccggtcgtacagatcaaacctccaaaccaggagctaaacaaattattaccagttatagcatcaataattatttgtgagatgtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactagaaagtacccgaatagaggctgtgacaataccccctgcacaacacaactcaccacagtgcaccattcctgaatcataatcaccccctctataaatataaccagaggcatggactccccagcgacccccacggacttctcgccgcttctcagtctgatgccccgcaatgaatcatgctatacaaaaggtaaagccgttgcccacgctggcttgtggttggtacggttaatgtttcacaacagtagctcgcgaaccggtccttaattgtcatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcaaattggccataacaaaggaaaaggttcacaccacccggtgacattcgaaaataaatgcacagttaaaataaatagagaatttaaatatagaatcaacatgctcaaaggattgtgtttaggatctgtgtgacttgccttgcaataatcggtcttcaattaatcttcttgaacacttccgacgcactcacgaaccttcgcaacgacggaaacgacaagctaacacgcaaaacgaagaaaaagactaagaaaaaccaaataaacagtacaaaacaagcataaacagtacatgtggatatttttaacatgtagattttgattttagatgaatttagcaacttgaaccactcgaatccgagttacgatgatttagttatgaatttccgaagtttaatcgattttcatctaataaagaaaacctagaaaaagggatttatgacgtcatcactgacgtcatcatcgccggccatggcacggttgtcacgaccaccggcaaaagagggctcggttgggccatccgaggacacctacgcgtagaggacgacgacgcgaactcaccggtgcaaagaacaacgacggacgacgacgaacgacggccggcgacgaggttcaatggcggcacggttcggcttgacggcggcgatggcgctccggtggtcttcggcggctgcgaaggggcggacggggttcctctcctccgtgcgcacccgacgacggcgacggacggcagcggcgacggctaccgcggcagcgcaacgcggccggaggatcgccggcaacggcggcggctagagcaaggcggcggcggctctacgggcgacgggggagctcgggagttggggcaaacgaaagaggacgaccaggggatgctatttataggcttggattgaagagatcggactccaaccgagaggaatcgaagccggaaaaaccgagggttagttggagagataaactcgaaaacgaattcgattccgcgttgatttcttcgggataaagtccgattcttgggggaaaagatagaggaggataagaggaatatttcccctcaactaattttgcaagcggagcatgggatgcggcggatttggtggaggaagcggcgtcggctagagcacaggacggcagctcgggcttctgtccaagcttgaagatgaacagtatacgggacgcaattagactttcgtcttgggctggctgaaaaacaaaggaaagaaagaaagagaaggggagctcggctgggccgacttgggctgcacagcacgcgcgcgaaggagagagatgttgggctgaaatcagcccaacggcttaggagaggatttaacaactttccaattaaaataatcactgaaatgatctttgaattgttaaaaatacttccaatgctcaaatagtttcaagaaaaatcctgaaaatacttggacactcaaagtacttaaaaaaattataagcagaccatttaatgattaatttaatatgtgaataattactgaaatgttctttgtatggttaaaattaagagttgagctccgaaaaatccgaaaaaattccagagaatataattaaccatggagaatttaatagaaattaaatccagccatgctttttatttagaaaattttatttcccacatttaacttctcttgtaaattaatgaacatttaatataacttctaataataatttattaaataatttataaatcctgaaacgaaaatcaggatgtgacaggaggggagtgagaatgacatgttgggcccacgcggacccctccattttaattattttttgttgtaactgacatgtgggcctacaatttttattattttccagatcacattgccacgtctttgccacgttggatgaagacttagttaaaggagccacgtaggcatcacgtcaaccaaaaccggggtcagcactaccgagggatctcgtttgcactagttttgtaaattggggatgtgttgtttccggttttttggttcaaggatgaaaatcgtattcggtgtaagttaagggacctcgaataaacttattccttttgggtacatgacatctcatatcggtgtttgctgtgtcggccttatgccagcatcctgcatcattattggtgttacttctgttattattgatatgtctgttgaaagttggaaccatgtatttattgtatctctctgtatcctctttgatgaactaatggtttgtgtacatttctgaattcttatttatagccttatggtccagcttcagacatctgagactgatagctcagtcaataaattcagacaactcatctcacctcgtgaattgtgcagtaatttagatagtttaagcattatggatatgatttcgttactagaggtgtaatagcgtgttacatcgggtatattatatagggtatcgtatgggatgttcgggcactaataaaaaaactaattataaaatctgccagtagtccgcgagaaaaatttattaagcctaattaatccgtcattaataaatgttttactgtagcaccacattgtcaaatcatggagcaattaggcttaaaagatttgtctcacaaattagtcacaatctatacaattagttatttttcagcctgtatttaatacttcatacatgtgttcaaacgttcgatgtgatagggtaaaatattttagggtgggatttaaacaggcccataatctaacttttttattattatgaacaaaacaaggaccataattgaggtacaaaatgtgcctttttttctcttttacttatatcatcaaaaatatattttctcacattatccttatatcatcgcaaaccatcctttttccattattttgtgttctaacatgccaaaatcattttgtatttaccttctcgatattcgatagacatggaagtattatttgtattcgtcttcgtccttcattataatgttcacattatggcttacttttccatagtgagaactattcacagtccagaaattatacagaggccaatttgagtatttctgtaccaactatttgccttaatatttatgtgctattaatgaagcaccgatatgataggttctctagttacgagtgtatatttagtactcctgtatgttgattatttcatttggcaattttcaggtaattataaatcatctgcataagcagtgttatcccccgaccagtgattgacccggtcaggtcttcggttgaaccgtaggttttctttgcatacgttcattcagggattatgggcttgcttactttgacgttactaccaatcctattaaattttgatatgagtaaattgcatattcacggtacatcaacttagtaagttggtgcaatttagtgaaggaatttgagaaataagcatgctatgacaacaacatgctaagtggatgcaacgtagtacaacaacttaataaatgagtttatgggtacgactatttgaaaggtgggtgtgattttgatgcaataacttgagaagtggtgtaaaaacttaattatgtatttttggctatatgtaaacagtttttacttacccagttgttaataaacttatgtagatttgtacaagcatattttctttgtcattctagtaactaaaagtctgagtaaaaaaatttaaaagtaaaaaaaattactgtgtagaaattttctagttgatatttgagatggtaaaaaaaaatctaaatcaatggtgcaaattaggtgaacaatatattcttacagattacatcaaacattataagattaattatatctacggaattgctatgtgatgacatattaacatcgtgaaaaaacttacatagcactcattaaccaaggtagcacatatctagccaagttattgcaccaaaatattaaattatcaaattcttgtattaaagtgcacccacttgctaagttattgcactttagacgtcacattcttcttgtcctaaatagaacccacgtatcaacgtgttgtactgtgggtgtaatttactcttttgataaagtaaaaaactgaacttatacatatatagcaatgctatcttaccaatatttggtaactttacggcttactcggtttggaggaatttgaatccataggaataggaaaaatgaaggaatataaatgtttgtacacatcaatctattggaatttttctaagagatttgactggatggaataattcttatgtttcctctatataacttgtagaaaaggaattttttttctttggttttcttatacttcaatcatataaattgaatgacactcataagaattgatctttaggaatccaaattctttgtttttcctccaaaacgaacaagcccttacaagatttcactattgaaaattccctcaaattgtaaggttttaaactaaacatatccaacagtattaaaatttgataatgtacaaatgtggcaaattttagtagggtaaaaagtggctacaaagttaacaagcccttatatatgattggttggttgtatcacgtgggtcagaaaagactaggtagttctatgggttttcgctggtctaaatcgactcgactccagagatattcccttcgtcctaaaaaaactcaacttctggaatttgagttttatctcataaaaaatcaacttctaacactctatctactctcagcatataaaacgacaagttttatcccttaaataccctatacctacctatcactattactactttttctaataatgataggtattttggtcatttttactctccactactttcttaggattatagggtttgatattttgtgggactgagggagaagtctaatagcctggactgaacaggtgaaggtgttaggtctggccaaatcgtggtcctagcgtttcgagtgacttgaaacgataatttactcgttattctttaaaatgattttcaaattactaaactgttattgtgtgaaaaaaattatatagaaatttctttaaaaattatattaatctaattttaagtttgtaataactaatatttgattaaaattatacgctaatgacttatctagttttttctcagccaacactgctggagagatgcacatctctcccagttcgtaaccccctttattcccgggtaacgaaccggaagaaaaaatccgggattaaaaatggatttttagtcccggttggagactccaaccgggagtaaaaataaaagcgccacgtagcgctttctctttctcttttctttttttattttttttgctactttcatattgattttgcactgaagtcaataataaattcatccacacagacaaaatcattcaacatcacagattcatttgtaacttcatagaaatatctgaaaatcatccacaaatttacatcacaaaatcatccacaaatccacaaatccgtcagcggccgcctcccatccgcgccgccttctccctgcgcccgccgcctctaccaccgcgccgtcgccacgcggggccgctgtcacccgccacgcacaggccgccgcctccctctaccgctacgcgggctgccgtcgcccaccacggtcaccgcctgctgctgctcaccccgccgggcgcggccctaccgccgctggccgcctgcccgctgccgcggatgacaggaggggaggggacgagaggaggaagggatctgaggtgttggaggctctcaaatccaatcttatctagatattttggtgaggaggaaagtctcgtctgggacttaaccgaacaaatatggtagagaaatatttactcacggttagagttaccagccggaactaaagatggattttcagtcccgggagtaaagatctaaataatctttaatcccggttggtagtaccaactgggactaaagtggtgatctttagtctcggttggtatcaaccgggactaaagctcctcggccccctgacaggggatgaatcaggactaaatatcatctttagtttttaaccaggactaaatatcaaaaaaatttaaaccgggactgaagaacaccaaccgggattaaagatcaatttttctttaactgggactaaaaacattttttgttagaaccaaaactattatgaaaatcagccgacccagtaaagatcacttctcctgtagtgcaaaatgctaagtagaacttaccctaataacacaatacaccagtactgtacaaggttaaaagacccataaaattgtcctgaattacatgaaaaataataaaagtgaacagcgatcaatatttatgcgtataatatgatatttaacaagttagtatctgaatgcatttactttcggctgcaaaatgcaaattacaagttgcttttagaagaagcttgcacatatattttcacgccaaaattggaagtttggttgaaattggaatgatgtgacgaaaaagttgaaagtttgtgtgtgtaagaaagttttgatgtgatggaaaagttggaagatcgaagaaaaattttggaactaaactcggccttatatagactttacgcctttacttgccaggaaaatgctctctgttgtacctgggcacattttataggtgtatgctataaaattgtgcacatcttatgagtgtgttaagttcacgctaaaattggaaatttggttgaaattgaaacgacgtgatgaaaaagttaaaagtttatgtatgtagaaaagttttatgtgacgaaaaagttaaaaatttgaagaaaaagtttggaaataaactcggcctaggtatctacatatgtgaaagcaacaagctttctcaaaaagccaggtcatgtgaataataatagccttaggatgagagtaggaataaaattggaccgttggatccatttgtgttataccaatcacacatcaggaaagttccagattaataggtcctatgcatcgatcggtgtatatacatatagtttcatatggtagtagtgaaagcaaaactagtatagatggagagcaccagcagctcgtctcattgacccgcaactacagaaatccatccaccgtagtgccaattctattaggccctgtttagttcaaaaataaaaaattttatgctaccatatcgaataaattggacacatgcatggattattaaatgtaggcaaaaaaaaccaattacacaaattacgtgtaaattgcgagatgaatcttttaagtcttattctgccatgatttgacaatatgattcaacagtaaacatttgctattgatggattaattaggcttaataaattcgtctcgcagtttcctaacggaatctctacgtttaatacttcaaatgtgtgtccgtatatccgatgtgacaaccaaacccaaaaattttccccagttaaacaaggccctactcccttcatctcaaaatatagctacctttaatatatataatttatcctacttcacatattccttcatctcaaccaactacaaccattttctatttaatttcatcatatacttctttatcttaatcaaccataaccttcacagtttctatcaaaaacaaaaataaaacacaaccctcccatttaattttattgccctctccttaatcccttcaaaaaaacataaaggtatctactctctatctacaaatataagcatcacaaatgtttaaaatttattcaaaaatataaggatttatataataacttaccttcaatctaacctcccattaaagaaaaaatatcttactctcgactattttctcaactcctatcatttctcggtaaagggatataaagttttatatgatcgaacataatctttcttaaacaatataaaaatccttatatttgaaaacagagagaatagtctcacaaaaattatcctgtaattatcaagatcagtcgtcaactcctatatgctggttatgccagcgctcagggtcgcgcgaagcgggactgggtggctagtttaggtgcttctagctgcaacaacaaaaaatgcgaacgctagctgcaacaaaatcactgcaatgaaagtaaatctctgataccgatttctgggtctaggctcttgtttttcattaggcgcgtggcaccctacaaatttagttagagctcactcaaaaactgccatgtgtgatgggtgaagtattcgcatcgaaagagatcgggaaaaaaaacgtaaacgtttgcctgcgtgcgtgtgcgggatgggctttgcatctagctagactgtgcgaccttgggcctgggcctggccctggcgccccacggccttttctgcaatatgtaccgcagtccgcagtactggtgcatggcctcttcacgcagcggtaagcatgttcgttcaaaagaaaagggaagaaaaacagcgtgaaggactgaagtgtatagagccagtatagaacaaaataatagtaataaaaagaaaaggagaaaaactaaaaataataggattatgcaatcaactacaattactcaaatgagggaaagtcacttcatgttagcatcatgtgtttctagaaaattagaaaaaatagtgaaattaaatggaaaaaaatatagcagcagcaaggattgtgttaggacaatcgaaagcctccaaataaatacaatctagaatgtttacttcaaacgaggaaaatacctaaaattctatagaatggaaagaataaaaagtgaaattagatgaacagatgtattctctgttaaccgacaagttcagcactactttcctattaattcagagcattttgtttttcctttattaatcctcaccttatactttttctggatgctaggaatccatttattttggaacatgggtaagtaacgacaataattttgctatattttttgtttgtgaaacacaatgtagatgatatacacacgagcaccttttaagactaggccgtcagacatatatttggattgataaagatcggtaggttgcctatcattgaaacaacaaatagtggtaaaatgtaagaactcgttctaagtctataagtctattgacctgaacctgtataggcacggaacctaaccagctgagctgcattagaatagctggatatataaaaacaagataagtatctttaccatgtcgatgtccctttctctaaataaaaccagtataaataaacaggtaaccgaagacacattatatgtatttcggactaattatacaaactatatgacttgcaagtttataacaatcgcgttgaatattaataaaaacacatttttttcactaatatatatgatctttaattatttcttaacgtaaatattccgttcagcatgataagaccacaaattaggataattttactattctaactttcttttacaaacataaaatttgaaaaaaaaattaaataatcattttaaacctattatttctaaaagaaaatatacacatgctataaactagctagcgtgccaacgggcacgctcattttctagtgttttcctaaatgtagaactggtgtaacagaaagcagtttttatagagcgctgcagctcttttaaaatcgtaacaatgccatactggtaatattgcagggtggagttgtagctgggtcaatgttgcctgcatagtgcatttaatacagtccactactgagcagtgctttgccaggaacatcaatgcatctgcatctaccagttcggaatatgcacgtaagtttccggtacacacctcgtacgcaactagcaaatatcatacttcctccgttttataatgtaagttatctagcatttttcatatttatattgatgttaataaatttatctagatatatatgtctagattcattaacatatagaatgacttacattatgaaacggagggagtataaaattttagaaaaaaacacacatatttccactaatatatatatctagatgtgaaatcttatcttcaaattcattatgttttagccttaaaaagacaaaattatgacatttttaccctcaaaattatcagatttttcacaaatataatgaatttgaatagtaggagattttacaaatatgtgtaatactattagacgtaaatgtctatttttttataaattttttatgacatttactagttggtgttaatgaatcgtgaaaaggaagtttgtatgcataagatatgtcccctaactagttctctttaggtgttgatatgatactccctccgtcctaaaatataagaaccttgtactggatgggac

SEQ ID NO: 48476 - DNA, 1132 bp, Oryza sativa
tgtcccatctaatataaggttgctacattttaggacggagggagtatataatatctctctcccttgatgttatcacgaactcctacatgacttataatggatgtgctcacttgaaatcaagatttctaacttttcactgccctttctcaagacagaaaaaatggaagagcagaggcccaaggccagcgagaacaagcctgtgatgacagaatgagcatctcctgaaacagcatttgatgcttaagggtgtgtttagttcacgctaaaattagaagtttggttgaaattgaaacgatgtgatgaaaaaattgaaattttatgtgtaaaaaagttttgatgtgataagaaaattgaaagtttaaaaaaaagtttggaactaaactcggccaaacgaactttcgctagcttaaaacgaaagcttcctgagatttttcatgcacggtatagtgtccctttctagcctgtagaattttggatgctctggttgaacgtgcaccgactgttgctgttacagtgagatggattggatccctcagctacctatgaatccctgatcctctctgatcaatgagagatgcatatgattgagagccttttttccagacatcatcctgttcctggttggtgcatccgtaccaggggtggggtgccactgccatggtgttcatctctcattttctctcccatctcttagatataagatatagattttatctcaatttatgttaacatgattttaagcagttaaacatcatatttcgtagaagatgttgttttaaaatattagataattatattttttaagtttaaaataattataacttaatcaataatatgctaatggttttttcgttttacgtgtccatatagggtcgaagcaggccacaagtatccagagattctagaggaggaggcaggaaagcggaaaagtgagtttttaggccggctcctcgtccgtctcgatccgttgcatggaagaatggcatcctaagccttctaattcgatgcattgttgcatggcatcatttggcctgagatttgtgtgtttgctgccatgtgtggtgatgtcgctgtcgttttcgacgaggccacgttgcatgtgaagaggtagtgaagctcaagctgaagggtt

SEQ ID NO: 48477 - DNA, 1531 bp, Oryza sativa
ttattattgaattatttttaaatgttgcacgatgttccactaggtatatcggaattgtttcataaatcgaaaatatttcactcgtttaaatcgagtgttgtttcaccttatataaaaacaatgtttcagcaattagtgaaagaatgtttcagttcactgcaacatttgatccatacatagtgaaacattttttggtggaaaaaaataaaataaattccattaaaagggggtttccaaaatatgtgggttttttgttgcaatgaatatttcagttcactgcagcattatatctatacatagtgaaacattgtgagtacactaggtgaaatatttttggtggaacaaaaaataaaccaaattcccttaatagagaggttccaaaatatgtgggtgatttgttacaatggcagataggagcagagacgcggtggggcctagagcctacatgcagtgcgtggggggaggggcgcgtgggggagcgcccgatccggctccccccgcgccggtcgcccggcttagagcattctcgactttactatattataagaggcagcaatataaggatccggctgctgaaggcagaggcccacggtaaaatgagcatgttgctacagtaaaaccaattatttgtagttaattactcactccgttccattttaagtgcagccatagtttttcccgcccaactttgactgcccatcttattttaaaatttttttaaaaaaaaattaaaacataagtcacgagtagagtactattcatgttttatcatctcataacaacaaaaatattaattataaaattttttcaaataagacggacgatcaaagttgagcgctaaaacttatggttgcacttaaaatgggacggatggagtactatagcaatcaatctcatttgttcgtcgtaaatcagacgggctaagaattaccccaaaatcatggcactgtacacttcattgtgtaaagttagaggatcccgatccgtaatatattcacacctatgtggcagagcataacatctatgcaatcgtggcctcaattacaaatatagaacataaactacaagtgccccaatatacatgttactaacatatcgaactcgaacgcgatagtatatattttggcaattggacccgtgcgggcgaaaaacggccctgcgcgaccggatggtccgaacagtgtgcccccaaggtcgtcatcggactttttctccggcaatgctcggtttgaaaatggcgggactcggtgacgatttacgactagtcgctttggagtactagtattttggggcgtttttccttgcccatccgcggttgttgtgtcgtctgcttcagttccaccccccaacttgagtcgaggttgttgtcgatcgatcgagctagcgtgcgtacggggcccggccagggcgaacacacgaggggaggggaaagcgcacacaccgtacgctactacgtgcgggggcgcagttgacgggcgggcaatccggctcgcctgcctcggcggctgtaggggggggggggggggggggg

SEQ ID NO: 48478 - DNA, 827 bp, Oryza sativa
cacggacagcatggcctccggcaccggaacttccgccgccggcgacgagcacgacgacgacaccgccgcaccggccaagtaagctcacaaccccctgaccctgcacaaacacctgtaacaacaacaacacaaaactaaccatggctaaaattctccttggttcagggcacaggtggtaggatggccaccagtgagggcataccggaggaacaccttccataggccgccgccgccgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggagtaagtgccatcatcatcatcatcatcatcagatattcagaatattcagatgacatgttatcagtttcttcagatctgtatctaactctaggttgctctgtttcttttgcagaatgtcatctcttcctgcaagaagttgaggatcatgaagggctctgaagccaggtgatggtctgatggatgacaaaggagacaaatcacaggctaggacacaccacatgagaagatggatgatgaatcagagatcatgaatcacatggcatgagatgaatgggatcaaaagggagcagaggactagaagagccctgatggcttgtg

SEQ ID NO: 48479 - DNA, 1163 bp, Oryza sativa
atagtaatgtgtcgttatcaggtcttggacctgcctttgaccctgtcggcctgtgcacctgaccgagccaaatggtgcaaccggaccacgattttttcctcccgaacacgcactgacgtggcatcgctacagtaaaaaaagccatgaggtggcatgctgacgtggcgctccgttccttcctctctcaagcatatatgtatgacatgtgggcccggaatgtcagtaacagggaatcccgaaaaaattgcagctatgtgataatttctaacactaatgttgcagttttctgaaaagtggcgcaaaggttgcagcaaagtaatagtttagtcaataaaagtgcagttttctgaatttactcaaaaaactaatatttatgtttttactctgtaaggaaacaagaaatgttgtatctaaataaccgatatatctgatatctatccctaattaataattattaatatgtctcttgcaatcatggtgattactcaatttaataaacccacgcaacgagcatacggcatatttggaatctttcgaggacagaatacgacacttatccgataagggttttgtgaccaaagccaagacatagatctctaaattctccctcttttgcacttcatgttttttgaaaaggggaatatcattgcttactcctggccttctgtggtggagtgtgaggagaacctcctcctttcccctgtgatgtccccctatccaagaactaaaaggcaggataaagccaatggttcctttctcttgacaaagatttgtgcaaatcaaatctttctaccacctgtcctaactcctcagccttcctcaggtttgtggtgggttgtgagtaggaactagcatggaaaaaaatattcttatatttgtacttcaataccatcttggttttgtcatgttcatgtatgtgtttgggatcatgtgtaacctttggcataaaccttatgatattctctcgagggctttcttgtcattccacgcgttaataacagtaggaagaacagagatgcaaaatagaagtttgctttgcaacacatagatttactaatatatgtcaaagcatggacttttgctttgctttgttggaagttcagggatcgccacaaatccaaggttttacttgacaagttattgacttttcaattgactacaga

SEQ ID NO: 48480 - DNA, 8264 bp, Oryza sativa
acacaatgacttaattattttcaacagacaacagtaaccccgaaaaccccaatagcaaaagtcatgctcccaatactatgcttcaaacctgactacaaaaaaatggactgtattttctttcctcatggaactgattgtttcagggcaatgcagccttcaggctcttggctagctcttctagcttcttcaatccttcttcgggtgaagcagcttcgcccaattgcctcaccatagcgctcccaatgatcacaccatctgcgccccatcccgcaatctgttacaaggaatgaagcgacaaaggtcatgcaatgaattggggggaattaaacgtatactgttttgaacataagttcttgagtatgatttacctgcttcacatgctctggagtcgatataccgaacccaacagccacagctttgtccgtgacctagaaaagaacaagagattctatgagcatccttgaatgttatataaatgttttggagatgccaacaccaattcactgacgatgaatgatgcatacctgcttgatatcctggagaagagattgcaccttgccactgacatttgcacgtgcacctgtaactccaacagtgcttacctgaataacataggagttagcaacaagccccatcataaatctagttcgctatcatcaaacagattcttgagatttgataataacaaatttccagcagtgcactgtgattacaagcattcagtttaattttagaacgttgaggtctatgaggtgcaaaattactgactggccatcaggaatatatgctatatgagaacagggtcattagatttcgtaaataagttaaaaaaagatatagaagctcacaagataaataaatccttcagaagcttttgtaattttctccattctttctgttggtgtagttggtgttgtcagtagcacctgtaggcatccatgcaaaataaatcatattcattaactgaaatggcataaccaaaatgatgtgggctcaaattacatatacatagacagaacgacacaatgttctttggtaatcagcagcaacataagcttgctagtaccacatggaaacaaacatcttgtatatatgaagggaaaagaacagaattatggaagttcaggactcaggacccatgtacccaaaattaaattactcagttatgcacggttgcagcaaagcaatactgacagaacaatattagagcttttttaaaaggttcatagcatgagagtggacctaccagctcaaggttgttcttagcagcttcactcctcaaaatatttgtctcttccagaggaacatcaggtaccacaagacctgcaacacagtaatacataagaaacttgataggtacctttataaacagttcaacactaccatattgttctaggtttactccatagttcagctagaaaagggtttactttatagtctataactctatacattgaaatgcaagaatgtacacataacaactgacaagtgggagtctgatgacactctctacaaatatcagtggtgtaaatttgtctatgttgttatacaagttctaattttctgaatgcctaaattaatgttagtccaaattgaaatacaagatatgaaatggaataccccttctagttgattaggtgtgtattgagtagaatgccattttatataaaatagcatttgtaaattcataacagaaaatatctaggacataccatggacaccggcttcttttacaacagtcatgaagtttgcgatgccacgcttcagaatcgggttataatatgtgaaaagcgctacagggcaggacagctcaggtatcacctcctttaccatagagataacatcctcaaatgtggtgccttttgatagtgcacgtgtagcagaagcctgaaatgatgcaatgaaatggttaaaaacttaaaactactcataaccaagactcacaaccaccatcaaacatcatagaacaatagcagaggtttttcatggtatacctgaatgacggggccatcagccaatgggtcagagtaaggcacgcccaattcgatcagatccgaaccacaagcatcaagaatcttcaacgctttcgctgtagtcgccaagtcagggtcaccagcagtgatgaatggaatgaatgcggtctgaaagttttcaaacatataagagagtaaacaaacataaagtggattgcagaaggggggaaaggcaaggtatgaactcaatgctgatctggatgcctatcacaacttaggagacatataactatgtcatctcatatcaattggtattctacatagtaatatatcacaaataataaaggaaaggtgattgggctcatccaacactaatcacaatgattcaattatcctcgagatgattccaacgcatcatcaatcctgaccgcgacggcacgattttttttttcgaaacgaatttaaacccacgacgcatgggaaaactggataaggattatccatcaaccgcggcctgtatcaccggatgcaaatccatccaatcgtaccgcactgaaatgcaagtatgcaaccgcagaacgattcaacgattacccccgcacgaatcgcgacgaatcaaatccatcgcgagcaaacggggagaggagatccacaccacgacatccccaaccccacccaacacgcgcggagatgacgaatcggccgcatccccacgcaccgaatcgacgaggagggggggtggtggcataaaatcaaaatcaaatcgaaacgcgcgcgaagaacggcccccccgcgctcaccttcccctgctccttgagcttggcgaaggtgccggagatgacgcgctcgtcctccccgacggcagccgcctccgccctgatcgccaccatgggagcagggaccccgcggaacgagaccctccccgccgcgccgccgcgcctcccgggcgcggccgcagccacggacagggacgaggccgaggccgaggccgtggacgccgccgcggcggaggcagttgaggccttgagcgcgaacgccatgggtggtggtggtcgacggcgatggcgcgcggcggcggtggtggtcgagtcggggatagaggcaggaggcgagcgtgtgagccggtgtttgtgtttgggtcggtattaataccagcaggaagagttggtgtggtgggatggccgagccggaccggcgcttcttggtgggcccacagtgtcagtgacagggagtcgacttcatgggggatattgttgttttgttcttgtggcacgtgcaatgcaatcacctaacatgagtttgctattcgtgttggtacttggtatactttgtagtaggtatatattactgtagtaccacagtattcgttggaatttttttggtctagttaaaatgaagttgaaaagcggtcaaactttgtaaattttagtattaaaatgtacatgatgttctaatctcagcctataaaatatggtaatatcttttacaacatcagcgcatcgtaacttatatagttttagctccaatatagtaaacgtcaatcttgagaaaaaaacacgtttaatagttaaattatggctatttgttgttgccacgtccataagaaaaattgtatgaaaagtaagtaatacccatggccccatatgccaattttctcgtctctcttctttatttcttccaatcttttcggcaagccatgacgggtatattcctttgtctccttaagaagctccatggcattcggtccttttctgtattttgccaaactctgcagcaacaatgagtacagtagcactaggttaaacctcaatacgacaccgcggatagtattggcttctaggacgacacataacctagcatcttgcatacgagagtcttcttgtccaaatgattccagtagactctagcttagacacctcccttagcagggatcttgtcaatggcgcatcattgatcatgatgcctctagctcaggatattcgagcttagggataaccatatccatcacccctaagttaaaaaagaaccacctcgacagtgagcatcagggatcacatcgctcgtagtcgagctcgagctccaccttctttatcgctgcagcattgagattcgcttcctccgcaactacaccgccttgctatcgagatcggcttcctccatcttctactcgagctgtgtcccgttgcaaacgacaaagctcgaggaggcaaagttttgcggaggcaatagtagagtttgaattcaaggttggtggacgaggcagcaacatattttctcccttgcgatgctatatgcgtcgtaatggcttgccgaagagacaaggagaaagggagatgggaaaactggcacgtgggactaaggatatttatgatctttcacactatttatctcttattcaattggaaatgaatattttcatagctatagtgaccaacacaaaataaccatattttaatagtgtattacgtgtttgggagataaaaccatgaattcaggtgttctacagtaaaatttatcatctactactacttaaaaaataagaggtgcttccatcgtccgtcaaaaaaaccgggtggaaaaaaaccgggcagaaaaaaccaagtttgtccgatcaaaaaaaccggacgaaaaaaaaagtccgatccaaaaaaaaagtgaaaaaaaaaaccgggcgaaaaaaacacccgtccctggcaaaaaaacacccgatcccttaaaaagagaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaaaaaggaaaaaaaaggaaaaaataccgaaacgaatccgactacatcgacgcggtaaaaagagtttaaaaagataaaaagaaaactgtcctattccaaagaaaaatgaattatatgtatcgtggagaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactatcatattccaaagaaaaaggaattatatatatcgtggtaaaaaaatcgaccgggcgaaaaaagaaaaaaatagtccgatccgaaaaaaacaggagaaaaaaaatgggcgaaaaaaaaatttgtctgataaaagaaaaggaaaaagctgaaaagaatctgactccatcgacgctctaattttctgattgttatcgacatggttatgcatgaaaaacgtatattatcattacgttttttcacccgttgcaacgcacgggcatatttgctagtaaaataaaatatactgtagcttacgcaatattaattacagagtatcttgcctgtacggctgtacgataggctactagcagtagatacttcactctagtctaaaagcaaaacgagtattattgaaaaaataaaaagaaaactaatagacgtgccggttctctcccggtgttgaggaaagagcagagaaagcgagatggacgacgccgtgtgctagcagccgtgcaggtgtccatttcaccctgatcctgcctcatgcatcatgctacaaacgttccccattcctttcctactgctggctagagtagagagtacttgtcaaacttgtaaaatcttcttcttcttttcttgtttgtgtccgtgttaggagtactatcgatcgccgagacgagacgccgatggatggatggagctgtgttgttgttgatggtaactcgtagcctttgaccgatgcgaaaaaagaacaaaaaaaaaacgaaagggaaaacaaaacgcaagaagctttgcttggccttgtattgccaggttcaaccgagactcgagaatcgagatcgatcggctgcctcggccggtcagcactgcgtcgtcttccggcagctggtttgactgatctgaggcgggcggttggtgaaacaatggccgggccggcgacgggggaagaggccggcccagtgggtcgcgtcgcacgaagccggcctatctcgccggacgaataaggccggcccattaacctggagcctaaaataccctaatcacagagaagtaggacagcgtggcatgcatgcagataggggtgtatgtatacttctactcctacaagtgaaccggagagagaacagaaggcatgctgacatggcacgtcctcagcaaccgtcactgggacccacctctgtcggctttggctgttgatttattatgtgggtctagagataactggaacgaaaacttttgacttccctctccactttagttaacagatgtgccttttatatccggaggccggctaggagggacattgatcagactaaacatatcaagttcagaggagtattctccacttttgcttacatgcaatggcaatgtgaacgagctccttcacgtataaaagaaagttccatgtcaccaaaaaaaggttcacactctcattgaagctaggttaaccaaacattcagtgaacaaggaatttctccaacacacttagtttttcttcccacatcaacttataattcatccattgatcaataatctatcacatatgagtaggtattacgtatctgtgcaatctaaacctatatatgtgtgctcgtgttcatttttactatgcgattaaacactcgagcttggatcttgcaccctagccgtattcacaaaggggagtatttagcttcccctgttgagttccatactccaacagtactaaattagacttaatgcaattaatttggtgtggtagatgttgttaatatttttaataaacttggttaagtttttaaaagttagattagaaaaaaaaacataggtatttattaggtcttttcaagaaaatgcttaatgatttaatcaataggtcatcgggggaaaagaaagcgagggcttttcaaaaacaaatgtagttgtgtttcacagcattgatgattccaaaacctcgcacttgcaaaagccattcctcctttttatttgagagttgagactgagggaggaaaaaccatccccaaaagacagcagcagtagtaagggcctgtttttatctgagtttggtatgggatatttgttcgcacgtgaagaaaaaaactcattaacgtatgattaattaaatattaataatcataaacatgaaaaattgtcttatttatttttaaagatacttttatatagaatttttttagacaaaacacatgtttagcaatttacaaagcaacataaaacgatggagtttacagtttgtagctgaaggaaagaacctggctaagaatcatactgccaatagttagagcaggtacaatagtaggctataagctagttataaacatattttaaagagagaaaggaagagagagaagagcagcgggctatagatctgtagccagctacagcacggacttcaagacgtaatgagtgtatgacatgtgggaccagttattaatagtatagtaagcaactattgtatgaattgactattacattggctatagatgatttagagttagtagtggcctatactattaaacttgctcttaatgacaatataaaggccattgttgaaaggaataattgcatatcccccaggggtatttgtctcatcttctatatggccctcctcctccacggcccacaacccatctctgtttctctctcctccgacctctactaaagaagagaagacaacgcctctctcctcactcctcccccactctctctctctctcctcaatctctctctctcgcccctcgcgccaccgcgccaggagctcgcgccgcgcctcgcctcgccgacgaagacgacgaggaggtcggtggtcgtggtggtctggttgggtgtccatccatggcggggcagcagccgccgacgggaggagccgaggacgacttcttcgaccacttcttcagcatcccctccgccgccgcggccggagcctgcggcctcggcggattggctcggggtgaccaccaccccttgccgctggcgctcagcctaaacgcggagggcgccggtgccgccaggcgcctcctgacgggggccacga

SEQ ID NO: 48481 - DNA, 1909 bp, Oryza sativa
ctacagcaaattcgaccatgctgcacatatatgttcatgaacgaatgcttgtgattgtggtagcaaccgagttattttcggtgcctttttcagttgtaacgaagatagcttgccaccgaatttttgcgattacaagttagattatggtgcaagtaattggatgttttaagggacaaggtttgtcttcttagccaagtgttgggcagatattgcggtgaaactgcatggtgtgtggtttaagcatcatcataggctgctcgctgctacaaccatgatgttgtagtgtattggaagtcaccaacttttggccattgttatatcaaattggaaccttgttttgtagcgaatgtgctatgattgtctttagggtatctaataattgtggtttgagggtgtatactccttgtagcttcattactatattactaatagtcattaaagatggaaaggctaacctcttgctggtcccttctataagtttacaggaccatgttatttttaactgcattatttttttccctagaagttattttccatattcttctaggtattttctttaacttccatctgttcaatgcagctaaggagagagagaatagccgaaaggatgagggccctgcaggacttggtccccaacacaaacaaggtaatgatgcatcacattttttattgacattataagccaaagacttgcaagtttcaatgcctgccatcgatggaatttttagaaagtggtccagggctatcatgtcctgataactgaggttttttcattgcttttctaattctttcagctaatgaacagggatatcttcagaacagatgatatatatccatttgcaacattaatgtgctgcttgaaataacaaaaatacttgccctttgggtcactgctatgtgccctgtgattttcaattatttgaaaactgcaattgatctagatagagtgtcactcttctgatgcaaaagaagttaagttaaaaattgatgtattatttttaaattatgcagacagacagggcagctatgctagacgaaatccttgattatgtgaagtttcttcggcttcaagtaaaggtatatatgttttatctgtactatgtcactatttcttataacagcacatccataactaacagctaatgtttatatatgtttgacatggataattgtgctataatgttaggttctgagtatgagcaggctgggtggtgctggtgcagttgcgcagctggttgctgatattccaatctcagttaaggtaatcttctttttttcagatgtaagaccttctgattatggacttttgcaccagtagattattatgttgaactcatttcaattaagatgggtgggctagtcacgataaattttatgtatttgtcgcttatataaaacatgacacatgatcagtatgtttagatttcttttactaatgtcaatgtgctgctatgtgtagtttatttgctcttcttaccttctttctgccctcttatatttatctagatgtcaatcttctgaagttgtgtagtttctttgctcttctcatctttctgccttcttattttctttttgttgtgctttcttttgttacattatttgtttatatgtgtcagcatacattgctagggttttctgactgtcggcaataaacacaattttcgcttgcactaacaagtaccttatattttactaatgagttgagtagttcaaatccttagctatattttgtagtctaccaaggaaatacctatctcatttatattgttagatgcgactcttgtcatcaacaaaacttgaaagcatggattacttaacactggagactactaaatgatactacaatacaacatgacagtaattctttcttgaataatcatgttttgtcttgtgccacatttgtttgcat

SEQ ID NO: 48482 - DNA, 11195 bp, Oryza sativa
  unsure (1)..(11195): unsure at all n locations
ttccccccacccaaaaaattgcatgtgttgttccgaagcagattaggcatgtattatatgacgaagttaccatggtctccactcaaatcttcagatcagaagtatgttaagaaaataaacttgagatcacatcacacttcacatgtattgatctgcagtttgcagtttgtgctccgcatagctccgtgagatttcctccagttttaacacccaccaccaccgtcactttagatggtaattagcaccacaagatggatacatttaagtgcaaatctcgatcgatcgcgcaaacaaggaacatcgccgaatttgcaccctcgatttgcaggcgattccgagattaatttcgatggatgcttatataataaagcagggtgtgccatgttgataggtaacacggtatatctctcctcctcgcttgtccagccagctactagctaccgacatcgccggacgacgacggcgccgccggcgtcggagctcgatctcgccggcgatcgccatggacgccggtgacgacggccgctgcggtgactgtgagtcggtgtgcgacccgtgtcccgtgacggcgccatggatgcatttctttagggtacattgttttctttgtttgtttgtttttggtttttttgctgcctctacagcttatcaaattacttccctccgtttggcatttcactcaaagaggttcttttgactggcattgttctagtttgaccgtgttatcttttaaaacgtggtgtgatgatgaacgggatttatacgtctacaactttacagtgtaatatactttattaatatggtttttttcttagtacttataatgtatttgtataaaacggggatgatcaaactaaaaacaatatactaccaataaaagtgtcaattatgaaacggaaaaaattactacctcctccgtctttatattataacgcttattttgttttttattacaaggtgtgttttctttcgttaagataacaattgtttcattaatatattgtttatgtgataaaaaatacaatcataaaaaatataatcctaagtagtttcgaatacgaaataataacattaatttttatgtcataaaaagtataccatgacaaagtaattgtcggtcaaagtcttaccctaacgaagcaaaacacatcaacatagtgagtagtatcttgtacatgaacatgctctggcacactggccactgacaagttaactattaccttcgtttttttatataacaatgttaaacttttcacataattttccatcactcatattatttaaaagttatgtaaatatgtaaaaatataagttaagcttaaagtttatttcataataaaacaagtcacaacaaaataaatatcatttatataaacttttgaataggaagaagaatcaaaggttaaaaaccgcggcggacgagatgcgcgctacctgccttattacagcgtcccaatggcgcaggcgcctttcacaatcccaatatttgtgttttgttgctgcaagcttgaaaacgcagtcaggagcagcagcagtacggtataattagcttagttagcatcgtcgcttttcaagtgatttcaggaagataatatctagacgtttctgcttagtgcacgtatggtcaactagttgtttccccataatcagttaattcctgagaaggtttgtcctcggttgaaattctgtttaagaaattctactccctccattccaaaatataaggcacaaccacccttaacctaaagatcaagaaataattattatcatcttgtagtttggatcatcctcataaatataatgtatgcatccaatagaattagataatataagagtggaggatttaaaaaagttataatttaatgaagaagatgctataattaattgcatgcttgcatgcatgtcttatattatggaacatctatgaaaagtggttgtgccttatattatggaatggagggagtatcaattattgagaaagttaaaagtcaattcagtcgcaaacggatgctggtattcctcattacctcaaaacattgaaacacgccagaaacgttggtttgtggttgtggcaaaccaatatttgtagggcactgtaactttcataaatataataataataaacaacgtgcaacgaaaaaaaaacaactctaaaggtgtaggttgaaacttaaccaatttttttttaaaaaaaaaactcgatcaaatggaagagacatcttctggtgctcccaatttacactgccagaagagtttgcagaaaaaaacattgctggttgagtatgttaccgaccgcagttatctgaatgatgtgcacgaccacaatataaggatttcttctataatttcaaactaattgctttcgatctgaatatttgccctcaatttgaatctgctcagagtatttaaggttagcacatttcatactgagtatgttgtgcacgaataatatttttggtcagtgagttgagggaaacaaattccatccctgcacttgatattcttcatgtccagttgcaggttgtggcacaacgaaaacctaaagcacatgtgaatgccgactgcccaggaatttggctaattctcttcttaacttcaaatgaaatggtatttttcttaggctgtgtttagttgacgccaaaattagaagtttgtttgaaattggaacgatgtgacagaaaagttggaagtttatgtatataggaaagttttgatgtgatgaaaaagttgaaagtttgaagaaatattttggaactaaacacggcgttactgtatgagttattactactcataataatcttcagtttaaagtaacggttatagtattagtcagactttatctaaactcatggttaaattttatcaattggctttgtttctctctcttttttttaagataatggattatattaaaccagccctctacatcttgtgaaggtgtacacagtctaaaagtcacaaacacacataagactctcccgttacatgggtaaagcataaaaaagcttcaatccttcttctaaagttccacctaaaaatagagaagctccatcgtacgcttctccaaaagcttgcgcttcacaattactttaatgatttcgtcttccttaaaaagaaagaccaaagccttgctaacttatgttatttttaccacaaacatgaatattatttgagagattttacagtatcatattttcactttctaccgtaaaatctggtatctctcaattagaaggtacaaaaatttgcaatatctctcaagtactgtaaaatatttcacgttatttttgttttccctgtgtgagagttcatgggacttgtgtggaggagcagtaatcagttcctttctgcggaacttcatgacatgcaaacatgatgtgattatcatgctgtttccttgatgtctgattcatacttatatttggtaaaatttaataatttgacactctctttgttgccactctggttatattaacacttctgcccatgacagtgggccatgatatcaaataatcgaaatccagttcgtagagtgtcgaaaatcgaatctctcgttgtatttgtggaattgttttagacatactaaaattttaattgaaaatttaaaaaatagaggttggttggctgaaatcagaaatttaacaccctatcgaacaatcaaaatttgacaagggaacggccattgtttgataggatctgcacggtaatttttctttttttaaagctgatgcatgtgcaattgtgcatggtctgattttgcatgtaggtaagcagggcctattgaacacccaaagttcgatagggcaccctcatgcatgcatgcactttttttatcagaccatagccctatcgaataatcgtggttcgagaatggttgttggacagagtactaaacttgtggttttagccaactgacctatattttttaattttccattaaaatattaatatttctaaaaaaaactccacagcctaatgaaggctccatcaaaacatcacgtacgccctccgttctaacttctaatgatcaaaatatgtcctagcaatttcttcacctattccctcatatcaaacaatcacaatcatctcttatttaatttatccacctaatttctcatcttaaccaatcactagtcatgacatttagttacatctactttcttaatcaccatacaaaacttaaaaaaccttatattttaggaaaatgggataattagtagcagtgtgacgtaaattgcaccccctgaaaaagcagtctcatgtgtgatttctgcgtgtttgggttcttcattgttaattcctcgctgaaagagagaggctatatcccttcaaagtcagaagtacatgtgatcaaattagggtggagtggacccaggatttcgaggttgtatatgcgaaatgcgaaggggcaaaaaaacattgcagccaaaagcctaatatttggcatgtatgtcacatagtgctaatggtataatatatagcatacatattgtgtgctaaatatgacacttttttttcatacacaatatatatatatatatatatatatatatatatatatatacatacatttttttaatcaaaaatcttgggtattcatatcaatatccatgaattgagttgggcccgcccctggattaaatgtttcattcacacatatgtggaatgcgattgacacttggaattcataagtgatgtgttaaccattaagtttattttctcctactacgatgcacgcgctcatgctcacccactacgctcttgtttcgcacacatccatacagatgcctgatatcactcatctacaacttaaaaaggctagaccacattttagtatcctcttagcatgtcaggcaaagcaactaatcaaaagtaataccgagctaattgattcatgtaataacaccacttgacacacgttccttagtcacgaaacaatgcaaatccaagccaatcagcatgggtgaatcgcggttgttgatcatcaatatcaagaatcgtcgagttgcttgcctcaagccctcgatataaagctggggttaagaatgtgaagtcatgaatgcatagggccaactgtccacacatcgaacatgtcgacaccagataatacaccaatagttgttcatcgatcatcctagtagggttttcaggatcagaaagtatattttcctaggaatgtttaggcatcatatatttatttacattcataaagttttggttttttacatagccaagctaggatacctggatacggctgtcaagcgacgtatcagtatcagatacgtgaacagatacggatacgccttctccgataagcgccgatacatacgggatacgtatctagcaattttgtgatttccatataaataaaacaaacccgatacgtcactaatacgtctgatgcccaccactgaatctccttccaggcgcagggccgccgcctccagacatagcaccttccccgtcgaccgtcgtgcatcatgccccgcctggctaccagggctagagccgtcttccttgtgctcgcttgaggcacgcatccccacatgattgctgcaggtttgtagcgctgctaccgccgacgccgatgaatgctgcagtgattcatctaagcaaagcatcaccaccaccggattagcagacgaaacgccatcgccagacaacacgcagggcacgacagatgccattgaatgattgagttgttgaccccttccgtgcttgacctgcactagtttttgctgctccaatttctattttcttagtacaagtgctatatcaatgtagatccaaatcatccgatggattttatatcgaattccaagctagtgtatcccggcatccagtgctcctacacttcgaagaactagggcagctgcaaaataataatgaaaagaagcctcgctggattggattgtggcagacaagagaagtataggagatagcactttttttttgtgaataatcagcagttagcagtcagtccgcaagtttattaatttttctgtgaacgcattggttttcacaatttgtcaagagagtttattagtattttattttttattaaatatataggcatatccacatatccatgattcttgaaaaatgccgtatccccgtatcgccgtatcgcgtatccgtatcctcgtattcgggtaacatagtagccaagagcatttgcttaaaccttttgtcttactatgtcatgtactcttgtaatccaaaaaaaaagaaaatataattctcacaaggtcttctattcctgaaaaaaaaatcctaattaacagatagaacatgtaatcttcaaggggatatataaggagatctcgttgcatattgatacgaattcaatagaataagtaccaatagatacattatgaaaactttgttcaccttaagatatgtataattcacaaaattttcatcatcaatactgcatgtaccttgaaccaaaatagatgcaactctcttaatgatgaactggcaccttgaacccaaaatagatgcatctctcttaatgatgaactattatgcttctcgatatatgatttttgccatggtaggcctacacatatatagaatatcaattatgacatcttattttaaaagccaaacgatttaataacgagtgatctttaataaataacaattaagaagtgaactaactaaattccatacaaaggcatgttcaggatgagcacgattcatatgatgatgagtctaatttgctaaatttccataggttagcaaagggaaggctaacggggcatatgccccctcctcgcggatagaaaattggaggggcatgtgccccaacaatggcccatcctcgcggatagaaaattagagggcattgtccacaatagaacaacctggagtatttaaaagttttttttagaaaaatgaagtagagctgcacatgacctatagtggcgacatgagaacctaagggctggggaatcgatctagtaattggggaggaggggaacttaggtatagagcttatatatatatcaatttggaatgggttagctaggctctaattattgtaatgggcatgagaaacacataccccgggaactcgcagggtcacccacgagttcccccatcctaaccccggaaatttgcgggccccgccccgcttacccgcgggtgagaaatctccctggccctagccccgtcggagaaattgccacccctaacagtccctaacttagcaattggagttagaatacaatggatctcaatatgaaaatttgtttgatgctaataaatttttggtcttccaactgcccaaaatttgctaggctttttgagttcattccgaccatgctgtgagcattgaaacgagcaacaactacgctcaaagatttttttttttttgttcttagggatagtataaaaagattgtaagatcaggtttgcttgtaccaaaggctatggatgatccatacagttggaaaggctttatataattaaattactagtagttgtattgtccacctacaccaacacactcgtaccctcaacatgctcgtacactccggcatcaaagagaaatcgagctacaatttggtggtgttttaaaatgaatatgaagtaacacacgtaaaacgagaaaaccattagcatatgattaattgatatttaattattgcaaacctgaaaaatagatttcactacactggtttaagtcatcagtaacagactcaaaccatcaccaagtcatcagtaacaggctcagatcatcacctctaatggactcagagataagtggtcagtgatgactaaactcatctctaatgggtgaaggtccgtaactagtatggatgactaaactcatctctcacgggtgaaggtgactcacccgtgatgggtagcacaatgcccctttgactggtggcattgcaacccatcacaggtgactcacctgtgatgtgtagcacaatgcggcttgtcaatggtgcagattaccaatgaagaaaaacaaaatatattccattctatttctcattgcagttgcattcatctaaaaaatttacaaaacacaaaaatcatcacaatcacacatctgggaatatccaaacactcattcacatccaaacacgcatggcatcacgaaatcaacacgaaacgcatcaagaaatcaacgagacttgttgttgacgatgaaaccctcaagccgcaatgaaaaacttgtcaaagtagtagttggtcgccattgccaagctcgacgccgttggagggagtcaacaccgatggtgctgaggcggttgtcagtgcttggtagtctgtggagtcgtgcgaacgaagcctcggcggccggcaatcggggggagggatgacggttggcgatcgaaggagtgcatggggaagacggctcccaacggtcgacgacggtggtaggcagttgaagtaagatagaagagagaacgggtgacgggaggatttttctttatttttaaatcatcactaacatgtataagaattgaagacgtttgaggtgaggtatctcacctatgacgagtgcaaactcaacacccgtcataggaaagaggtcaactgtgacaggtttgtatgtgggcttgtcagagatgttatgtgtttggtgcttatatagatctagcatatatgagttcttatccatgacaaaccattttcttagcctcatctacaacaggatttagttttacccatcagagatgatatcatccgtgacgggatattttggttcgttatagataggtcatcacaaatgggctgatctgacatagtgtttatttaatatttgaaagcaatttttatatattctttaaaaaaagataaaccaaaaccaggtaaaatctacatctacttggccgaccgaagacgagaggtgaacttgtatgggcccacatgtcggtgaaccactccgatctcacgaacaggaaactattatacattgtcgaggggtcacctcgttgtttgcatatcatctaaatggttatgtaaacatttgaaaaaaattcaataagatagattaatatgtgaaaaaccactccacaaatatgcaaggtcaatttttataagttgcaaaaaaaaacatatttgactataaatatacgttaactaggtatagttcaatttctttttttttcatcttctaaaagttaaaatttaacttatatgttcatatggattgatttattatatattaatctatctagttaatttattttcataatcattcgaatgacagaggacctcgagagtcaatcgacttcctctcacgaaccgccctcgccaacctccggcgccgccgtccgccgagtctccgcagagcaggcgtacgtccacctcgagcctccctcgcaccgctctcctttgtcctcgccgccgcgcgttccgcgacgcgcaagcacggtggtcctcctcctcctcctcttcttctctccccagcgtcgtcggtgccgatggcgagtggcgacgcggcgggtcccaggccgaggaacgcggcgtgctccgcctccggcggcacagggaactgcagccctgactgatccaggcacagaacgccgggcgacatgatccccgtgaagctttgccacttttgatctgaataatatatttttgtgttcatggtattcctgaacagctccattcttggcacatccagtgcagagtttgttgtgcacgaatagaggtggtaaacaccgattccatcactgtccgtgatattcttcacagattccatcactgtccatgatatattcttcatgtccagttacaggttgtgaacttgtgattccttcagggaaaataaaatggttgcaggcacaaccaaaactgtaagcatatgtgaattgatattgcctggaacttgggtgattctcttcttcttaacttgaaattgaaattgctattgagagaatgtttttgtgcatcccttgactagttaacttttctgtagtactagtttacgggacaaaataatcttcatttttatggaaacagttgtagtcaacatgaactttattgtttcccttcaacttatgttattgttaacacaacaagcaagccattttaatttgctttgccttgtgaacccagttcatggaccttgtgattttgaggaagcatcacggaacaggaatcagttccctacaccataactccatgacctgtaaaccatacattgattatcgcgctgtcccctagatgtccgattcacacttacatttgtgggtctaatgacagatcgtctctatcaagaanagcattgcaagtttggaacggcaccagtaacatggagagacattttcaccttcacattgccatcatctgtactgctgccctgcatgcttttttctttcagagattaacatcaccattacagtatcgttttgcttcccccagtgctgatcaggtcacatggctcctcttaacctctggatctctgatcatatgatggcaggtggtcggctgtcgttattttcagtacatttcctcactgttgcagctgcaggccatggctcgggcagcgtgatattctggctgcaggagaattcctggaaggtggggcaccagccagccatgcatacgcatcatcttgtcctctgaataatcatcatcgtcatcagctgtgatactatgtgagtatttttgacagaattttttttgtgtccttttccttgtcttgctggtgcagagtgcagactgcatatggtgtggcatgaactgctcccctgaggaagcagcaaggcagcattgcgtggctttctgtgcgtttggattcttctatggagtttttatttattttttcgaggtaattcttccacggagtttgtgctgattcatccgtgcatctgcatctgcttggttggcagtgtgggcaggcagccaggcaagggccttatcttcttcagagtttgaaccaatggcctgcaggttaagcacttgattggtcttcaaggcataaatcttgctgaaattaatttacttctttgattagatcaccaataagatcaaattgtttgtgtgtgtctgtgttcattcagatcaggtatatagccttgacatgcctttgatcttattcagatctgaataaggaattacctctgatctgacaaatactggcttggtactgtatttatgatatgaacacagagaaacaaggaatctttggtgtggagaaatgaccaagcttaagtcaaatttct

SEQ ID NO: 48483 - DNA, 1632 bp, Oryza sativa
cgggtcggcgccgccggtggtggtggtggtggtgatgctgcttcccggcagggccgaggcggaggcagaggttgtcggcgtcggtctccgcggcggaggcgaggcagctggtgctcctgagagaagaagaagacgccatggctagctactgattttcttgagagaaagaagaggaggaggaggaaatgtggaagaggaatttggaggagaagatgagatgaggacgaagtggggagggagggggggattggttttaaatggtggcgcgcaggtgtgcatgtcgcgcggtcggggaggccggtggggcccacgggacaggcgggccggggtggggtggggcccacgggccgacaggcgggccccaccggctttggacgggatgggtggtgggattccctgccgggtcgggttagttggctcgcgccatgtgaccgacaggtgggcccgcgcgtcacgcgtgcggtcggggccccgccgcccaatgggcggagcacacgtgccgacggtgggtgcggctcgcgcgtgcgggttcgcgacgctgtcttttaaatttgtgattttttattattattactccatatgtctcaaaacataaacattttagcatggtgcaaagtcaaatatttataactttaattattaatttaaaaatgtaaaaaaatattaattatataaaattaatgttattagatttatcattaaacaaactatcacaatatgtaacttttttatttaaaacatcttaaatagcgttgattaaaatagtatcttgaaaccgtgccaaagtctaaaagtgtttatattttgggacagagagatattatttttcgtttgttttgatttaagttgcggtgctgtgttagtgcagtgctttgtgttaatttttaatcagagtttagtcaaatgatgtggacagggaatcgacacgggaaatacagttagatgcttggagtttccctgtatgcctacatgtggctcatttaatagtgggttattcgattttctgattggacgcggtgctcatcatggcagacacagtatgggcttgttattttattcttctacttgacgaaaaaaattatatatatcatgccaattttcagttagatgctgcttcggagaactgatagctacttacaagttgataattcgtaatgtatacttctgtatgtacagaggtccatttgttataaaaggaaaaggtatacctaactcactcgaattattttgctggagtaagtagcaaataaaaaaaatcagcttattttaccacctaaaatactctaaagcagattaatatgactatcaattacttttaaaatatttaatttgcacagtagaacacaattcattagtcttaaaaaatacgtcgataaaattaatttttacttactgtaatgcattataatacaaatcataatcaaagataaattttgaagactgtattattgtccaaaacgttaagaattatatataagactgaagggagtgtgtctttttttctctttataaaagcatgtccaaattttataaaaaaaaatatgtcaatagtcatttcaaaatttcccatggtagttgtgtgcttaattccatcttacatgtttccagtatattgtgtaatagttactaaaa

SEQ ID NO: 48484 - DNA, 7093 bp, Oryza sativa
ttatgcagctttggactcatgccacacacatccttcgcacgcacggaatatattggtcgtgttcatcactgccctttggcctttgcgtgtgcacatgcaacgtttccaaccattctgtacaccccatcatcaaatccatgcataataatgatcattccccccgcaatttgtgttcgtcttttcttttgtacttgtagaagttttagcaaacatcgatcatttagttagtagtttgtgtatacaaaaggctagccgaaaggaacctactgacgattagagcaaatcgctagttgattgcatttacaaactttataaagagcacgagcgaaaaatgcagctagtgattaaatttatcttatagttacacaaacatccaaagccagcatcattagtcgatctactactgtctctacatgcacattgcacggatcgacaatattttttcccccttattttaaggagagagcaccttttcccaatgaggataacaaaccaattaattaattatttcctttctactaaaatataaatactccatccatttcaggttataagactttctagcattgtctatatttatatagatattaatgaatctaaacacacatatatgtgtatattcattagtatatatatgaatgtggtcaatgctagaaaatcttataatctgaaatggaggaagtaacaaagaagttaaattaaataagaaattattacgaatggttgagataagtagtggacaaagaaaagataattgtggcctgttaagataaaggaactacgtgaaaagattattaatattttaaataagttttaaacgttaaaattatttatattttgagacgaacgagatgtaattaactgttcattaggcttcaagctatgcatgcatacatccaaacgcgaagaataatagtttgtcccctcttgcacagagagaacaaaataagcacacgtacactagcttttaactatacgtacgtgcgagctaagcacgcatgaatgtgcgtagctgtcagtgacacatatataacgtccaaattagcattggatggatgggagaggcgaagaaaaatcaacgggagttaatggccggtagctgatgatcaggggtggctaattaggtcggggcttttggtagccgtctcgctgtcacgggcatatatggatacataaacctggctgtgctgtgacactgctgtgcctcctttttcccaaaagacaagacaccatcatgcgtacatgctggcccatcgacagaaaagccagatcggttttatacaactgtgagtgagtatacgttactagctaggtgcctctcaatgctcctaatatcaagtaggcttttatttttctattttctttctttactttttttaagaaaaaaacaaagtgtaggtgtttagataaaacctattagtaatctcagcatcgagtcatcttttttacattcaagtgtaggcttttatattaagaatttatgaaatcaaatcagtcgtcatcggatccggccaccatagattttagcttggctaggggtaaattaatagcatttaataactaactgatacaattaacaacaactctttctacatctaacggagaacgagtatagctcagcaggcagggagccgagcaagctattgcctattgggttgtgtaacttgtgttccatccctcgaataggtcttttttcacgactttcttctctatcaataatactgagttaactgtatgtacggggctacgggcccccatttctcgtcggttcgattcaacgcacgtttcgtggcgaacgtatataacgagctgcaaaatgcgggaaggacacgtgttacgttacagcggcaccatccatgagtgcgtgcattatattcctgatcgatccggccagccataaactccggtgctccacgctttgactccacccatctcgtctcgtctcgtcggcgcgtctcgcttgcccggcccactcacccgacacacggcgtacgcacgtacgacccccccgccacgcgtacgtacgctcgcgcgcgcccccacggttaatggtggcgcctcccctcccgacacataccacgtactacacactttaccacactgtacgatcgagcaccgcaacgtcacgtggccgcagccaatcggatggcgacgcgctcccgtggcgccggatgccggggccgcggcgtacgtgcgatgccgatgcgtcgcgtgtgcgtgcacgcatgcgcggatgcgccacctgccggctaggtcggccgcgctgtggcccgcgcgcccgcactgcgagaccagaccgagtctaggtgagcgatcgaacgatgcatgcgcggtgcgcgcggctgcggggaggggcagggcagcgtgggctccgccgtgtccgaaccgaacgcgatcgacgggtgagatggtggaggcatggagggtggagctatttattatgcgtaatgccatgtacaatacaccgccgtcgatagcggtctcaaactctcaatccttcacatcatctatcaaaaaaaaaatgtccttcacgtcagatccgaacatccatggcggtggggaccatggttctatgatatgtgcatatacaggttacggttgcctcgacgcgcttcagcttgggattgcgaaaccacaactcgggaccatgcgttgagcaacaccggagccctgtgatatgcatgggaaaaaattagaggtcgaggcgaggcctaggacttggtgtagtcgttgttgccactcgccgacgttgtggtagcctcgccactccccaccactgccaaggacttctctcgcagaggtcgtcgccgctccttgctactgaagtcgccgttgcaaatccagcgagttcgtgaccagattcagtgaactcgtggccagatccgccgccggcggttgtccctcggccgtcgcaagaatgggggagggaagaggccggcggccaaatctgacatcgccgttcgtagagaaggaatggcaagaggccgacgagctcgcagcttaatccaccgccaccatggggatccgctgtcgctgctcgcaaagaaaggagggggagtccaatgatgttatcccttccaccatcgccactcgcagagaagacgcggaggagaggctggaggtggaagagaagtgcacctgtggatgcgaagtaggccaggggagcagcgctgctgtggctgaagaggaggtgacaacgttgagaggaggaggtggcattgcggtcggccagttgtgggaatgaggatagtgatgggtaggaatagaaaataaagaagatgacaggagaggctgacggtgggtacatatctagattaggagtatctatatatttctttttgttgttataagatctaaaatagttatttataataacaaatatcataggggctaggggcagacacacaaaatgtatttagaagttgtcttcattgtaaacatcatggcttttgtatggtcttatcctatgtggcaggttaagaccactactccattgttgtcatgccctgaagtttcccttgccagctttaaaatttgtaaaataaatcgtccgaagaaattgttctttttaacctagagatgaatccctaattaataaatgcaaataataatcggaatctacatgtggaattttttcatggattctacatgtcaaaatatgctaacaggatttttagtggaattttcagagccttggaaataattttaaccaattaaaatgaacaaagggcaatattaaatccctggaaaaatcctttcttctttttctttttctttttcctcttttttctctcttcttgggccgtcggcccagtccattcgcctcccgcgccggccttccctcggctgggccggcccaagccgactcctccctcctccctaacccctccgggtcaccgataggtagggcccacctgtcggccccttcttccacctcccgcagtcgaaaccgccgcctaccgccgtcggtttccccgcttcccgcgcccactccgcccgtgccgcacgcccacgtcgccgctcaccttctccacacctccgctagctcgcgcgccgcaaacggcgggggatttgctcctttcccccactctctctctcctcctccacttcccccacgtcgcggccaaatcggccaccttcccggcctcgtccgcccctcccgagcccatataaaccatccctccactcccctccaccttttcctctttccaccgctccctcccgtgccctctatcgctcccgcgctgctacacccgccgccaccgccttttccactcctccggccgccgctcgccgccgctggagccgccgccgagccaatccgccgccgccattagcttcgccgccgccaaagctaccccggccgccgcatccccatccaatcccgccgtcggggcccgcttctccccgcgcgccggtgagtaccaccatagccgccgctgtcggccatggctctcgctcgtcatggacaccctctctccctctaacctctcacacttcctctcttagggtgtcctggagctcggccgccgttcgccgtcgccctccggtcgctcaccgtcgccgtttgccgtcgtctcctcccgcgccggccgaaccccggtgagaactccctccccttctcttcctcccgcgcgtgccgccgctccccacatgcgcgtcgccgcgatgcaccgtcgcccgcgtcgccggccgccgccgtcggtggccgcttgccgctgccgccctcgccataaccggccggccggcttgaagccgagccgagccaggctgccttcctccttcccccatgagccgccgcccggtgggccccgcctgccagtacccctccctcctccttgagccgctgaccagtggggcccgcatgtcggcgccgccccaccccttgctgacgtcagccctgggatgaattattgcgcaataaatacattaaggctttttctttattagtaaaaacacagataatcttctaaaaacataactaattcatccgaactccgattaagtccattcaagtctcagtaaattcataaaaatgtatagaatccattaaaaattgttttgtttcctgtttcagtagtcttatagcatgttttgcttgtgtgctttgtttgtcgcgtagatttcgcccgtttcgtcgattcgcggtttctcgaagacgttgctgtggttccatcagtgcgagagcaaggcaagtcatacattacaattgatcatattgtacccaatttacaaatgtcccgcatttctattaaatattgcattgttttacaatatcatgtgggatgggtcctattactcagctatatgttgtttcccttacgccattaataacttgggtattaaaatgactagatgttggtttaggagatgcttagccatgcttagttcaactagtgcacaaaaggggatcacattaaagcatagactttgattattggcaatagctttggattagtgccaccgcaatggtgttggttaattaaaatacactacatggtgggctgtgggtgcatggttttgctagtcgtgtccatggcgattaaggagcggttcacgggatgccctggaagaacttatcgtacttaccacaagccagcgtgggcaacggttgggcttgtagtgtagcttttctctagccgatgtacccaggcgagggtgggcatgatggagttgggtcggccggggtgtccggttgatcggcttccggattcaccgtggcacgaaaggggggctgcccgttgcctgttggggacgggggcgaaccctaaggtgtggtgcgatcggttagagagggttatgcgaagggtcctgtcacggcctctttccggtatgtcgtggtggcatgtcggcgcacgggaacgtgtcatgggactgtgtcttgtgggtacagttgtacacctctgatcagagtaaaactattcgaatagccgtgcccgcggttatgggcggtcgaccagattcaccgtgattagtctcacccctagtttagcttaatgaactggtgtagttcaggtggttggttgggcctgttgcaacgtggtgtagcgttggacagtgattggttaatactgcttaattgctactactgttttactgctttcaacttctgcttttaaatgctagctttatgcaaaagaacctttagcccccttggatatatcctgcatcatacctcctcttccggtacgacttgctgagtacagtgggtagtactcagtcttgctcttttcccccacaccagagttgaagttcttctcagttggagccgtctcagagaggttggttccgtcgctgccgtcaaggattgcctgtggaatggagtcgccttgctgctgaagtcaagctttccggtttagctcgcttttatcttttccgctgcatttgtaatcttttatatttttgtaagacgtggatctgtatgtcaacaattgtcgtttgtgtaccctggctggtcctggacagaggtttaatatacattcagcttagaaattctggttcgtgaatttctaggcgtgacaagtacatgccctaattggctggattcatttgactcgtctcatcgtggacttgatcacgagcaaaatttaagtgatgctctttttaataaagatggagatgaagttaagacacggaaaataagaaagtgaatatatatgattaattaagttttaattattataaatttaagatggattttgttcgtttgaatcgaattctagctattaacatagatcttcttttgtgcagttcccaattcaaaatttcttatagttataagtatttttagctccacaaatctatatatttagatttctatttctattttggattaaattttaaacaactataattcaacatacaaactttaaatttactatagatctaagatatggagttgtgcctaacaagatcatagatcccctattttagatcatagatcccctatttttctttttttccccagctgccagaagaacgccgactgtttttattaaggttaagataagaaaaaaaagtcagattacatgatgacaacggggttattgtgctgcctcaagcacatgcagccaacaattaggggatataaaca

SEQ ID NO: 48485 - DNA, 2239 bp, Oryza sativa
gggggacaccgcacgcgcgcggccgccatcacgtccatctggacaggacccacgtacgtacgcgcgagcgcgcgtgcttttctcggtctctcttttggccgtgatcgccgacgactggcttgattgattgccatcatcacatatgcttgctgccgtgattttgctcccagcgattatgcttgattatggtatagtaatttcacttcccgttagaattcaggttgcatgttcttggttagctcctaagggagtgttggagagaaagggaaaagagaatattgataaaatatacaaaatgaggcgagctattagcgcacgattaattatgtgttgattattttaaactcaaaaattgtattaatatgatttttgaaagcaacttatatatatgttttaaaaaaacgtacagtttgataaacgtgcacgtgtaaaacgagagatcttctcacccaatctgctaactcgaacacaacctaagacctcaaggcctgtttcgatgtgattaagggtgtctttggttgggcttttgaacctgcttttgcagggctcaagctagctgcttctacccaaaagctacttttgttatagtacaaactaaaagcacctcctaccttgcttccagtggcttttaagggaaaaaattacccatctgccattggttatgagaaaacggttcgatttctttcctcccgtccccttcttgcgaccttcacatgcggtgcgcagcagtggtgcccctccgactggctggccgccgcctgtacggtgccgcccctgctcgtccccgcccagcgccggcttgcccagggttggggcgcacggaggagaggacggcggcgactccacaccgactccgccgcgcgcgtctgcctacccgccgctgccggcgtgtcgatggccatctctatgtctttctcctcttttttttccctctttttacccctctttttcccttttttccaatgtgcgtatgacatgtggggcccgcttgtaagcggaactagttatttcaaaagtcacaactgttgaacctaacgagctttttcaaaagatatagcccatattccacagctgcttttcgaaaagtcacagcctacggccacttttcaaaagtcacagctcaaccaaacacaccctaagtttgtcacaccctaatttgctaactcaaacacagcctaagtcctcaatgcatgtttcgatgtaacatttgttaacaaattttctctaaaaaatttagatgtaaatatagtataatcgtagtataattacattataacttatatggaacttttaaaaatccctccataacactctattcccgtgaaacataggtcgttggaccaaatccctcacccatgccagcactgtaattgttcccttcccgcttgaaggcccgctctggcgttggctcactgtcaactgtcacgccgaggtgccgtggtggaagtcgacgctttgctgggggtgacaactggtttatcgtccagggtcactgtgcccgaggcgtagccatagatctcctccaagtgcacgtacatgcagtacttcactgcgtgctgcgaacgctcctgcggcctctctcggacaccgtcacagtcagtgtggagcacattgccacgcctgctgctagtgaagattatccacacacgtttggggatagaggactggtttagttcctaactttttctttaaatttttaactttttcatcatattaaaacgtttctacacacaaatttttaatattttcgtcacattgtttcaatttcaatcaaactttcaattttaacgtgcaccaaacacacccagagtttgggttgctagtccacgctcgaatattgatccagcgtgtgttggacgaatgaatgaagctcatctcgatgttcttcaatacacatgtgcgcgctacagtcagcctttcaggcatgatgcggaacaccgtcaaggtagagatggacgcaaaacatcaaggcgatgctgaggacgctcttgtgccacttgaaaagaatgaagctcaagcccacggcgcttgggaaccccttcttgagcgcctcagcatggcgccgccggtgctcaaactttattaggaaagattttgggtggtgttggagatcactgcctcgcatttccttaggtggagcacctccacaaacattgcttttatgtcctttgctgttgttgacgccgaagccttgaccacccagatgatgatgaccatggactcccattctttcagctca

SEQ ID NO: 48486 - DNA, 5879 bp, Oryza sativa
gtcattgccaaaatcgagagcagacaactcagggatcacatgattcttgttcttgaatgcataacacaagacaactcagggatcaaatgattcttgttcttgaatgcataacacaatactattaaattcctacaaggtacatgttatctgcttaaatgtcatgcgtggatattccatggccgttaaaattcacgttcatatggattaaatagtgtggcacataattctgccgagcacacatctcttctagatagtttgtttatcgggccaactatcgttctatctcaaacatggttggtacaagtccaacttttatcacaaaagaaagagtaaattgcattagcggtacataaacttgttagttacgtgcaatgtagtgtataaacttgtaaaatgctcgttttggtgcatgaacttgtctggtacatgcaaactaagactaaaatggcacgacaagaccgatttttatatgttaaacattataaattacaaattagtagatgacttgcgtgtacatagtagaaaggttatgaattggggcctaaaattgctaggtatgacccttacaaatcagcatacatgtcaaaccaggggaaccatggactcttcacaggtatactgaccattatttctaccttactagttagtacacaatcacaagccaatgagcttgcaaacatagacttcagcacgacactaccaggccaaatctctgttgtctagctcaactctcaccggaagaatgtgcattcctcaagagccctccaggttgagtatctgaatcattgcagccgagatagaaaagcaactagctctttcagccatggtcgatgcagcaactcaagatcaatcgtacacgcaatagcagggaaaataaggaaatttaaagtgaagagatatgaattttatttttcagggaacaatctgtgtaccacaaatatcaaaagaatagacaagagtaattaatcttaaaatagtttggaacaagagcattctaatcttctagctgaacttacaaatttagtttttctgggagctcccccaaccagcagggagtgtatgggagagatgatcgtaccagtttgtcgttgtgcatgtatggagcatgatgaataaaaatttttgtaaaaacattgcccaaatccagaagctttgagctactccaattataggctagcactctgtcaaatttatcaccaaagaaaatcatagccctgtctagttcgcgaaaagaaaatttttaactgtcacatcagacgtttaaccagatattagaaggggttttcggacacaaatgaaaaaaaataatttcataactcgcttagaaaccgcgagacgaatttattaagcctaattaatccatcattagcacatatgggttactgtagcacttatggctaatcatggactaattaggcttaaaagattcgtctcgcaatttccatgtaaactgtgcaattaatttttctttttatctatgtttaatgctctatgcatatgtccaaatattcgatgtgatgtttttgggaaaaaaattgagaactaaacaaggcccatatctttgtaaggatgaaatgcaaggaaatagacatagcaatccttgcgcagttgcgcctacttccaggttcaagaacattatcactgtcagagtcccacccgaatttctcaaatttctcttccactattggctcgtcttccacatagtaatcatcatcatcataataaaaaggcttataattataagagtgaataataatgttgtaaggcccaaggtccatcacgttgttgttcatcatagttcagattcagtaggatgtgggaaatgtccatgtcatgcttcaacacccactcggtctgaccacaccgttcattcaggaaaccaaacctgaagttggggcctcagaaatgatggtaataatgcacagtatatccccttgcttgattttcctagataaaattgaccatctcctggatcttccgtgggcgttctaatcactcgatacgtattgtccgacaatgatattcttcaacaaaagaacagaataacatgatctgaatcacaatgcatgcttaattaattaaggggtggagagttagtacgtatctacctcatgacaaatcaataggagcagcatatataaagtgctcttcgccagtatccacactgatgatcacaaaatggatttgacctggtaacatccctgcagcctccccttccagagcaaatttcctctcctcccaagaaccagtcttggatgaaaacacaggtaggatcaatatatgtccacggcggccattcgcattcctcgcattcttcttcctcgcgcagcttgtaaggaacatgatcggcactatgaacaactcatagttgggcgtaagtgtggggtcgaacaccaggtactcgttttccccatgcctggaggtaggagaggaggaggccgttgcagtggcccttgacgtattaaatggggggcatggcggcggcggaggcggcacggtgtagtaaagtcggcaggacacgtcggcgcccgtggtggggcggtagaggaattgggtgtgaaccgcgagtcgtggcagttgaggaggatgccgcccagcgagagcgggaggaggtccgcgcgcaggaggcggcgggagtcgacgacgagcgcggcgccactccttgcaggcgcagcgggacgctgcgcgaggccacgcggcgggaggcggcggaggacggccgcgagcacgtcgtcaggcagcgacgacgccacatccatcgcctcagcacgtcgtcgtcgcttgactatcgcggcaaattggggaattctttttcgccaatgcagttgatttgggctcaaccgctcaagccgcgggaggtggtcgtggctcgttgccaagtagtgtcgctgccagttaacgggccggcccattaggctttctttttttccattttaaaacgattttccaatcatatattgcgagatttcatcagaacatggatttgtattcagtttttaaacaagtttaaatgaagtatttgtggggtactccctcggtcccaaaaaaaccaatcttaggtacgaacctgaacgcacgtatgttcatattcatatctaggattgagttttttctgggacacaaagtgtacacggtaccccggatatctcatagcaagccttattctagcaaatactgggatactacatctcgatgattccgaatatcttcgggcttgttcactttgctactattttcaaccttaccaagttttggtattgtcaaattttggtaatgttgccaaaattttggcaaggttgttaaattttagcaagatttcatatgtacgtactaaaatttggcaacaaactaaatgcaaccacttttttttaactttgccaaaaaaaagataaggttgaaaatggtagcaaagtgaataagcccttctagatatagaataggagaatttagttgcaaccgactagataaccttctttttaatccttcctatcatcttacataagagggggcagagtcccgagattggggtgactccagacgatagatacaacacatcataatggcgccatgttcatcatacacaaacccttaggcacaagataatcccatatactgatacacaactagattagagtattacctcaaggtttatgtgtcgctatcgttatgtagatccaacacataacaatataaataatattgttgatccagataatcgacggtattgtactaaaatactgtaatgccacgagtttgctcggataggacatgaacccatgcggatgagagcttgcaggccgcgacaacacattctctctgaacgaagttgccacaacttcgtgccatccccctgtgaagtcgaggtgaggtccgggttcgctgtttacccacgagatgtggtgacgacatcacaaacacatcacgtgaattcaccttactaatatatcatggtgtccttttggtttattctatattatttacacttgaatattgtatatattagcattgctataattgtggtgtttacaatttattttagtcggaccacctatacactaaatcctagatataccattggatacaagtatttctactccctaaatagttagtcttactagcatacttttttaacctcttggttcaaactaagatgtgagatgttttctgccagacaacatggtgttaggaattttgatgtctcgatttggaaatcgggaggagatcgtgccaaagaccatttccatccgttgtctatgcgcaatcaccgcgattaaattcgtgttaaaatcttccttaactacacactacgatcggtggtgccatatcctttccttttggagctgcccccaattccctcgataccaaaataaaaggggaggccagacaaaaaacgaggtgaagatctctatcttgctgccacactaaaccctaatcccgatctgaacaagtgctagaggggggaacgtgtgtccaaccttggtcgatgcaagtggaggccgaaggaacgctgtcacgtcacatcccatcaccggcgaccccttcgggatcaagccggcgatttggtatgtgctgctactacgactactttgtctacaccgacaaacaccggagcggcttgaggggcttcaacctcttcttccacatcggtcatcaccgagcaaatcatgaacatcgtgctaatggcttctcaaggtacacataaagttttacctctatctttcgcatagggtgatcatgctaggctaaagaattagattagtagattagataatttacacaaggttcgacttatcaggtatcaattttctgattgactttcgtgctttggtgagtcatttgagattcctttgatgacctatgttatgttgaagggatttctggtgatatagttcgattgttgtctccaatgactatatttctatttcccacacgagatagcatgatatctaatatttgtaacacgtcatcgcttcatatatattaactattattctaccaaaatactctaaagtttagagtacttagtccaaaagaacacatgatgagcggggcatactcaccgcagccataaggcatcaaaaatacaaaacccaaccaaagctgacgcttgaacaagacataagtggaattatgttttgttgccaaccaatcatacccaaagtcacgcctagttggataactccaataaaaaaggaaaaaaaagcaacgctcaaatcagggataaacttaaaagcaattcccgaaatggaaatacatttttaccatttcggatgtaaaatgataacaaaatcctgctcatcaacccctttcaaaaaagatttataccaccaacacagaaaagttaggtgtagaactcagctttcacaagcactcctcttctatcatttttcccccaaacaccatagcttgacttatgtggttatagtacgattattgtctctaatatgtagatttataatcttcacaagagatggcctgatatcgatatagctaatattttgatataactaatatttacacttacagaacttcatatatattagtttttccactaaaaatactttaaacgcttggttcaaaagaacacacatgacacacaatggcgtgactcactacagctatgaggcaacaaaacccagccaaaagctgacgtttgaaccaagagaaaacctggaaacaagtgaccaacgcaatgcctagctggaaaaggccagcaaaaaaaggaaacgacaacggttggaatttggaccaattttagaagcaattcgtcaaacggagcaaaacctgaccaatttggatgtaaacgaaaacaaaaccccgctcatcaaccccttccaaaaaaaaaaaaaactcctaccgtttttaaccaaaaatcctcc

SEQ ID NO: 48487 - DNA, 1452 bp, Oryza sativa
gttggggaatgatggattaccccgcggattcgggggttttagggaggaatttgattttaggaggggttttgtttagcaaatccgttctgtttgtgctggttgatgtgtgatttaggggcaaattctaggcgtgagggatttgtcgctggattagccagcgaaatcctgtctactgttacggttcccctgttttttctcacttggtaggacgggacggggcgtgtcctggtggaggttgggattaatccatctgttgcctcggggaccgtgccttccactatccccggatattttggtcgtgtttttttaatttcgcttcacaaagtggggtttctgatgtgcgctctggagattcatcttggtgctggaatcgccgattcgaggctgcttcggcgtgcttagcttcgtctgagggctgaggccaacccagatttggggctgcttcgctatgcttcgccgcgccgccgccaacgctgcctatttgtagtcctactaatcttcgtatggtatgttatgtaagtatgttgtggggtttagaagattgttttgatgaagtgtggtttggtgctgtttggctgagttattaatcttgttgccatgaatctgtccgacgtcctctttaatagtagtgttgagtcgctttccccaaaatagtcaacttctaggttagttaactagatattttccccatctgataattattctggcgttaactgcaaagcaggggtagcgaatctgtgggtggattttttatcttcatcaacaattgttcgcggcccttggtacaccgccgccaacgattggccgcagctggtaaccttgttcatcaatctacaaggtatttctgtgatggattcactttctatttatagcaaatgagttttgagtgatttatgttgctatattgtgctgatgtggtgattttgggtttgcgattagtgggttgttgagatgctgggcgccttatttgctacctacagttgtgcaacagtagaaccaaacgttgtctacagcaattcgttttagagtttcttgttggtattaattggttgaatgtgatagcatggtttggaacattggactttttttgtggttgtttctgccactacctttctctgtgtgtttactgtattcagtagtgctcacttgttttccctgctttcctatcttatggtggaccaattttaatcaaactttggggttatcttaaggtcagtgatgttttaggaaaaatcactaccttaccgttggttggctcaatatgcgtacttatctatccattcttcattatcagtttttgtaatctgctggcttttgtgtttgtgaactaaattgtgaatgggaatatttttgtattagtgagtacatgattcattgatttggatgtgggttttcttgacatgggtgtgtcatgacctacttgctgtcatttctagatgattctacacaatt

SEQ ID NO: 48488 - DNA, 1334 bp, Oryza sativa
ttcttgccactgatggggtagagatcttggcttggcagttcattggttggatctagcgatgagatcatgctgagacataatcttgaactccgatacctcttctcagggtgaagacctttgttcttaccatcattagttggagctggcctaattgatattcccttctaaaggcatcgaaataggagaattggcccatgggagcagaggtgaaaaccttcgatctaattttcactgattagatctagcaacgatgatgcgagccgtgtcccttcttggaggtgttgtcatcaatactaaagccccaaggacctctttcaactgttgtcctcttgtggttggtcgcctaatggtggtgatggcgggtctacgtttcttttttcttgaccagtcttagcattgacaagtattgtgacgttatgtttttttctggtcttggttgtgtgcaatcctagttgatgtagatgttggaatttacactttcccttatctaaacaacaatgccttgggttgagtggcttattaacaatgggtagcatagtttaatcacatattggcttaagaaatcttttgttaggaaccttggacagccctctgaaaagcattcttattacatacttataaggtaaattaatctcaatgcatgttaccttgttcaaaggaaataaattaacaatagtttggccatcaaaagttccggatctatgcatcaacaaacgggatcgaggtaacactgaatgctattttgaaaggttttaacaaggcagggacaatgttgtccccgtggtcccaggttgttccatgtttccggtgactactttttgttagtttactcatcatctgtatgttaatgcataaatgcggcagccaacagattcggaaagagtttttgccatccttgacaattgcccaaatggccaattggcatgcttcgtgagcatgccatcgatcatgattcctaggatttgtttgacttgtacatgataccataacggtaggttatctatgcgttccaccagcaagtttcccacaaaacatggcattaaatgtgcattatatccaaaacagaataatgaagtcttgttaacttaagaaatgacaggtgttgctattattcacaatgagtgctggaatcgctctaaaagtggattgctaaatttctacttatttgaaaatggcttcttgtcacttgtgccattttgcatttggaaaatgcatattcaccgttggatgtacatcaggaaagcagaatagtaatagtagatatatatgttatttgctgtgatgttgccgcatttaatttctaatgcctatgtttttcaagttcctgatagaaa

SEQ ID NO: 48489 - DNA, 6590 bp, Oryza sativa
tttggatctggttttatgagagaggatgatggaagttgctgttctactgctgaatctgcaaaattgtcttcatcaagtagttctaaccaccaggatgcaggcgtttcattttatctgagccctatcaaggagtgggttatagaatttggtggatcaatgatttgcataaccattcgaactgatgtggcctggtaagtactccagccagatctgttcaatgtggatttttttctattacacaatctttttgttgggaaacaattttccttctgcctgctacattgatgcttacatttggctcgtgatttcaggtataagctacggcaacctacaaagcaatatgctccttggtgtgagcctgtcttgaaaacagccaggctctctgttagcatcataactctactaaaagagcaaagtcgtgcttcaaagctttcctttgctgatgtcatcaagaaagtggctgaatttgataaagggagtcctgcatttgtatcatctaatgttgcactggtcgagagatatattgtggtccatggacagattattcttcagcagttctcagattttccagatgagactatccggcggagtgcatttgctactggtcttttgatgaagatggagcaaagaaggcatacaaagttggtcatgaagaaaaaggttcaagtgatgagaggagagaatctgaacccaagtgcaactatggggccagcatcaagaagaaaagtgatgcgtgcaacaacaaccaggttgattaacaggatatggagtgattactatacacaccatttccctgaagattccaaggatgcagatgtgaatgaagctaaagaaattgatgatgaactggaagaaaatgaagatgaggatgctgaagaggaagcacagattgaggaggaaaatgtctcaaaaactccaccatcaacacggtctcgaaagttggtatcacaaacatgcaaagaaattagatgggaaggtgaagccattggtaaaacaccttctggagaagctctatacaaatgtgcttatgttcgagagctcagaataaatttgggacggacagttgcactagaagatgattcaggagaactggtcatgtgctttgttgagtacagtttcagaaacttaatggagcaaaaatggttcatggaaggctacttcagaaaggttcagagactgttcttggcaatgctgcaaatgaaagggatcttttcttaaccaatgaatgtttagaatttgagttagaagatatcaaagaattgatgtctgtcaatctccaatcattgccctggggtcacaagtatagaaaaaagaatgctgaagctgacaggattgagcgtgccaaagctgaagataggaagaaaaaaggtttgccaatggaatatttatgcaaaagcttgtactggcctgaaaagggtgcatttttctcccttctcatgataaactgggccttggtaatggtttctgtagctcttgtcagcaaaaagagccaaattgtgatgaattgcaaatactatccaagaacagcttcatttacagaaacattacctacaatgtcaatgactatttgtatattagacctgactttttctctcaagaggaggatcgtgcaaccttcaagggagggcgaaatgtgggtctaaagccctatgtagtttgccatctattggatgtccatgaacctgctggatccagaaaaattcatccagcatcaacaaaaatcagtgttagaagattttacagaccagatgacatttcatcagccaaagcttatgtttctgacattagagaggttacattctttgtcctccttttctatgtttaaattctggtgtcatcattaattcattgctgtcattgtttgcaagatatttctccttacattggctttgatactttttctggatcaggtatactatagtgaaaatatagttaaagtgcctgtggatatgatagagggaaaatgtgaggtcaaaaagaagatcgacatctcaaactcagatgttccagtgatggttgaacatgaatttttctgtgaacatttctatgatcctgccactggagcattaaagcaggttagtcaatagctaatgtaccatttttattcagcaatgttagtttccatagttaactgaatgtgtgctgtatatatggaccagttgcctccaaatgttaagctcatgtctgtgcaacaaaaggcaactggcgctttgaaaaagaacaaaggaaagcagatctgtgaaagtgatcaggtggattcagataaatgtacaaaggtgtccaaagagaaccgtcttgcaactcttgacatttttgctggctgtggaggtttatcagaaggactgcagcaagctggtatgcactttccttcaataatggtgtttagctttatcatcaacatgtcggccatcagactgatattttattaccatttaaattctgtaggtgtatcgtttacaaagtgggcgattgaatatgaggaaccagctggtgaagcatttaccaaaaatcatccagaagctgcggtgtttgtggataactgcaatgtgattttgaagtaggtgcaccgtgcacttccttgattttttctgtggttttctttttacctatatagctcaatagggactgttatatgattttgcagggcaattatggacaaatgtggagatgctgatgattgcatttcaacttctgaggctgctgaacaagcagctaaattttctcaggacaatattatgaaccttcctgtccctggtgaagtagaattcataaatggtggtcctccatgtcaggtatattattttgctatacttgatggaattttctttgcacctaggcaagcaaattgtttgcacttcaatacttgtgataaatgacttcaattttgtaatttttttctcaactcagggcttttctgggatgaacagatttaaccaaagcccatggagtaaagttcaatgtgagatgattttagcattcctgtcttttgctgaatatttccgccccagattctttcttttagaaaatgttaggaactttgtttcattcaacaaaggacagacatttcgactgacagttgcatcccttctggagatgggataccaggtaattattcttctggttatacatacttaaaatgcctatgtacagcatttgttttgaatcttataataaccagaagctgtttacttgttgcttaggtccggtttggaattttagaggcagggacttttggtgttgctcagtccaggaaaagagcattcatttgggctgctgcacctggagagactctgcctgattggccagaaccaatgcatgtgtttgctagccctgagctgaaaataaatttgcctgatggtaaatactatgcagctgcaaaaagcactgctggtggtgctcctttccgtgcaataacagttagagatacaataggcgatttaccaaaggtggagaatggcgccagtaaactcctacttgaggtaaaattgcttctcctatatggctatccgctccattttatcctgtttcttctcttgatttatatgctgaatgaatcccctcttttgtaatgcagtacggtggcgaacccatctcctggttccagaagaagattagagggaacacgatcgcgctgaatgatcacatatctaaggagatgaatgaactaacctcatcagatgccaacgcattccaaagcggcctggttgtgattggcatgacctaccagatgagaaggtaaatgccatctaccttgcggttgcattcactttcttttgtgctcttccatacattccttgcatcagcggaatgttaaccattatgagcgtgtgcaggtgaaactatcatctggccaactggtggacctgaaaatgatcccttggtgcctgcctaacacagctaaaaggcacaaccagtggaaagggctttatggtaggctggattgggagggcaatttccctacttctgtgacagacccccagccaatgggcaaggttggcatgtgcttccaccctgaccaggataggatcatcacagtccgtgaatgtgcgcgatctcaggtaagctgctattgctatccatccattcaacattctcttcctgtcttctaagatattgtgaatttggaggggagtcagtactgaccgtttaactaacctattcttgtctgcagggctttcctgacaactaccagttcgcgggcaacatccagagcaagcacaggcagattggcaatgcggtgcctccacctcttgccttcgccctcgggaggaaactgaaggaagctgttgatgcaaagcgtcagtaggtgctcagagtccttctccgatgatcgagggagatgattctcccctgaaaagaaacaaacaaccaaacatatgagtgtacttattttaattgtgcgctgcatttaactttgtgtgttgattaagattttagtcatatagatccttggtaaccttgtacattttagaggttgtgttgtgattgatacccttgattcaggggtatgatttagtggctgtattcagatatttaaacaaaataatactagttagtgatggttgaattgttaccgtgggttatctggaaattcttgttttggtttgttcaggtctctaaaattttatttcagtttagtttggattttaagaattgaggtatattctcatttggctggatgcagtggaatctagggatttccatgggtcatggggtgaaggttttacttttgcatgaaactagaaagctagcccgcgcgaatacgcgggcatgcattttatttagttttgaaaatagttctaacaaaataagttgaaactaaagtaaggtatttttttaattgaattttcattgtttacatttttcttaagaagtctcgagaaatttttattgcttgtaaatttattcttttaccatccctgttagccctctttttaattgatgaaatatacatatcttatatagcgcttctcagtaatatgttagaccttatggtattttaaagaaaatgtctagtcaacatgaatcttaaaataataatttattatggaaaaatataacttttaatcatattataataagaaaggatactaatttgtattaccaccttagaggcttatacatgtaggttgtggagaaacccttggagctacttaaaggataggaatttactgaatttgaatttgttgatttatcattgactttcatctcttggtgtgtttaatatgactcatatgaagagaaatataaaattttggaaagaataaaatatcattatgttgtaaaataagctatgtttttctgtaacgaaagtagtagatttattcaatactatcttacgggttaagtgctcaactaaaatagttgtatacgttacataacaggttaagcacttcactaaaatagttctttgtaaatggattgcaaaagttattttcaaagatgacccatgagtctgaggcaaaaggctcgccacatagcaagctacacatttgagccacatgtgaaaagaatgctcacaaacaatcatttgtgcagtagtgtgattaaaataattatttatacaattaaaatgtttaaattcactatgtaaattaatggtacttgtgcccatattattgtttgccaacaatcgatagaacttgatagttcttttcggtatatagcaaaattagctagatattttacaactaattattgtatttcgttgctgagatgcacatgctattttttttctttatgttgcagtttcttattgttgatgaactgatgcctgggtgcatttgacactatacatattccaaataaaaaagtctagcggaatctaaattgatttcggattgtttcttgcatagtgcatgagacttcacataccccacgaatataatttcataactaaaaataactcggcaagcgtgattattattgtagtttggacttttcatgattgccgtcatgatttaaatatttttactctaaaatttataattaaacattaggaatttatatgctccaaacaatcactctttgtaactttcttttagctaacgtgcattaggaatttagtattacaattatgggtaaagtgttacccttaaattcattatattttagccacaacaaaaaggttaaaaatcctgacggccttaagagtataaatgtattagaattttgttttttcttcctcccaatatataatgaatttgaatataagaccttacatatagatataatactactaaaagtacaaacaaaaaaaattccataatttttgggatatataactaaaacattatatgttctcaaataactgatagtaaaaaaattgttgttagacttgatactgagatttgtgacaaatgaagtgattattaagaatatggttacatgtggcagttttttttgtaattaatatataggtaatatcgatgctatatatattatttatagaatagatacatcatatgttttataaagttttaaatagtgaataactgaagaaaataaggggggtaaggatagatcgctttgtaggtgattttttttctttggcaaatagtgggtaggtaattttccttacgtacatatat

SEQ ID NO: 48490 - DNA, 2104 bp, Oryza sativa
ggatggattaattgtacgtaaatattttctctcgtacgtgaacaggatattaggagtgagagactattttctttatagatctaataatttattggtctaaaataatgggtccaccactttaaatgaaaatcaaggttacatgttttacttttttttaagaatttctatgattattttctaatttattatagcgccacgtggtggcatagaagcgattgtagattgccacatggtgacttgagagcgtttataggaagttttatggacttttagtatataatagatagatgaatggctgataaatacagtttttaattggtttgccctcgtatgagggttgcttttactctggtgagaaagatcaaccaaatttcaaactcacgacatctaacttagatgccgtattgagttggagtactcagtatagtgtgtttgggatttcttcaaaatctgaatatctgattttttttttaaaaaaatgttgttctccgcatgtagtataactttgtttgttccatggtgaaaagttttggcgtgtcacatcggatacgcggacacacatttgaagtattaaacgtagattaataacaaaacaaattacaaaatttgcacgtaaagtgcgagatgaatctattaagtctaattaatcgccattagcaaatatttactgtagcaccaccttgtcaaatcatggagcaattatgcttaaaagattcatctcgtaaattagtcgtaatctgtgcgattagttattttttaacatatatttaatatttcatacatttgttcaaacgttcaatgtgacagggtgtaaaatttttgggtgaaaactaaacagagcctcgatatgcctcaacaaaatgtaatgcattcccgtatcccacacataacaactgggtttttattttacctattcatataagcttcatgacaatgattttcttttcagcggttacaaaacaatcttgccaggtaatgctaatgccatctcttcaccaaatgtgaaacgatatgttgcctagtaattgcagtgacttgagtagcacaccaaggtcttgagttcaaatctccatagaagtgaatttcagattgagttatttgagggctagttccttgttcgataggctaagttcctattaaaaaaatgctgcatatatccgattggatatagagaccgggtaaaaaataccattctctaaaaaaaaatctcttcactaaatgagtgcagtgccttgctttgtgtttgccaattgaagttagcaacgctaccccattgcacaaaacgaggcgacggtttaacgtataattaattaagtatttaagtagtagtgaaaaacttaaaaaaatggaataataataatatggtttttaaaacaattttattaaaaaaatatagcgtttaacaatttaagaagcggcgaaaaatataagaggtgaagtgaggaaaacagagtaaagaacacagtcaaaccaagaaaattctatcaagcctagcatatatccagacacatgcgcagcgtgttcgtgtctaccaagtcgatatctgcggagccacacgaaccactctctgtacacagttacacagcctacccgcctagaactacaagtaaagtatctctatataaggcaatgaacgcgccgccgtcaacaacattccatttccagaacctccctgctcccgtgcgccgcgcgttccaccaaccccgctcacctccatctccaatggcggccgagccggccgatctgtacgtggaggtggaggagtccgcccgcgacgacgacgtcgacgtcgacggccgttcccgcgtccccgtccccgtcccctccccctccggctgggagctcccgccgtgccccgtcctgcgcaacgtcttccgccgcctcccccgcaacccggacttcgacggcgccaccttcctctccaagccatggctcgagctcccctgcgacgggcccatggtgatcgccgagccgcagcggctcatgccggcgctgctgctcccggaggggatggcgctcgacccggcctcccgcgccttcctaagcctcgccgacgggcgccgccatgacatcgcgttcccccacgcccgcggcgcgcgctgcg

SEQ ID NO: 48491 - DNA, 7102 bp, Oryza sativa
gtggtgcaccacaagggcagcttctacgcggcgtgctacgacggcatggtgctgcgcgtgtccatcccgccgcccggcagcgcgtcgccccctcgggtcgacaagttcgcggacgcgccacgcagggagagcatccggtgggcgcggtggtggctcgccgtggacaccgcatcctcctccgccggcggcggcgcgctggtgctcgtcgcgaccgaacggcgctggtggaagcagaagatgtacatgtgcgcgttccggtgggacgacgagctgcggttctggcgccgccccaaggacttgggcgggcgggcggtgttcgtcgggcgcggcacggcgttcgtcgccgacgcgcggcacctgccgtggtgcgccggcaactgcatctacttcacccgcgacgagcgggtgcgcaccggcgacgacgtgccggtgcggtgctgcgacgtgcgccgccagaagctctactccgtccacaatgcggggcccaaggtggcgatggccccacctgtctgggtcatgccgttccatgaatagcgcagagattttgcatcagagagatcataggtactatgtggattgtggtgatgcttgatgtaaattctctctttgagacttttggctgaatttcgtacgaactacgtgtatgtttgtcataggaattgcagattttagatcgcatttctggagtaaatttcctgcaaactgtaggcaagttgttatagcaattgaggaattctggatattgagaacttcgtgtgcctgtgcaacttgatagtactatgcattgagctgacacatttaagccggttctgaatcttctgtgaattttgctctgttttctcaccttttatacatgctagtttttcatatttgaagatgtgtaacattgtgttgtgtggcaaaaatatgtggcagttttcattgatacggtggtgatattcactagcctaggtcatattatgcatcttttggtgatgtaaatagtataccacccagttaggtctatgtcaacaaaatgcaatcaaaattattgtggaatactccataatttagtgtgtcgttcatgcgtttctaaaagttgagacaacaaataaccgatttgtctagtttagacaaaaaaaaaagactccaaaaatgtttgatagccaacagtataaattttaccctcaatagagttacctcgactgctaggatgatttcaatacgtatttcatggccctccagttatggtggaccgtcctctcgagtctcggcctcccacattgctttccctctgatgctgtttccttccatgagtggcactactcctgccgactcaaagtttggagggagcgtcgtcgtgggttcaacatggtcgtgacccttggcgcgtggtctatttggaaggaacggaacaaccgcgcgttcaacaactgttctcggccctggttcgaggtggtcgtaggcatgtcacaagaggccgccctttggcatcttgcccatcccctgttgccaacgctttcttcgtagcgtgctaggttgtttggtcatctcattgtaatcgcaagaataggtttaagtcctccttttcttccaacccccctccccctcatttttttgttttgcctaccgtgtaaattttattcctcttaaaaggtgcgcaatctttttgcatattccaaaaaaaatacgtatttcatggggaaaaaaacatggacactaaggaggaacttagagtcgacaatttcgactagagttgagcgtggcatggagattttatttaagaagaaataaatgtggctttgtctatagagttttgtttaaaaaatatgtggcaatatatatgactttaggggaacattccaaagtcatgtgccgatgtatttagcttcttccaacatagtttcatggcaactgctaaatcaaatactacctactcttctccatagccgtatctccttgctctaattgtgcatggttaccaaccaaccgaacatataatatttcttcggattttggagtgggattgcagaactttcaccggaaatggtacaatttgtagacaagacagaaaacattcctgggcttcaacgagaaattgaccacgcctaaatgacttagcgcaaaaatgacgcagcgtaaatcaggtgtacccgtgggacccacacgcagtgacacggttttttctcgaaactgtgcgcctgtgccacaacgccgcgcgacgcactctacacagcgtccgcctatataatgcctggcgcgcaggcgcagctagcccaccaacccatcgtcacccacacaatcgcgcacatccgcaacaacgttaatccgcacccttcattctccgccgcgggcgctgcctcgccaccgcgtgccgaacatacaccaccgcacccacatgttcatctcgcggaccacgtaccgccacaggatgtacccgtaccgcagcctccctccgccaccgcggccagcgtggcccctcgcctgttgccccatttaccaaggaaccaaaaaatacttccaactcagcagtagcctagtatttcctaactcttactcatgtttttcttgtattttaacatacaatccatgtttgtactacgtttaataccacaataattcaaacataaatatttctaatgcatataatttaaccacacttaaattcacaatttcacacaccacaattcaaatccaaaatcaaaattttcaaacatgtaaatacggtgtgagcataatgccatatacaacaacatgcaactaagattcataattcaccaatgaaaatgaaaattgctcaccaacatgtaatttttttttgtctccatatcaccacaataagctatgtgaatccggtgatgtattatataatttaaaaataacacattctacaaccatgaatggttcgatcgtaaaaataacacatcttacaagaatgaatggtttaggggctgtgtttaggtcctgctagagatgctcttaaccataactccataaacaagtatgaattgcagtaatgcaaattggacccaatagagtgacagtgtgtcagtgtgactggcaaccaatcttgtggcatcgataagtggatcaattagcctattcaagtttgtttctcaatcttcattgcaagcaaagacatgaatgtcaatgagacagtagccgtggaaaagttcagtgaatataccttgggaagtttatcaaaatttcacataaatgtatgtgtgatttcactacttcagggtcctcgcctacaaccattttggttgtggccaccgaccagcaattcgaagtgtgatttgaagcatcggccgcaccatgaaaccaccactacgactactgatggcttgctgagttgttagccctgtgatccatctcgaggatttacaatgcgaaacgcggagccacgactcgggataattggtgcggatgaagaagaagaggatgccattgtctgaagttgcagcgccaacgatggagcagacgtggtggcatctccggcgtgcgcagtcgatgtggttgctgctgccgcctcctcatcagaaccctgtggtggaagagcgagctgaacgggttggacttgccaagaattaactcgtctgttcatcgtgggagcgagcggggagtcacgatcccagtcaacctgcagatcgatcgagatatacatgcaatcagattgatcgatcgatcgatcaaacagcaacccagcagcatgtcgaatcctggaaaatggtgatcaaagaactgaagaacaattgattttgtcaggcaattatacctcgagcatgcgccactcgctccggcaatggacgtccctgacggtgccgtacaccggtggctggctgcggcggcgcgcgtcgtcggggttcatcagtaagcgcaccctcgtccccggagcgagcggcggcgagccttccacctcctcgcggcgcaccacgaactccgccgtgccctgccatgggcagtaggtcaccctgaacggttgggcggacgacgcgtcgagccaggcgtccgccacgtgcttgtcggggatcccgaccggcatgccgccgtgcggcttgcggcgcaccccgacgagcggctcgccgccggggcggcggcgcatgaagatcacggtgtccccgacgcagaggcgcttggccttgacgaacgcgctccagccggcggcgagcgtgtgggaggaggagcggcggtccgtgtcggcgtcgctccaggtgtggccgaactcccagcggccgccttgcaggttcgtcacgcggaggtccgggatccgcggaaggacgtgctcggcggcgctgggcttggggatcacgaagagggcgccgctgccgccgccgttcgccgcggcgtcgctcggcgacagcttcttgtcgaagaagcagaactcccgctggcctccgacggggtcgcgcgcggcgggaagcgggcggtgcgtgacgtagcagtcgcccggaaagagggaaatcatggcgtaggaatcatcggactgggcgtcgacagcgaatcgatgccggtgacggtgcagcgtaagcgatggcggttgtccgggatcaggcacgtcgtgcaggtgtggcattgctcggcgtggccttgggggaagtagtagaccgccgagccgacgacggggaggcggccggagtacggcgtggcgcaggcgagccagatgtcgtggtcgatgaccggcaccattcccgtcgtcgtcgtcggcggcggcggcctcggcagcgccattatctgaacttgcggggtggcaacaatggcatcccgaattcgcacagccgaagtagttgctgctggctgaggctgacgcaggacttgccaagaattaacttgtctgtgtatcctgtaggagatcggggaggccgcttgatcccaatcaacctgcacacatgcaccgatcgagcaatttcagatcaacgatcgatcaatcatctcaacatgcaacgatcgaattgatcgatgaacaaatcagattgggtaggaaggggatgatgagatgatgaaattaatacctcgagcatgcgccatgggcgtagatggtcgaaggtcctgacggtgcccgaaatcgattgggcgatctgcagcgggttcatccgcaagtgcaccgtcgtcccgggaacgaaagggtagaacggcgagaaggagaagccgatgtactcgtcgcgcgacaccacgaactcgaatgtgccctcccgtgggtagtaggtcacctcgaacggcgtcacgccctgcatcgccagccacacctcggacaccaccttgttgtcttcgaccccgggcctcgggtggtggccgccgcgcgcgcggggcgcgcgccgcaccccgacaagcagctcgccgtcgccgtcgccgtcgccgccgccgcggcgcatgaagaccacggtgtccctggtggcgaggcgcttggctttgacgaaccctctccagccgtcgttgacgatgacgccgaggtcgccgagcatgtagcggcagcgcttcttgtcccagatgtgcacgaactcgaagcgcttgcctcgcaggtccctcacgtcgaagagccgggcggtctggtaggcggcgatgtcgagcggcggaaggacgtgctcggcgccggcggggaggacgagggcgttgctggtgacgtcggccggcgacagctgcttctcgaagaagcggaaccccggctcgccgtgggcggggacctggcgccgcgcggtcgtgtcgtcgtggctgcctggaaggagggagatggtggcgtacgcctcgccgctctcggcgtcgacgtcgaggacgaggtcggcaacggtgcagggcacggggtggatggggtccggaaggcgggagagcagcagcgcgggatcctcggcgcactgttcgatgtggccatgggggatgtagtagaccagtgtgccgacgccggggaggacgccggagtacgggacggcgcaggcgtgccagacatcccggtcgatgactaccggcggcgggacggcggcggcggcggcggcgtcaggcggctgcgccattgttcgatctcctccacgggaggtagtggaagtggtggaaatgtgttgaattcgaaattcgaattgacgccagcagatggggtttatatatacacgccacgccgccacctccacttcgttaacccttctcctttcgtcttgctaattacagtgattaatccgttattacatgtttctttcttgtcggctacgttttaaatgaccagttagttacaggcttacagctagccagcgtccacttgcacggttttttactgttatttcttttcgttttttctttttttttgcttgggttacctctctgcaaggaaaaatatcagtaaaaaaaatcgtctacattgttctggacggaggaggccagggttcaaaattttagaaatatcgaaccccgatatgatatttatttcggcagaaaattttaatgtttttaattttttcatgaattttaacaatatttgttcaaatgtgactaaatttcgttcaaaatatcggaccgaaattttgaacatatcgtcatatcagcgtcccgatacaaatacccacttgatataggaaacagtaaccgtcacctcgcctcgcctcaaacctcaattcgacaaatccatctcccgctccacccaaaacccctcgtcctctctcccggcgacaatggcggcggcggcggcgccgctcgccgacgacggcgacgggatcgtagaccgtgacatgtggctcgcatgcgccgccccgaactccggccgcctccccgccgtcggctcggtggtcttctacttcgtcgacggccacgccgctcagttttgccagttccccgcccctctcctggagcagctcgccgtccccggcccccgcgtcttcctctgtacggtggccgccgtccgcctccgcgccgacgccctcaccaatgaggcctacgccgagatcaccctcgacccggtcgccgaccacgacgtcccgcgcctggcccccgctcccgctcccgcacccgccgccgacgccggtggccagcagttgcgttacttcgtcaagacgctgatgattgccgacttcgacttcgcatccgcttctccgcccccatggctgacgccaaaggcgtcttcccgcccgtggtcgacgccaaa

SEQ ID NO: 48492 - DNA, 7673 bp, Oryza sativa
attcctgcagcccaggcctccgaccccgccccaggcggccgtgcaggaggcggtactagccgcggcgggtcacgcggcggccggcgagcggttcacggtggcgtaccggtcgcggaaggacggcgacgagttcgtcgtgccacgcgaggcggtggaggaggggctccgcgccagactcacctcgctggcggaggtggagtttgtgtgggccgtcgaggacggcgcgccgcccatcgtcgggccacggggcaaggtcaccgccattgccaccggacagctgtggcgaaatctcgaggtaatccattcttgacagcttcctgacatccatgccaatgaattttcattttgtttgtttgattgttttttgtccctcatcagcacagcatcatcatcgatttcgttcttgcatgcccagtgttactgttttgttcatgcaggattgatcactaccgcgtgattgattattactcaataattgcattgatatggattctactctgctcgttgtgcacatcttcagattgtatgggatggaaactcggagatggacatgagtgccaacttttggcaagttcgacctgttgaggaagttgatatttctccttctactcctcctccgaagaggctcaagaattgtgagattgatgataccgcctctacttctgtttccgtcgacaatggagatgagcaagttccaacgatgaggcaacggctagaggcgctgattcctgataacatctgaggccaagtacacctgcttgtgactaactcaagtaaaaattagttctgtcacttgcgagttgtgactttgtgagattgggtccgtcatgaatcagctttggtctgcatttagtttgaaggttattccgaatagtttcaaaattcggggaacaagtttgcagtgttaaatgtccattctaaatctgacggaattggaaaatggtgtacctgaaatctgatatctgaagaacacgaacagttcagatcgagatgacataacgacaattttatctgttagttacgactaatatctcaaggctgcttcctgcactgaacttaaaattcatagaatgcagtcaaatcctgtcaggtttttggacgccgacaattctgatgatcatagatcagctaatggttcaattcacgttgctagtgaaaacaaccaaattgcgtaaagccttggctaatgctgtagtttagcagatggtttgggacttgggacagtcactgctcaaggactaggttcagagttgagacttgagaccaataatctatgttccgttgttacaaaaaaccgttgcaaggacggcaatctgaaacttgttgccggttgagattgagtggagctgtttgacaatacgtttaactgggcatcagcttcagacacagacgcagttacaagcctctgtctgaatggatgctactggtggttccgactgacattttacattggtgaaattattgtttgatccattgtgcattactgctggaaaatgacttatctttgctaaaaatccagtgaaatagaacaaatcaactcaaacctgaactttctgaaaattcagactcgatatctgaattctgaactgtttttagataaaaaaacaaatttaactatggttatacgttaactagttgttgtttaatttgttttttcttgcgagatgtacaaattgaatttaaacttgtatatttataaagtgatatatcacatgttaatatatcttctcaatttcttttaaacttttttttttgactatttcaatggcatgcaagcaacgaagatacatccgtgcagggatcgaaatagttccccaacgccgccgcctccacttcgttaatccttttctcctttcgtcttagtaattacagtgattaatccgttcttacatgtttctttcttgtcggcttacgttttactagttgggctagttagttacagctagctagggtccacttgcacagtttattactgatagtatttctttcctttttttttttttgcttgggttaactctgcaacgaaacgtctacaaattctggacggacgaggcggcggccggcggcgacagtataaaaccccaccgcccccacccacttgcaagcgagaacaaacagtaaccaacgcctcgcctcgcctcaaacctcaattcgacaaatccatctcccgctgccccccccccccagttcctcggcctctcccggcgacaatggcggcggcggcggcggcgctcgccgacgacggcgacgggatcgtagaccgtgccatgtggctcgcatgcgccgccccgaactccggccgcctccccgccgtcggctcgatggtcttctacttcgtcgacggccacgcagagcagttttgccagttccccgcacctctcctggagcagctcgccgtccccggcccccgcgtcttcctctgtacggtggccgccgtccgcctccgcgccgacgccctcaccaatgaggcctacgccgacatcaccctcgacccggtcgccgaccacgacgtcccgcgcctgctccccgctcccgctcccgccgccgccgccggtggccagcagcagcagttgcgttacttcgtcaagacgctgatgtcttccgatgccgagtaccgagaccgcttcgccgtccccatggatgttgccaaggacgtcttcccgccgctggtcgacgccaaagcggtccagcccctcatcgtcaaggaccttcaaggatctccgatgacgttcgactacggcaggaacggcaacagggtcacgctcgccaaggtctggaagaaatttcgggacgacatggacttcgtcgacggagacagcgtcatcttcatgcgtcgccgcgacgacgacgagctgtacgtcggggtgcggcgccagcgcacgctcgacaagccactcaggacgcgccgatccaggcctccgacaccgcttccggtggccgtgcaggaggtgatagctgcagcgggtcgcgcggcggccggcgagcagttcactgcgacgtaccgctcgcggcaggacggcgacgagttcgtcgtgccacgcgaggtggtggaggaggggctccgcctccgctccagattcactcccgagatggaggtggagtttgtttgggcccttgaggatggcgcgccgcccagcgtcgggccacatggcaagatcaccgccatccacgacactacatggatgtggcgatcagtcgaggtatcctgacatcgattaattcccctgattctcatccgccatgccaatgtttttgaagttttcttgtctgatttcgttcatactgcagattggatggacgggaggttcagagatgaacaagtacgccaacttctggcaagttcgattggttggttcggacgattttgcttctgctgctcctccccctcctctttctccaaagaggctgaagagttcagaggtagctacggcatctacttcttcatctccctgcaatggatgtctcacacattgatcgacttgtaaacgcacgcacacgttgatcgatgcaacaatgttcactatttggtgaattgatcgatgcaatgttcaatcgcttttcaggatcatctgcctccaccaaaggcgtcagcgtcagcggcagcggcaaaggcttctccctcttcctccgcgcaggcgcagcagttcagtatcacacgcgagatgtggcgggcatgcgccgcccccaagtctggccgcctccccgctgttggctcatttgtctactacttccctgacggccacgcctagcagtgcccgtcgcgtccaccagagccccttccaggcagggtgtttctatgtaaagtcacagctgtccgcttggatgcaacaagaaatgagctctttgcgaccatgtccctcatcccagtcgccagagaccaagccatccagcctcaggcgcccgctgatccaggtccaagctcccctcaagtgcagactactcttgtttcatttgtgaagcctctcacgtgcaccgatgctgtcaagaatcggtatcggttcatagtgcccaagagagagaccgccatgggtgttctaccccagctccaattgaacgaacacgtgccgctctatatcaaggacatgcacggaaaggagtgggtgattaattatacatggaaagagtacacccacatgctttccagtggctggataaaattcgcgaatgccaaccgccttgtcacaggtgacaacgtagtgtttatgcgcagcatggacagtggcgagagatacatggggctgcgtcgcaccctcaagccggagccagtgtcagttgacgaagtgattgaggccgtatggagggcggcgcgtctcgagccgttcgaggtgacctacctctcgcgccaggacggcgacgagtttgttgtaccgtgtgggattgtacataatgctctacgagcgaagtttaccccaggaatggtggtaaacttcgtatgggctgttgaggaggacaggctgccgaatgttgggccacagggaaaggtcattgccatagagaactatgcaacctcaatctggaggatgattcaggtattactgtattactctgaattttgctgcttgtttaattgcaaatgctttcctaaattgtgccttggatattaggcatcatgagtagttgtaactttgtaccagatctagtgctagcattttgtgtctccactgaaattgttgcattgtccatttttatctgacactgtgctgctcgccaggttgagtggccatcctgtgcaggaatgaacagatatgttaatttttggcaaattcgtgaagttcttggagagagttcctttgaggcatccacttgcattgtgagaagtcaagattactcgccggcaccacagaggaatttagttaatgcgcttcagcttcctgacggaacaaaacagcttcagcaaaacaagaagtctgtttcctcgtcatccaccttccgactctttggcaaaaaaatgacacctggcgtgccaccaagaagagacaccagtggtctttctggacaggtgagctcaacattgcagtaacaaaagtttgcattctcctattgatgatcatggaatttgtaggtatcattattcagccattatcttccccatgatgaggacgatggacaagttccaacgatgaggcaacggctagagacgctgtttcctgataacatctgaggccaaggacacctacctaactaaagatttgctctgtcacttgtgactttgcgagactgggtccgtcatgaatcatctatgccagctttggtctgaatttagtttgaaggttattctgaatagtttcaaaattcggggaacaagtttgcagtgttaaatgtccattctaaatctgacggaattggaaaatggtgtatctgcaatctgatatctgaagaacgcgaacagttcagatcgagatgacataaccgacaatttcatctattagttacaacttacaactaatatctgaaggctgctgcctgcactgaacttaaaatttttacagaatgcagccaaagacctgtcaggttttcggacgacgacaattctgataatcacaaatcaactaatggttgaattcctgttgctagtccaaacgaccaaattgcataaaagccttggctaattctgtagtttagcaaatggtttgggagcagtccctgctcaaggaacttggtgttttgccaggttcagagttgagaccaatatcctctgttccttggaccagtttttcagacatttttacaaaaaccgttgcaaggacgcaatctggaacttgtcgttgccggttgagattgagtggagatgttaaataactgatgacggcatcagcttcaggcacaaacgcagttacaagcctctttgtctgaatgaatgatactggtgtttccgactgacatttttacattggtgaaatggttgatccattgcgctggaaaatgacttatctttgctaaaaaaaacccagtgaaatagaacaaatcaactcaaacatgaacattctgaaaattcagacttgatatctgaattctgaactcaatccaactcatctcggtgtcgacctatataatgccccacgcaacccccagtccgatcgcacatacttttcagcccaccagcccgcacgctggtttctcattatgggcccatcagcccacatgtttgtttctttcttcattatttttggcccaccagtcctttctttttctttttcgcgggtttcggcccactatgtgtacgtgcttcctttccttttttttattttccgaaattttcaactcaaatttgattcaaattgtaaaactttcaaaacagactttgagaacttccaactccaatttcaaaacttttaactcagatcttaaatactttcaactcaaattttaaaaactttcatctcaaatataaaaaaatttcatctcaaaattgaaaactttcatacctaaatccaaaattttcatctcaaattttaaaaacttccaattcaaaattgaaaactttcaactcaaaattcaaaaacttttaactcagatttaaaaactttcatgtcaatattttgaaaactttcaaattgtattttgaaaattttcaagtcaatatttaaaaaattttaactcaaaatttcaaaagcaattatttttatttttattgagagattactgtagcattcgctaatagctatgattagcactaatcgttgggattagcgacgtcgcgtcatttcgctaagcggaggccgcgtgcgcgcgacttaagatactcgcgcgtgcgcgcgagctatctatcccccgcgcagtcacgcaggcgcagcgccgcaacaacattccacgctcttccttcaactcatttcgctgcgccgctcgtggtggaatgtgggcgaaggcgtcggatctgtattgtgaggaggccgaccgcgacgacgacgacggactcgccgccatcctccacgacgcctgggagctccccacgcgccccgtcctgcgcaacgtcttccgccgcctcccgcgcaacacggacttcgacggcgccaccttcctctccaagccatggcttgcgctcgccgtggacgggcacaacgtcgtcgccgacgggcgcttccacgacatcgccttcccccacgaccgcggcgcgcgctgcgtcgggagctcccgtggatggctcgtgagggggcaagggagtcgccggcgccgcgggcaccgccaccatccatgattccatgtcgtccacccgctgcttccgcacctcaagttccgcctccccgacgagttctccctcttcgagatccatgccgccgcggacgagaggagcactgcgattgccactctcgaaggaggcgcgcctccgtgccggcctccccctggaggagacggacgccgagatgctgcagtgcgtgtacaagcccgacaaggagaactgcccctacatcaccatggtcacgctctcgtgcagccccgccggctccaacgacgacgactgcgtcgcgctctgcgtctaccgccgcggccgctgcctcgccatcgcgcgccccggggacgcgttgtggacgcgcgtcgaggtgggctgggagtacatggtctcaacggcaagtacgtcagcatggtccacctcaacggcggcttctacgcggcgtgctacgacggcacggtgctgtgcgtctccatcccaccggcgggcagcagctgttgagatt

SEQ ID NO: 48493 - DNA, 8579 bp, Oryza sativa
ccagatttttcggaacgtttccaaaacaaaaacgaatccgaatttgcagcaaaacaaaactgcaaaaggaggctgcatctgcgcaagggtgagaagccaattttttggaccattcgacgcgtacgtcgtgcacgcgcgccgcttgccctgccctgccaggcgaggcgaggcgagcgagcgcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagacgaattaaggttgaacatccacctagaactccaagctacacttactcacaacttgaacaatggactacgccttgaattgcaagtcttgtgcaagcaagtttcactcaaagtcttatctggtactagaccgtctgtagactacccatcgggtggagcgtataagtcatactcctaggtctttagtaagcttcctagaagattcacccaaaatcttcataaactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataattcacatgggtctcaaacccatctccttcgatgcattgtttatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggaccgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaataataccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatcctttattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcagtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggtacacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacataagcatgtgacccattctccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcgacatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagctattttgtagtcatgaaactgctccatgatatacagatcattgctagcatcagtagcactgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggttgttggatggttgagattatagacatataatgatttaatctattccataaataaatcatgacattacagatgaaaactagcatgaacgcatcattagatctacacatgtaaactacacagtgtaacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtccgaacgaacagggagcagtcgcgcgaagcgcttccaaaaaccttattgccgcttctcccggtgcaggacgtcaaaggcagaggttccggagacctgtctcccgatcgctggtgcacgccggcgagcgggatggagtagtctacgagcgacggcgcagtacagagtggaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaagagccaatttttcggaccattcgacgcgtacgtcgtgcacgcgcgccgcctgccctgccaggccaggccaggccaggcgagcgagcacgcgcgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaagacccattcattaattccaacagcagcaacagtgcgtcgtcgtccccgccgcggggggagaagtttgcggacaggccgtacagggaatactgatccttgtggagatcgcggtggtggctcgccgccgacgactggtgttcgtcgggacggagagctgcctgagcccctgggacgacgacagatacctctgcgcgttccggtgggaccacgagctgcggttctggcgccggccgccgggacaggagcttcggcggccgcgcgctattcctcagcgccggcacggcgttcttcgcgcgacgcgaggatcctgccgtggtgcgccggcgactgcatctaccctattgacgacgagagcgtgctcgccgggaagaacatgaccgtgcgctgctacaacatgcgcagccggaagtatagatggccatctgggcggcacggcccaggcacggccgtgctccggccagaatctatcgggcccacacggcccgaccaacgccagaagcatcggcccaggcacggcctaatatgactcgggccgggccaggccggcccgatggcacgacagcccatcgtgcttcttaaaaaaaaaataatttcagtccctcatttctttggaccatgtctgaaggaaaaagtacaccaaaggtccctcaacttgtcatcgggttacaaaatggtccctaaacaggtatatcacatcccttagcttacaaaaccgttcactcaaggtccttaggtggttttgaacccggttttatctgacgcggtggctgagtcagcgtgggacccacatggaccccacgtgtcagggtgtccacgtcaccacacacacactctctctctcccctcttctctccattcctctctctcatttttcccctgggcatggatggcggcggcgtctttgacgcggcggggaggagacccggcgtggccggcggctggaggggaaggagcgtggcggagaggagggccgatgcgacgggcggctccgccgatggatgtcgtcgcgcggatggccgcggcggccgtccccctcaaccgtcggcctcgacgcggcaaagcaatccaaaccaaatcaaataccgagccgatcgagtctagctagctagctcgctccggcgattgaccaccaccaccgcttgcagcggtagtgatatactgatatggcggagaagaggctactgctgccggtggcgctgacgatggcgcagaagcatggaggaggggagagggtgtgggagcggccgtggaggtcgtcatcacgcgcaggggacgcggcgttcgtggaggacgtcgtcgcgcaggcgcaggtgtccaacttccggtcgtcctcatcgtatccgccacgcgcgcttctgatactctatgagcaatcgacgcccgcccctctgttcgctctctctctctctctctctctctctctctctctctctctctcacgtggctgagctgacctcgacgggcgatgtggcggcggcggcgacgatgtgggagcaagagggccgccccccacgccgccggcctccgtcgcctctccaccagcttccatggatgacgacggcggcctcctcgctctccccgtcggctcctcatcctccgtgctctgcgaggacggcgcctcgggcgccgccgaccgctccacgctgctcgccgctgctgctcgatctgaacctgtcggcctcgtccccgtcggctgttgccgccgccgaagccgacgagatggattggtggtgcgacacgctgctccacctctagcctgcacaacaccaaacaatggcagcaatcgccagtgaactctagcctacgacgacgacgacgacgaccaaccagcaagcagcaagaatcggcaaactggtactgcgttgctacgctccaatccaaccatcaccattgctgctgctgctactgcgaagaagctctaccatctccttcatagacacggatatttttttttattttcgttttcctccatcactttttcaccactcaggatttcgtttccgccgcctctcttttgcatctctgtatccaaaggggatgctgctgctttcagctgtaccaatagctagaaaatggtagagaagatgagaaaatttggttcaaaatttgtaatgttcagatcgagcagcagtggcgagcagcgtggggcggtcggcggcgcccgaggcgccgtcctcgcagagcacggaggatgaggagccgacggggagcgcaacagggagagcgaggaggccgccgtcgtaatccatgggagctggtggagaggcgacggaggccggcggcatgggggcggccctcctgctcccacgtcgtcgtcaccgccggtcgccggccgcctgacctcctctcccacctcgccccgccggccggcttgcccagacgaaggacaaatttgagagagagaaggaagggatagaagaggggaaagagaaatagtgatgacgtggtacctgacacataggtcccacgctgactcagccgccacgtcaaataaaaccgggttcaaaaccacctaagcaacaaaagtaaacagttttataagttgaggatgtgatatatctgttttgcggttgaggtacgactttgtaactcgatgacaagttgagggaccttcggtgtactttttcccatgtctgaatgattgtagtaagtctatttacatcccttatttcttgggccgcgaattatatggctgcaataagtctaacttagtccctaaagtattttcttccctcctcattgaatcaggccgt

SEQ ID NO: 48494 - DNA, 3953 bp, Oryza sativa
tttaacttgattctaagtgtctttactttgaaatcagtattagtagctgcaatactgttccaattttgcaaagctctctgtctttcatgttctcgaataaagatttgcctgttcaagagtttgatcgtccatatgtattaagcagattagtgaaaatatttttggattagattttagtgaggactacatgtatgctatatggatatagaataatactagaaaaacgtcccgcgcgttgccacaggatgtgtgaaattgaacgataataaataaatataaaatatcaaaatattataaaatcattttcttacttatatataaaatgagaatgacgatttgaggattttagaaaaaaaataaattgaacaaatgacttttttctaacttcgatgatttattttttagaaactaattatgaacatcacttcatatatgactaagtattcaattctctatgattttgtaggagtttaacattgacacaattaatacttcctcctatttgtgtacaatggacataatatataatacaattaatattgtgtttttcattgtacgtttaattttcacttgagatgtggtgttccaacctctgttcaaaccgatcatgttaaatttaggatcctactctataaaatcaagttttccaagttctcccataatatcacatcttttctcagattttttttatacctatacgatttatctgcttaatttccttccataaggttattgtacatgattaatatggttcatctagaagtttttttccatagcaatgaatgggcgtagttagtctcataattgtgatagattttattgtgcttgtttttgttactcttgtcgtacaaatcgatatagcaaaaccggttgatcataaattgttatgtttcagttatgagatacaattatttgaagctcttaagatacaattaaaatcttaattgcaatttgtcagaaataactgcacattgcggtagtttggtgtggcatcatcaatgctatcaaagctatagtaagacatttcttcagtggctatgtggttaataatttgtgtatttatagcagcagcgatctcatctgttggtgctaaaattgcacgctcacataagtaggttggtagctgtgatacatgtggtattgaaccatacacaaaagaaatcaaacctgctaggttcctttcttcaaccggtagtaagagatatgatggaattttcacccaggtggtgtccggtcgatcagcgggtgcactatcatggacaacaccatcacccaaaaatagaagccatgttgcaaacagctcaagctcaaacctgtcttaatgagaaaaggttggataattgagcctcatgttttcagttaattcaagcaccacacaattttgccataagtgggagcgagtgatcaaggcattcaggatttgttgctgtcttgcattaggaataaccggtagagtttgcctaaagtctccacccaagacaattgttataccaccaaattgcatgttcactgaattaatcatggttgatcgatggcatgatatctctaacggtgcgatcaaatgcttcaaagcaatgtttatggttaacaggtgctttatcccatataatgggagatgtttgtcgaataattcatcaagatgggtgttctacaatagagagtggatttaaactctcaagtggatgatccctcattatttacatgccactcaaatagttatgaaaaaaattataaaaaatgagaagatgtattattatgtgatatatcgctctacaaacatgcaagttaaaatttaacttttacaagttaaaaaaataaattaaactatagctagttaatgtatgttcccagttaaatttgttttttcattgcgacatatagaagttgtttgtgaagtgatctatcacatgttatatatcttgttgatttttcttttaaaaaaaattcttaactatttgagtgacattcaaaccttaatttagaatagtttctttatataatggagtttcaagccaatttatagataaaaaaaaatgtgaagatgtcagcttatggtagtgtgtaccggcggatgagtattgggccagttgtcgctgtcggcggcggcgaggtgcatatgctgctatgggcttcaatgggctggtttcatcagaagttaagtatatgtgcatgcgtcaggaataatttcactttgattcccttaactagtggaagaatctggttagtatccctaaaccgtaatattggttatcttgactccccaactattaaaacatattcgatttgcctcccaccacggttttggagggctgtttgcagatgtagcgtctacacggggtgttgatctggtcttcgttccacgtgatgttgacgtgacgcttatgtggtatttgaatttaaaaaaaaactaggtgattcccttcactttgttgcgggaattacttagaaattcttaatatttttttgacaatcaagctaagagtaaaaaagaaaaaagaaatgaaacatccgggttgatacccgtgctttagtgtgaacatattgataagtatatgttaaatattgtaaaagtgatagatagatttgttaaaatattatgcaaatgaacgaggggtgatgattgatatgcttgtattttgatttgtataattaaataaattgtagatcatgtttatgtttgcatgagattaaatatgtaattattgctagtggatgatgatgtggcatggttgcatgttgagctatagacttagtgtgctttaacttatatagaaagcatagatatgagggacccatgtcatcctccttcacattctttcacaccttctttcgtcgaggaattcttccacatgtcatcctcattcaccttcttccgtcgagggagtcaaattgagccagtcaagatatctggtatagtgattcagggatatgaatgagattctgccgctacttaaggccttgttcggtttggaaggattgaagaggattgaagggagaataattccacaccacaataggtgtggaataaatcccctccaatcctttcatcatggggattaaccgaacaaggcctaagggagtttttacttttatagatattgttggtcaaagtagcatttcgaagacgatgttagggtccaaaaatacttatattttgtgacggaggaagtagatcaaaatcgtattacaactcaatgactagtgcactgtacccttgttttaatatccagtagtcctcggttgcgttctctttgagcttaaggctgaaatccgctctacatttaataagattcacaaaaggttggatattatttacattgacaatgaaaaaaaattaactatcatgcaaactattaagatgaggaccaggagattgcatctttggcgatgcgttgtaataggatggatcacgcttcccacataccatagaattttcgtcagtcattctgcctgatgcataacaccacatagaacaatgtttccagtgcatggtttaaaagagtgaagcaattctgcagtcggggtgaactaagcgagactgaaagctaaggttgcccagaccacacgagccaacacaacaagaagacccgttgcaacgtatgaatatttttctagtaatataaccaaacaaccacgtgaatacaaattatatgatgatatgaaaccaaacttttcattgtcacacaccctctagacataacggacttccagtgtacacacctactccagcatagatgcttgtttccgttatatccaaggaaatcttagttaccgggttataaatctgcacgatcgcttttgtccctgcttgcaaccaaaacactacctctccctcgtccgtcacaaccaaagggtgcactttcacataaactccagttccaaagaaaacaaaatcaacattaatcctatattctttcgaccacgtccccttgtcaaaatcagtcagaaaccac

SEQ ID NO: 48495 - DNA, 6396 bp, Oryza sativa
gggtggacatccactcgagttattagaatccatctccggttttacaagggctctctcggctgggctggggccctcttggctgggccgaatgggaattaaaagagtggcccgtgacgagggggaaggatggaagcccggacgggacaactgtgctggtgcagtgggaagaataagtctattttatctcctcacaaaaaaaagagtctattttggcctccctaacctcttatgctttgatccaatcacatcccccaaccataaaaccgactgtaatgcatctcccaacttcaaaaactgatgcaaatatactccttcggtgatttaagaagtggtttttgctgacgtgacaggttgaccgactgagtcaacatatggcccccagatgtcagtgaaatgtgaaaaaacatatagggggacccacatgtaagatatattcattttctccttcctccacctctccctatttcctctctttctctgtctccatacctatcggggtcaccgtcgggagtggcgcggtgaaagggagctggtggccgatggagggatgcagaagtcaacgatgatagggaaggagctaaaggtcggtggtgaggccgggaggttgatacagtcaattagccggagaaaccaagggcggtggcggccttagatccagaagaggagccaagagagaggcgataggtagtcgagatagagagcccggtgctagcaagcttgcgttaatgcaaacggagcttgagctctcgctacagagacagaggggatccaggaagagggcggagcttggggtcccactggtcgcaggctcctctctcaaacctcagtggcaggggagcttgggttcccgctgccccatcaaacctcagtggtgggtggcaggggagctttgggtcctgctggtcgcagtctcctctctctcgagcagtggccacaacagcctaatggtcgacgagatcacggtggcgtagatggaacttgggatcccgtgacagatatggaggggagccgcgcgagcaacatgtcatctcctctctcccgagtgacgcgggcggcagcgcactggcgtcaccaagcatgatgatgcggcaactgttgtggatcttcagctcgaggtcacgaaggtggcggtagtgccatggaggtggtcgtcagggaggaggagcagttgcgtggaggtatcaggggtggaggctagcgggtgcgtcatggggaaagagattggacacctcttcatcccctcctcctagcaaaaagcagctccattgtagtaatttctgttgaacttgccgacgaagactagagagacttggcaaagaaatccttgaattcttaggaaccaagaaaaggaggggaatatatgaccccatcaaaatcattcattagcatccatgaaatggaatgtagtaagcaaaggatcggtgcttttcgtattctcttgggaggagggtttgatgttgtacaaccactagattggtgaatttattattaaattgtggtgaacttgttcaacgtatatttacccgtgataactcttttttgagatacaataaataatattttcttacatatatttgtatataatctctcatatttctcaaactgggggtaaaaaggtcatttcaagttccttttggtgacataacactctaattaggaaaaatctctcactcatatagtgtttgtgtaaaaaaaatggaagaggggcatctcaatagagtcactccgtaggagtggtggcaaatacttaaaaaccctgttatagtaacaacaggaatagaaataggagtaaaagtggcatttatagtactactctttccgtcctaaaatataacaatttagagggtttaaaatttgctaaaaaaatataataatttctccactaacattctcttccaaaccaatcacaaacctccattattcaattttttcgtctaccttcacttctcaaccaatcacaatattcccttattcaattttaccaatttttttaataactgtattcaatctttaaaaaaattatatatgggaaggggtagtattataatagtggcaaatagttaaatttccacaagaattgaatggaggagaagagttgtctcccctgagttgatttaacacctctccacgaggtaggcaacgcgagttggcagctaatcctgtcaagtatatttttaagatggacataggtattaagaaaataggtagaaataattagagaaatattgtgattaattgagaagataaattatttaagaaattaaatagagaatgattgtgattgattgagaggagttggtaaatgaagaaatagttttatttcacaaaatgttaaagatagatttattttgagataaagaaagtaggatggagccactgggagagcagaagtgcgggttccaaaaatcagattttttttatttgccctcaaattggcttagatcatttaatgaagcagacgacaagcttttcatggagactctccattatatgcccattcattttttttccttttccaatcatttccgttgtttgattaaggtgcagaaattaattgaactttcaattttttttctgatcgaatcgccatgtaagtatcatatggaatgaagacctagtcaaatgggctttgtatgagccacgtcagttaaaatcaggttcaatactactcggcgggggactatatttgtaccggttttaaagttgagggtacaacgattctgattttgcggtttgaggatgtcttaatttgaaactcaaaaaaaaatgaggaatgtaaagtggacttttaccagtgaaaaaaaggtcagtttgtgagggttggcaaggaggaggggcgagggcgtattgaacaggtcaacaggaacaccctcaccctcgctgcccttcgggttcacccggccccggccctaaagtgaaaaacgggcgtaaaacaacctctgcacccgacacctccggggccctgtcacccgaccgaggccctgctgcacccgcatccgcatggcaacgaccgaggaagagacgatgaggcgtgatgcagtgggacgacgatgaagaggcggagcagcgacgagcaggcgtggggactgtggatggatgaggcggcctgacgacaatgatggtgtgtcgcaccggcagccggagatgaaccggcgcggagtagcagtaggcggcgtcgacagcccggctgcgtgggggcatagaggagaagcaggcggcccggttgcatagggacgcagtagcgtggaggaggagtagggtgacgctagcggtgccggcgacgtgggtgagtgagcttggcaatgacatcgcgttggggaacgcccgcgcgtgcacatgcagtaggcggtatagcgctagcttgggccggtggtagctagggactagaaaagggatagggagagaagaacttatataatacatacttaatttaacccggtttcataagtgggaagtgtttacacctaaatttggtacctatgaatgaaatagaggaaaattgtcaaagtttgaaaagtgttggatttcctccacagggccggtcataccataggtatatgggcggtctgactggctaatagagccggtctgaccgcaggtatgtggccagtcagactgtcagagtccgagtccaagtctgtcttcatcgggtctcaggtttccttactcgggaaggctatgtttcgtatttcctttgatttctatcccgagttagacgtggagaagggcctgtagagggcaagaccaacccctatttaagggacaaggccggttcatttgtaatcccccgaatacaatctcttttaccatgttttctattttacccaagttttagtccatttttttcaatttgcgctgtaaatcatctgccgctgctgcgagagtgcgacacctctttgtaggtttgtcctgaaaaccttccgttttgcccacgagacgggtagttatcttcatattgatctaagtcggtctagaggctgattttgatctctaaatcgccttcgctaaccggtttagctgtttttctacaaaacccatcttgatttggtcgtttggctagatcgaggtggtcgattctatatcacctcaaggcgtttaggtgttgcgatcatgcttgtcgacttgtcacaaaaagttaccaacaggagggttaagattttcggtatgggatcacctatacatttgtcaacaaattttgttttcaaaacttgacaaatgtaattgtagtacaatcgtgatgtaattacgttgtaacttgtatgtaactttcaaaaatctctccgtaatcggtgaaacggatgtcctgggaacgaatcctctcacatgtgtgctgctatgcgcgctgtgatttttttctttcctcacttgcacaattacggagaaacaaatctaccggttcaaaactatgtgaaagttacatacaaattatattgtagttacatctctcaaatttttaggagaaaatttgtccacaaatatgtagctaaattgttatgtagtacagtttcgaaaccgctaaaaagcggctagtcgcgcgtctcccctccctcgtggcgcggccacgtggcgcgaagagaggatggccacggtggaacggcgcgggagcgccacgtgcggcacgtttctccggtttttctggtttttccctgatttctttcggcggcagataaaaacgtggcggcggcggaatcagggaagacgaggaaacagctgccaccggcgggcgcaacgctgccggccgtgacgccgctggctgcgacactgctagccgtgacgccaccgggcaaggggctgcaggtacaggcaccggcgggcgaggcgccgctgccgggagaggcgctggcgggcgacgcgacgccgccgggagaggcgcaggcgagcgcggagaatcgccgggcgggagcatttcgtcttcgcacgggaacgagaggagagagaggcaggagtgtgagattgggagcgatattcgcgagaatactcgcccgtatataagccgagcaaggaatggggagaagggagttccaaaacttatgcaggagggtaggggatttgttggagctgttttctagactaaaatccctcaaaattagttttgggaatcagataggttgactgttggtgatgctcttagcgcgctcgtgcagtttaggatatgaattagactatccctttggcctgaaatatttatttgcgttccgcaagtgaaatactccattttgttaggcccatcaaactaacaagcaccagagcccacccacgatcgaggccaggcaccatccatgccgttgccaagttgccgtcgacgagagcagaggccaaggcaaagctgcttccagaatccagagtgccacctccgtctccgagcacggcagcaacggccacaggaatctgccgtgcagagcacgctatcctcatctatatatttctctgaccacttcgtcctcacccctcccccatttcaaatcacgcccacctcaattcagaactccacatggctgccgatcccaacctccccggccgtggcggcgccacctcttccccgatggtctccagcctcggtggcgtcgacggcgagggcgcgccgcccccctctcccatccttgctgccctcgctttgtcgactgtctccgcggcgtcgagcgcgcccgctaccggcgccaccgtttcccccctggtctccaacctcggtggcgtcgaccgcgagagcgcgccatgagcgccgcctccctcccccactgtccctgcttcgtcgacggtgtccgcggcgtcgagcgcgcccgctaccggctccacctcttccctctccagcctcggtggcgtcgacggcgagggcgcgccatgcgcgccgcccccctcccccatccctgctggccccgcttcgtcgacggtctccgcggcgtcgagcgcgcccgctacccgcgactacctcggcgggatcactggccaccgcctcggccaggaggacgactccggcggccacgagtacacatccgtctccggcatccacgtccccagcagcagcggcgtcgccttcgtgtcgttcggccagtgtcctcaggaggtgatctccaccgacctctgcctcggcttggggcccatcgccgccaccgcaccgctgcaacctcctccacctccagcggcggcagcggcagcggggtctccgtctgctacgacgccggagccaggacatggggaagcgacaccgacgacaagttcctccgcgcagtttcagacgcaggcgcagcaggttacgcgcgacatgtggatggcctgcgctgcacccaagtccggccgtctccccaccgttggatcattggtctactacttcccggacgggcacgccgagcagtgcctgtcacgtccgcaggagccgcttccaggcagaattttcctatg

SEQ ID NO: 48496 - DNA, 1205 bp, Oryza sativa
  unsure (1)..(1205): unsure at all n locations
acgaccctgccttccagcttcaggctcccgctgatccagaccctgctccagcccagtcccagagtctcgtttcattcgtcaagcctctcacctataccgatgtcaccaagaatcggttcatggtgcccaagacgatgccgctgcgggagttcttcctcacatacagttgaacgatgatgtgcctctccgaatcaaggacttgagcggaaaggagtgggcgtttaactacacctggaaagctcacacccgcatgtttcgcaatggttggatggagttttctaatgccaacggcctcgtcactggcgacaatgccgtgttcatgcgtcgcggcaacggcgagatgttcatggcggtgcggcgcacgcgcaacaggccggcgcccttctcagtggaggaggtcatcgaggccgtgtggcgggcagcgcgccgcgagccgtttgaggtcagctattgcttgcgccaggatggggacgagttcgttgtaccacgtgacatcgtcgatgatggcttacgcgccaggtttgctccaggcatggctgtgaacttcgtatgggctgttgaggatggcaagctgccaaccatcgggccacagggggaggtgatttccatagagaactatgctacgtccattggcgcataattcaggttctgaatttttcttgttttgattgaagtgactgcatgtattgtgttgatagtatgattgatcttaatttcttctgctcattgtttttttttttttgacgcaaaaggtagagagactctaccttgttaccattgtattaatggtggtcatgaaagtaacaaagccagtggctggcaagagattatacagggggaacaaagaggaaggataaagaaaaagaaagataaaaaagaaggaagggagaagaaaaagaagaagaaagaacaaaacacaaaaaaaaacaaaaataaaaaggaaacctagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48497 - DNA, 1263 bp, Oryza sativa
cgtctttgttggcccttggagagtcatgctccattgctccgtttcaaggtcgaaggaaggcatgcagcctgtccgtatgagggaggaggcggcaacgcggttgaagtaggacaggaggaagtaagccgcgcctctgtacacgactccattggtgaagctccaatcaggtagtccggtgggttgtccgccttcctccactgaggtttcgtgtcgctggtggtgatgatctccgacacgtgggagtagtccctggactccacgatgcggagtagcttgtgctcgcctgtgtgagatgtgcggccaaacgcgagccaaacacggtctccgcctctggtgcgacggcgaggtaagtgcagccgcaggggatgtgcttgacgacgttgccggaaaggtcgacgaggttgatacgtggggtaggagaggtctccacgccaacggcgaggaggagggcggtgtgagggtggcgggcggcgtgcgcggcggcgaagagcgggtcggaggtgaaggaccgccacgagtggcagacggcgcggaggcggcagatgggcttggcggggaggcgaagcaggacctcgtgcagcatctccggtggcaacacgccgtccactgctcctccgtacccactgcaggcgccgccgacgaggacttgttaccgacgcgagcacgagtagtaggaccgccacgacggcgagaggcagcgcgcttgggcatcacggcggcgacggtcctcttccggcggggtctagaggacggcaaggaccggacgggcttccccatgtgttcctgcggttccgaattccgacggtggactgagggcggcagcgatcgaggctagggctcaagataatagccgatcgaagaggaggaggaattcgaacccggaacgacgctcacccggtgaccggcggcgtcgggttttacgagggaaactgttttaacagctcgagtggacgtccacccgtttattgcatgtcatctaaatggttatgaaaaaaattgaaaaaatatgaacaatatatatatatatatatatatatatatatatatatatgtatatgtaatatatcactccacaaacatgcaagttaaaattcaacttgtacaaattgtagcaaaaataacaaacaagactcaaattaatatgtatatttacagttaaatttgttatttttgttacaacttatagaagttgaatttgaacttgcatgtttgtggaatgatatattacatattgatctatcttgttaatttttttgaaaattt

SEQ ID NO: 48498 - DNA, 786 bp, Oryza sativa
  unsure (1)..(786): unsure at all n locations
tgcgggganagtgactgcttctatctgcgccccgaactctaacaccgagctcactctcatctctccacagtcgcatcgcctcgcctcatcctccagtcctgtgccgagagaaccgagggagagagctcttgctgctctcctcgccttcgatctcaccaccagccgtgacaaagacgatgctcgtcgtcgccgacgagtcttcgccaaccctatctcttccacgttccatactctcctcaccatgcccaagattctccttttgatttcatcctctttcgtacagcgaatcaacgggaacgccactgtgtcatcgccggccttggggcgtgctctgcgcgacgccgttgtgacctcgtcgctgttcccgtcgttctggaccaaatcaagcagagccatcgcgccatcaactcctccatgagatcctcttaaaaacccctcaagaaccgagaagaatggagcaccatggacggagatcggcctccatcgtcttcaacttcggccactgtcgccatgaccaaattctccttcgctggtgagcccctcatcgattctttgcacatgcaccatctatgggacctaatcaacctcttggacatgcatgcatgtgtttgtatcataatttggcttatagttagttcatttgtgcaggccaaattattttggaatagatggtgaaattatcttatgatttgcttgaaatcaattcagtttacatgtgtaggaatttgtgatgcaatagatggttccatgtaaatgggagggtggctttatcatttgatcatgtga

SEQ ID NO: 48499 - DNA, 782 bp, Oryza sativa
aatgtaacgttctccatcaggtgatacaataggttagatctctttgctgatatgtgagcgtcagtatcatgggttcctatgtgccgattaatattcgttgctgtatttgattagactcgcattcgctccgtatttgtgtacgataatattcgattccattacagtatcccggtgtcggtccacgatatcgatttcgacagtgtgggtatgaacagtgatatgataaagctagttgccgatcgtatccgatccattttcatctctagtgacacaggtcggaattcaggttatcctatgcggtggtgatagtctagctcaattatcgagacgtattgaaaaatagtaaagatacgtcaggacaaccacagtagctcaagtgctctgatcgagaagtgctttcagataagatggactagtattcataccacaagggacttctgagttctcctagacaaatcgatcggtgagtgactgggcggtgttaaggctggatggcgcgtgaacgggcgaccagtgtaggggcgaacgcgtgcggatggggaccagtgagtggaagcgagtaactcatacggcgaggagattacgtgttgataattgtcacaatacgggcgccaggattacaatgaggtatatagcttcggttcagagtttgttgtgagagcctagattacaggtataagttctatctcttctaactaactcaacaaactctatccggcagctatatggagcatcatcacatgtacacagtatagggccgcaggaatacgaagcagtctact

SEQ ID NO: 48500 - DNA, 769 bp, Oryza sativa
tcctgcggcccttaaagactaccgaggagtcatcccttctaaatacggtcacatcaacatcggtaaaaagacaattgtagcccatggaacataattgagaaatggacaagagattatagtttagagattttaccaagaggacgttagaaatggaaagatcattggagattgcaatcttacccaatcccattacttttccctttccatcgtacccgaagagtatgttctcttgcaaagtgccatttggatcaagggaagaaaacattgattcttctctgggcatgtgatttgtgcatccactatcaatcacccaacttcttccaccggagagatattcctacaagagatcaatctctagttttaggtacccacactttgttgggtcatcttatgtcagtgacaagtgccttacgaacccatagaactctcttgatggaaacatttttgcccctaggcccaacatatttagcacccacacgaccactagcattcttcctaagaacatatgatacatcaaaaggacaatgtgaagcatgaccattaggaaggatacttttggccttaacaaagatgctaagaccttggggcttcttgatcaacacactcttgtccacctttccttttggtggaggaacatacccaaggccttcatggttgaagttgtccctttgatagcctaggtatttctttagtaccttactacccatatggcacttaagcaagccattgtgaaggagtcccataagcttctcattttgcttttgcaaag

SEQ ID NO: 48501 - DNA, 777 bp, Oryza sativa
  unsure (1)..(777): unsure at all n locations
agtgactgacttctttcctgcgncccctcatcgtagcgatgccagcagtcacttgcacatgaccttttttgtgacagacttggcacaccgggcgagtgtcattgccacgccctcgcccaggattggcaccgcctgtgttcccacggccaccaccacggccgccgtgaggtgcgctgctgcgcccgccacgatttccaccacggccaccacgaccaccgcgatttgcagcgttcgccgacgtggtgaggtaggcttgacgaatccgaatcctgttttcataactcaagagttgagaatacacatgagaaattgaaaggggtgcgattcttgctgttgccatcaatccttcaactgttgcgtcgaagtcggagttgaggccgttgatgatgtacgctatcagctcttcatcgtcaagaggcttccctgcacccgccatctcgtcgccaagagatcgcatcttggcgatgtactcggagatggaaatgggtcccttctgagttgtcgttagtgcaaggagaacgttgatggcaccagctttggacttgcaggtgaacatgtcgttgatcatgctccatgcttgggccgccgtctttgcgccagccacctgctgcagggacctccgtgacagggagggagagaggaaccccagcacctgttggtcctgggtgaaccacttgatgtattctggaatggagatggtggtcttgactttcttgtcgccatcttctttctcacactcgggccgcggaacttaactgggcccgtgatgtacccttt

SEQ ID NO: 48502 - DNA, 931 bp, Oryza sativa
gtgcggacaacgccaagctgcaggaggagattgccagcgcggaggaatcaccaagtccaaggacaactctgcttcactctggcaagctctgcactagaactacgggcgcctcgatgtggccgcaaaagggcctggggatgagcgttcctcatcccgagtttcctgacgaaaccacggtcctggtgtcccttgggtcgctgataaccaagctggagaccgccgcgagctcccatgcagaccaagtagacaagggaatgaggtctaggatccagaccgacgcatgccacgttcttatgtgcctcaaactcacacgcccggaggtcaacattgaacaaatgatgaccaagggaggagccaacaagcgtcgcgaggacatgatatcagaattggaggatgtcgaggagtctgtgatccccttttttgaagagtaatatgctaattttagtttcattgcaaccttaaggacaagtatttcgtctgttgcccgagaacacttcccttctgttatccttttaaggtttccatcttgtcttttgtattctgtagatgctttgaagtcgagaatgagaacgtccagcaaggcggacgctcgtcaggcttaattgcacatcctagtacgccctaggcctcgtcaaccccgagtgatggcgaccgtgctctggtcgtcgtcacttctgatggcacgttggcctctcaagatgatcaactcacgctccttcgtgagaaatatcaaggtgcgaaaacccgaaattatagtgtattgctcctgtactcagaacaaaggatgctaatggtgtcgctgtctattctagatcttaaacattctctcgaggagatgaaacgctgggccgagtactggagaactaagttcgaaaagaaagagccggagcgagcaaccgacaatatcaagaaaggctagaactcgaagctt

SEQ ID NO: 48503 - DNA, 804 bp, Oryza sativa
ccttgttctcaatcacctccctgaagactccggacatgtcggacggctgctaggtaaatacatctgcattgtcatagaggaaggtgatgagcttgagttccaatttgcagtcgagctcggcgccaatcttggccgtgtttgtcaagtgtgctactagacagcgggattatctttatggcgtcgtctggtttgggtgccaagttgggtttgctcactttcccaggaggctcgattgtggcgggactgcggtagtttgctcgactatatcaaggctcatcttgtcacattgcacggccatcttcgcgttccctggcaccgtgattatccttttaggtcccggaatcttaatcaactggtaggcgtaatgcgaagccgccatgaatttggtgagtgttgttattctgaatatagtgttgtaggcaatatcgaactctgctacatcaaaatgatatgctatgtctgcaagttgtcaactctgccaaaggtcacgggcaatgtaatcttcccccaacaaccttgatgatgactctggggtaatgccatggaagggctgttctgaggggatgagctcgcttctaggaatccccattgcgtcaagcgcgctgaggaagaggagattgattgactgccaccgtcaatgagaaatcgcgcgactagaacgttctgaatagtaggcttgactactatcgggtatcgtccaggggttgtcgtcagagaagggtagtcgatgtcagagaactctatcttctgatttgaccaattcatcttagacgtcgatacccgagatgtagagcatacttcgtg

SEQ ID NO: 48504 - DNA, 1281 bp, Oryza sativa
ctaattatgctgccaaattgcggtaccacccatgggtgaaaagaacacggggattgcttctggaagcaagcatatcgcatccaacatttacagaggtcactgacctattggccccttcaatgctaatgatttccattaagcaattttccaaaatgacaatgcacctgacaagctacatcaaccacgatacatcattcgaagaaaccaaaccaataattcaaaagccaaactttcttgttcaagtgatagatgtgcaatgtcataattcctctgcataactaacatgacttgaggtctacatatttcatactacagcatcagaaatttgcaaaaataaacttggcaagtcccaacactccaaaatatgctctatctcagcacggtcaaagttggataattccataacctgaaataacataagcaaataatgaaatagttgtccaacgtagcatagcaattgttatgtaaaaagactaaatgatgacaattagtaaacagtactccctccatcccaccctctatcccatatataacacgcggtcaaagctggcacggtctccaaaactaatctttagcttataatttctcatatactataaggtttgtagcaacaaaattataaccatattaaagtaaatttaaatctcaatctaatgatataatttttaataaataaaattaatttcatattatactaagtgttggtcaaatgttttaaaagttgaatcttaatatgtgtgcgcgccatatattgtggtatggagggagtattttgatgtcattggctttagtgccctttacttagaggatgatcaatctgggatggagggagtactatttgtacattcttttaagaaacctgtagtttaacctacccatttttgaaaataaacatggcagcttcattattaatctactatattcaagacgcaaggtccggagcataaatgaactacttgttaaccacaacttcacttttttgcggccttcacaaaggagaggctaaacagcgaattgatcgtgaacttaaaagagatctaatcacattatagctccatcatggatactaatcagaacaaatgcatttttattgtctggcaatagagtagactagacactgtgaaatgaaccaaatactgataggcataatatcacacacaacattcattggctacttgttatgtttatcaatggcagggcatatgaaacaatttcatgcatggcatttgtattttttttcaatccacttctaggatgttgatgttcgctaaaaatatcagg

SEQ ID NO: 48505 - DNA, 730 bp, Oryza sativa
cccgggcagatctcatgctgaagttgactggcaggctaaagacccagcaatgcctccaatattcttctctcgagacgtcgaatgtttcattatatttatttgatgatataaattattcacttcatctatataatgggaggtcaagagagcctacgacaactctccgcaccgcacggtgcacgcgacacctagccacggcctgccggcgttgagcgacggctggctcctcgcagccaatagctcgctcctcgccttctctcctcctgcttggtgctaagctgacaatgcgatgctgtcactgtcgcagtccggccgtgctagccccaccaccgtctagtccggccggccggccatccccgtgcggccatgctgccgtgcggccaacagtccgcagcagtgcaacactgcagcagctagcagcctagcgcccgacaggccagccgccagggccaagcgcaagcaacacgtgcagacacgtgcaggacatcgtcatttgtggtggctagctgcctagcggctagcgcctaatcgatttcgtcctgctgctatggtctatggacatagaggaacagggataaggacatggtgtggtcacgcacatacatacatacatacatacatatatatatatatattaaagatatctatcgaccatgttttataaaatttttgggtgtatgatgaattatgtatggcgcaaaaaatattactttattttaaactggtttgg

SEQ ID NO: 48506 - DNA, 2740 bp, Oryza sativa
tgaggtactaagctagtcatgaatatgagacagtgatgaagaccttatgtcagaaattaaggatgaaaatgggcaaaccaaaaattattaatttaaaaacaatttacaaaattttccatttgtaaaaaggtcctttttactctcctgttccgtactatttcatcaaatcacttaacctctaaaatattttatttcttattgtatccctaaactaataaagatggtttgctttactaattaattgcaattttgttttttgtttctctttatacaactcgtaaaaaatgttaagccataaacgacaccataaccaaagttctaaaatattttcaaaattagtgcttccaacctatataaacaatgataaaaaaatgttaacaagtagattataatggatctaccaatcctattaaatttcaatgcaaatatgccttatatagagataaaaaaatgagaaatattgttagggtgcgagtgaaccatcttcaatagttcgggttgtaaaataagctaaaaaattatttagaatgaccagtgctccaccaacatagttcgaggcagtaaaatagaactttttaaatatatttaccaatttaactatttagtatagactaggtactaaataaataaaaaaattcaaattttatgtatggcaaaaatggggaacagtcaaaatagtaccattataaaaaataatacttattcgaccgtgaatttccataaatatttttatccctgttcaaagtacttgatttatctaatggtttgaaagtgggctgacggctaatgtgtagaaatgggctctaagggtgtgaggcggtacagaccgtagctggaccgactgacccaccccgcttaatgggtgtgtccacccctatccgaaatacaataatactttgcttatctattggaatgggaaatcctcttaaaatttgcctaattctgaatagctgggccaatttacgcttgcctcgaatatgaaacctaaaggcattggaaaacaataaaatgtgcctatatatacttgcagtggcttagctgctccttggactagatcggtataactacttgaatatgaatcagtgagggggcgatgtatcctagctagctagaacgaatcacttacaattggtggccatgtgatgcacaataagaggaccaaacaggtaacacaagtgggatacaaatgcttatatataaccttacatcacctatgttatctgaattagatctagtctttctttttgttcttcttattcttatgtgaatcatgtgatagaaagatgatgaattattaattgcacccaacataagtgtgaacatatcctatgcaagcacacaagctttctcgtgtacataccgtgcacaccaactaaaaaatatcatcaaaaattctaaaaaaaattgtacatgtagttttagtagtatcacatctatgtatgaagtctcatatccaaatttattatatatagcgagaaaaaaagatattatttttgataaattgatattctcaaaactttcaacaatttatctttatgttacggtaaaatataatgaatttaaggttaagactttatgtaacactattggaaatacttgtacattttttttagattttttgataaaacttattagttagtgtgcacgatgtgtgcaaaaaattcttgtgtgcacatgatttatatgtttcgaacacaaatagtccaatatattaattatatctgtgaagtttatgctacttcacaagatattggcatgcacgcttgcatgtgaatggatctaatccaactatatttttatccgagtttatgccgagtagagtgcatgatgaagaggagagaacattgatgcaaaaccgcgcttgtttgaggcatggcacgaggaccttcgactgaggctgccgaaacctgataggcttaggcgaagcgccagctgaagaccaaggttttcgccttaggtgaacccaatgggcgaacccatcgggcgaagcaggagggattcgccatcaacctagatgccatttgctacttgagggccaattataaagcccattaaggagcccatgaccaaatagacactagttactctcataagtattatcataatggcataaaatttgacaatttgaccctttgcaaaaactaatttcacaaatgaacaatggccataacttatttcaaaatgacccacaaatgaacaatggccataacttatttcaaaatgacccttttgttcagcgccacatcgtatggcgctgaacttagacacctcagcatcacgtcaactggcgctgaatactgtgccacagcggatgggaggctgagtcggcgtgctaacgtgcattcagcactgtgctatttggcgctgatatgtctaagttcaaggccatatgatttggcgttgaacaaaagagtcatttttaaaataagttttggccgcggctcatttgcaaaattagatttcggaaagggtcaaattatcaaattaaatgatcataatgttatccatgtaaattcccctatacacattaagtctagggtgcatgaccttgtactaaggctataaatagtccctagagacatgtaataggggatcccaaaaaattcaatcaattaatacatattgctttacttactactatgcaaaccacgtctttcgacgtgcgcagttatcaatcgacaaaagtgctgttggtacaggaatcaatcataccgtaatatcccggttgtaaaaagaatga

SEQ ID NO: 48507 - DNA, 2384 bp, Oryza sativa
cgatgacctgtgatgcagtcctgttttttgggaatctgcctgtcctcctattgctgcagacgagaggccagaaacaggtcaatagctgcagacgatggtatttttaggaagttgtttttgtcaatggtatttttaggattaagatgcttgtcgatggtattttatggattttctcgtataaattacatgacatatcacaagacagtattgcgcaaggatgcacaaatttaaaaccggaaagaaatgagacagacgtatatatatcgctgcattatttgagccgcaacacacagcaccgtcgtcgaagccagcgtctgatctgctctacttgcagacgcctccactcggcgcagtgctgctccggtggctcgccggcgagccactgctcgacggcgaactccacagtggagcacgatagatgtcggtgaagatcgagcacgccggcggtgtcgtgcgttcggcgtcttcagcagcatcgtatactgattggccgtgcatagacggtcccggtgacccggtcccggtctctgctgcatcatcgccacggtcctcgggtcccggtgtacagtacacgcacccgtacttctcctcgccggcggccaccaccaagtccgggaccgccagcgtcaataacgagactagctcaaaacaaactaatgtgtatatacgcgcgttcatacgtaccaagatcgccgtagcaacgaggatggcaaagcagaacagcagcttcctatttgcagccattgggtattgttgaaccttcaacgagtagctaggctcgactgactctagctagtttattttgcacttctgttgaggctgtgtttagttccacgctaaaattggaagttttactaaaattgaaagtttgaagaaaaaagttagaagtttatgtgtgtaggaaaattttgatgtgatgaaaaagttgaaagtttgaaaaaaaagttgggaactaaactgagccgtaccgatttgtgagctagaggaggctaacgagggtatttataaggcgagctagaggaccagagctaatatgttggcttgttaaatattctgagggatgggtgcgtagctgaagcatatcccttcgtcgtaaaataaactaactcataataaatgtaacattatatatactagacaccgatccacgtgacatagctattactttattaattataaatattagaactttgatcatatatgaaatatgatgggtattttctgaattatgtatgatgctttagtaagaagtccgcctcacttgcagttgctagctacaactttatactattaactctgatttttaaaattgtcaaattttataaactaaaattaaaagagtcaatgttacttctagccaagttctattttacatgtgctcccaatatcatctcggtttcaatgattttaacccatggctagatatattaattagttaagtgaaacctcttaaagtatcataatattattagtaattgatatagaggtagacagaaggacggcactaaaaaaagatgcgcgcacacggcaagtgatcatagaaaaggggatcgctgataaggataaaatatatagaggatatcaagaattaagtttttataaagaataaaatatattaattagtggtaatatatcttgtgagatgcatacaaattgataacttatcttatataaatggttttgatagttcacacaacttgattggagtatgatcaagctcaatttaccgcatggccttctaattataccgataaaatcacatcactatcccaagactgatatggatgaaatatacgatcatgccatataatatactgttgtgctgagttcaatagaacttcgcatcatcttgtgtgagtcgttaaaaaataatatgttgttgtgctgagtttgaatggataagatatgagttgtgcaagattgtacaggaagctgaaaaattatatgaaaggaagggcattgtctagtgtttgatttatatctgatcgtccgaaatgggtttatagtgatcgcttgcgtttgtagccgtcttacctttttggtctgaagtctaaaccgcagagcaccggctccaacgaggcgcgcacataaggaaaggaaaacctgcaacaactccatggtctcctcccgtttcgatcaaacaaaagaccagaaaataaaagagaaaaaggtaatagtaagcctccgttcccaaactcccccaaaggcctccaagctcgagctcgaccccgaaccggaaacattcctcgtcggcgaggagcggcgagatcccccgggccccggccatggaggggctcctgtccaagctccggagcctggacgcctaccccaaggtgaacgaggacttctacagccgcacgctctccggcggcatcatcacgctc

SEQ ID NO: 48508 - DNA, 9749 bp, Oryza sativa
ctagtgaggtgtggcccgttgttgcattgtggttttgcgttttacggcgggaattcgccctcaccgtagagatctccttgactgttttcgaggatctggttgatgaggctggaatcgagccactatttcgactatacagcgttgagttttgcttcatctggttgttactggcttactgctggtatattgcattgaagaatcatttgttgctcaattctgttacatgaataattggacagttcgtgagcttctatttttacttttgttgtgctgtgcttggttaagtatgcgtgcagaacattctaccattttggtattaatgtgttctcacaactcctagggactccataatgaatacgaagatcaaacttgcatgcataatgttcggttccttgtgtacagagaaacttgagatgctgcagaaatgagttaaaccgaacttttgatcatcatcagagttccttaatatttactatgtatgacaaaatcaaattagtccaagaccatatcattaaaatgaaaaagaggggctgtttttataatatcatgttttatttctgagtgtaaaaatatactcacaatgtctaaatttgcttccatatcctagtgctgttgaacattctttttgtattcatgattcatcctgtgctcagtagctaatgtttcaccatacaggattatatcttcatgcggtcacagaaacaacactaagggttgatacctcaaggggagaaacacttcgcataaatgtaatgaccagctttaattctaaatctttgattgcatctgattatattctaaacctttcttttttatttctaccaaatattgagaaactttccgttcctcatttcttttagataattttctcaccgttgttccctttttcctttctttttttgtttttcttttttgccagttagctcatctgattatattcagaaatttctctcttctatgttcgattgttaccttctttactgcattctgttcaggacacacgttgacatatacctttggtatgattctaaaaatgcagtttgatgtcacctttccagcccttcagtgttctataataagccttgatgcaatggacatcagtggacaagagcaccttgatgtggtatgtatctgtgtgttgttattgttgctgtatgtgttatggttgatcactggttgttgcagacttttagtgagtagtagctaacacagctttgtgtaatgctcttatgtagaaacatgatatattcaagcagagaattgatgtccatggtaatgttattgcaactaagcaagatgcagttggtgggatgaaggttagtgcttttcactgtccttaagaacaatacgctcatgatttttagaatatagtaaggcgttacttcaaagtcccatttatgaattaatcaaaatcataactagtatgaatgcattttgtcatggaaatgccttaacagtcctagattcttaacgtgaagctaacgaggactggttatttaaaattgtaccatatctgaaatctgagctattaacaagataacataacatatatcattttccataactatgcaattaagtaaattctggcttgtaatgtccagatcttgatgcatttcgttaaccctaaagatgcatgtttccttgtttcttattttttacaggtggaacagcccctacagcggcatggcggcaggcttgaacacaatgagacctattgtggctcttgttatggtgcggaagaagtatgctcctcttgcttttagatgatatttcgtcctgactcgtatctctactactttaaaagcgaagttgtcccccttagcatctgacttcacccacatcccccccccccaaaaaaaataaaataaaattaacaacaacaataataataatcataataaaatgtgtttccacgtgaaaattgacgcagaaaaaccagatagaaaaagaaaaaaccattcatccgttttcctctaaatcctattcaactcaagggcatgcaactagcactatacaaaagttttactgccctgtggccttagcgaaaaagacacacctgatagtgatagtaggggttatcagatataatttgcttgggttagaccatttaatttttttagctttctgttttcttctttatttgcttactgtacaatggattgccctctgttttgcaaccttggccattactcctttgtgttttttatgggatattgttcttatattttagctcactagtgccttatatgctgatctcaataattccagggttcttttctattatctgtttcttatttacatgaattagattgttatatagtgctccgtatatttggtacatcagtcattcttccaggggtttcactgaatatcttctttcatttaatttagtctgatgagcagtgttgtaactcgtgtgaagatgttcgagaagcatacaggaaaaaaggttggggtgtatcaaatccagatttgatcgaccaggtataaaatctttttttttattatgtgctataactatgtacctgcatatgtaacataagttgcatgctgtataactcgtgttccttccacctaggggcattttattttgcctgatatgcattgttctgtagtgcaaaagggaaggcttccttcagagtataaaggatgaagaaggagaaggatgcaatatttatggtttcctggaagttaacaaggttgctggaaatttccactttgctccagggaaaagcttccagaaggcaaatgttcatgtccacgacttgcttccattccaaaaggacagcttcaatgtaataatacttgagcatgatttctaactgtgaatactggcaggcaggaaaattattgtttccatgtgaacattctttctttaatattccaacttttactttattctttatgttccaggtcagccataaaataaataagttaagttttggacaacgctttcctggtgtggttaatcctcttgacgggtagcttgtttttctcatgttttcatttcattgtgtccttttctatgtttattagaattaagtgcatgcgcctaagaataataaaagtgatactaaacatttctaagatctctctgcttgtaaaatatcagggcacaatggatgcaacattcatcatatggaatgtaccaatacttcatcaaggtctgtcctatactctttaactatcttaggaaaaagtatggaatgctaaatcatgttgcttatttcattgcacgtgatattatagcatgatataggaaatgtgatgataatattgtgttttttttcaggttgttcccactgtctacacagacataaatgaacacattattctttcgaatcaggtaatgccttccttttttccctcatgtgcacaagtatcgtcaagttcacctatgcacatgtatgtatggatggatacgattttaaacatatcttaaaatgctgttattccttgctgcagttttctgtgacggaacattttagaagtagtgagagcggtcggatacaggctgttcctggagtatttttcttttacgacctttcgccaattaaggtatcgttttgaagtattttctctgacgctgctattagactggcttcccaatttgcatcatcttctgtgttgtcttttataccatattttccttatatgaatgggaaatcagtgttcatgccttcaatgtttaataatacatcttgcagtgatattactgcaacaatcatataaacctcccatcgatgccttttgcaggtcacattcacggaacagcatgtgtcatttttgcacttcttaactaatgtttgcgctatagttggaggtaatatttcccttgtggacattgtcttacacttaatactcaattttattaaactgtatatgtttcatttaagcatttgatattttaagcatcgaatttctttttcttcaaaacctgagatatctacatttgtgtctaagaacaaacaaaatgtagctgctgaagcaagtgaacgatacctgaagttagacatatgtcttgccatttagtctttgtatatttctctttgttttgtctaatttagtctactcctgaacgatgtgcaaaatatgcaactttttttctgtcagctctaggggccatacattattagaagctatgaaattaacccaggtcatcaacatcctagtaacctaaggtgcctatcttcttgatgtgcaggcgtcttcactgtttctggaatcatagattcatttgtataccatggccagagagcaatcaagaagaagatggaaatcggaaaattcaactgaatattgaatgtagccttcctgttggtactacccacaactcattccattttcaggacttacttttgaagaactattgtcacagtagggggcgaggccgctccaagttcaaaaaacgccagtgaaccaacccactaatatttctcatatgctttctgctctgaaactattgattcccgtgcatagtttataaccaactggtcatcaaagtacaagtgacttggctgcttgcttccagcagaagctacctgtaaaggaaatggttcatctggttatactgccctggggcaaacggagcatttcagagatgctcaattttgtacaccataccaggaaacattttgtgtaagctgcatttttttttcttttgttgtaaatcggtgactccgtgttaatgagctcttgcttctttgtagaacagaaaattttcctgactccgtgttttatacatcatattcttttacttacctgtagctttcacatgctaggtaaaagaatgtgtaattatttcgaggaaaagtttcttttctcccttgctccccgttctctacaaagtttactgtaatcggtagaagtcaatgaccattgtattagatataaagtaaccatgtgacggtgtggatggtatcccataatgaatgcaccatgtcttttgctccgtccgtcataaaaaaaagataagtatttatgaatctggatgtctagaacttcatgtttatatattttttatattcaaggatggatgggtgtgctgtatatacttgttgtaattaagaaggggccattttgagtttacttaccgtgcaaattgaattttgttactgtttggtacttctatttcctgtccactttctttgtcttgaataaaattatttttaactataatttttttaaaaaataaatttatttttgagtaatcattggatgaaagtaaaaaagaaatgcattggaagtagataaagagagataattatattaaggtttgattaagttaaggtatttagtttttttattggtacgtgtgagatgaatgaaaaattgagtgttttaagatggacgaagtatttgtgagaagtgcacatgaactttctctgcaagcgcttctattcaatgaacataaataattgtattcatttgctcgttcttaccttcacataaccttacctgtttctttaacaaagctacagagctagtactaatgtttagtggatgtcgatgaaatttgttcagtccatacgtacttgatctgtattcagtgaagtgcctaatagtattataaacaaaataaaatgtattttattcaaaaaataaaaaagaaacaacaataagaaaaaataaagcgaggaagaccatagcatcgtcgtccgcaccaaaccaagcaaactccatctcatcgtcgctccggtccccaccctactccaccaactcccgccgccgccgccgccggcggtcgtgcgctccgggccgcagccatgcacggccgccgccacctcgccgcctccctggcccgcgccctgacctacgccccctcccgctccatctcctccaccccgtcgctcctccaaaccctcgacccgtccacgccctcccccgcggccgccccgcccaccgcggggcggctcgcggagctccggcagcggctgcaggcggacgcgccgtcgctgggggacttcacgtactcggtggaggtggggacgcggaagaagccgctgcccaagcccaagtggatgaaggagacgataccaggcggcgccaagtacgcggggatcaaggccaagctgcgggagctgaagctgcacaccgtctgcgaggaggcgcgctgccccaacctcggcgagtgctggtccggcggcgagaccggcaccgccaccgccaccatcatgatcctcggggacacctgcacgcgcggctgcaggtaagagattaatcctcttcttgttgctgcttgcattagatgtagctgggctgctgcttagatccttttcggattgtacatggagaccttactatcatgtctccgtaatattagagactttatctgtagagatagaatgaagctttctcatatgctatccatttcgatgaaatttcacagattgatgtccttgaaggtataacttgagccatgttagtgcaaatgatgtggttattgtatcttctagtttattttagttgcttgtgctagattatgtggatgcttgagctctgcttgtgatgtaaaattaggtcctatcatttgtgcattagggatgttagcaaaaattgtagaaataggcaaagaggtaattaacttagtgtagagaaatcatgagggatctccagttcttctgtattttcgaataggttgttttcttaaacataaatcaaccttgttggaaatattttgagcataaatttcaaaaaatatcagaataggttgtcctgtatgatgacaatttcagggtactgtctctttatctagtactatccatgtgaccttgtatggaaagaagtgttctgtgttattattgttgtgatttgtccatgaattccagttgctagtttaagatttgctgatgttgcactctaccttctcgtgaattggcactaaccttttagacaaggtattgcaagtcttctgttttgatcgtttagtgagttggcaagtcattgatttgcaggttttgtaatgtcaagacctcgcgaactcctcgccaccagatcctgatgaaccttctaatgttgctcaagctattgcctcgtggggcctggagtatattgtcatcacaagtgttgaccgcgatgatttacctgatcaagggagtggtcactttgctgaaacagttcaaaagctaaaggtgttgaagccagaaatgcttattgaagcacttggtaagtgacatatttctggtatattgctttgttattcggtcagtatattatcagtcctctgtctgctaatgttgtgcttccctatattgtacccttatgcaagttattttgcagttcctgatttccgtggagacccagcatgtgtagagaaggttgctacttctgggttgcatgttttcgcccacaacattgaaacagttgaagagctgcaaagaaatgtgagagatcatcgtgcgaacttcaagcaatcaatagatgtcctgaaattggcaaaagagtatgctccagctggtaccctcacaaagacatcaatcatgctgggttgtggagaaacgcctgatcaggttatcagcacgacggaaaaggttagggctgctggtgttgatgtaatgacatttggtcagtacatgagaccatctaaacgtcatatgcctgtttccgagtatgttactcccgaagcctttgagaggtatcgatcccttggtgttgacatggtacgtccgtcttcctggaagttttttgcatcattcaaagtaaaatcaagtattggctttcattagtaggatacatagtgtacatggcaaagcttaatttactattaacatcagattttatcacaataaagaagctttccttggcatcctcatgtagactattagctagtcaatctttattagttttcaatgagggatatgataaacagaacaatacaaccaatctaaatagctgtttatttgctctatcatttggtggaccaaacttgattttttgagaacgtaggcacttgctttgtcatacaatctgcctccatgctcagttattcgtctaacaatcttaactccagggatttgtaaatctcgactttaaatttgggctcctttggaagaaaggatttttgaaggaattctggagaaattcaatcctatggaaaattttcatacgtggtcgtttggatcaaaggaatagatagccaaaaatcctataaaattttagattggctcaaaacataagaatttttccatgaggtccaacctcttggggaaaaaaatcttctctctctctctctctctcattattcttacatttttcctgggctccatttaaacggtcattcctatagtattcctgcaatttttcagtccatacgatttgaggtgcttgagcactccaatttcctgtatttttcctattcctgtgttttaagaatcttgcttttccaaaggagccttgcatgcatttcttaatactcccatgttggctctcagaatctttcctacagttcaaggtttttaaacaatactactgtactttgtataacagtaattagcttgtttgctgatgaaatgccatggtcatgaataacagggcttccgttatgtggcttcgggcccaatggttcgatcttcctacaaagctggtgagttctacataaaagccatgattgaagctgacagagcaaaagctacgactgcaatatagttgatcctctttccttgacattgttacactgcaaataaagtcgcaggattctaaaagttcttattggaaaaacatgttcatttttgtcataattgcaatcgtgctcctttcaacttctcactgccccttgtaccatttcaacatctccaagctatgtttgaaattgttgctctcttttgttttataatgtaaaaatcacgagtccctgtggtccagttgtcaatcattcattcattgctgtaaacttcaacagtagcaggaagtcaagtcaaactacccactgaaaatgtaggatattgtccctcatgttactatgctgtacttttgtatatatgatggcacaatgtgaagatggtaaacttgcctgctgttccattgaagatcagatctgatgtagaccattccaaaaagatggagcccgcccaatgctccaagatcgacgaaacactctttctgcaagtcaacaaaggccctcccccaggggctaattggaggaatatgttaggggtaaagagcaccactacgagaattattgacacttccatcggtgtcttgtccccaaaagaaactaaatggccgtgcaataataatgcttgaactcgctgaattattatattgcattgtggacatcccgttgaagttgaaggccaggaggatttgcgtgtcccaccatattcaccagcagccacgctgcagcaatgagtttcgagtcaaaccggcactagcacgaatcgctagctcctgtagccatatggacgacttcttgagccaaacggcacccagtgggtttggttcttgtgtgctgttatcctgtcaaacgtgctttggtggttacagacatgcataaaggaatcgcagcagcgatcgggatcactcgatcaacggattcaactcttcaaatgaggtgaaggtctggaggatcgagttagaacttggaatgaaatcactgagtaatctccggaccaaacaccctcttaaactaatacttactccaccttgtagcaaagcgcacatgattacatgcgtaatataatcgactgtccgatctgtcccgcaggatcgcaatctacttatgtacttatccgaatccgattcggacggagtcc

SEQ ID NO: 48509 - DNA, 1586 bp, Oryza sativa
tctggggcgagctcgcccgcttcaagcgccgcggtggcggccccccggcttcggtaggcggggtcgtgttcgagctccggtggaggccgcggcggcgctcgccggcgttcctcgggatgctcgggaacgggaggcgtcgtcgcgcgtgctggcgcggggcgagctcgcgtgccaggacaacgccgccgccgccgtacgcccgcgccggcgtcgtcggggagtacctggctgaggctctcgccggcgtgccgcgagctgagcgggtgcaaggcgcccaagctgctggtcgaggtcaggatgatccacgccgccgacaactacggagccgtgaaggcgacgaggtcgctcggcggcgtgaaccaccactactgctgcagcgacggcgagcggtgcgcgcagtgcgggtggatcgggaccgaggaggacatgttcctggcagcaacgttcacccacgaatgagtggcgtgatcgttgatttcgtagttcatgggagaggagctagttaattaacctaactgtactttcgctgatgaaatgataaaagaagctctcgactacgaggcaatttagtcatgggattttgatcgattgtccacatatgttgcgacatactccgtatttcggcatcataaatcaatgatttttggtacattggattaaaacaggggcggattcaccaagtgaattagacttgtctcggccccaaaagtttctgcactcccatagattatccttcagcttataagcgcaaccaaaattttaattttaaaacttaattttgaggtttttcattgtatagcttatttttcctgcattagctttcaaaccgttaaaaacacatatacaaattgttttcggttgatgataagctattatagcttataatccgcataagcaaaactatgtattggattcggcgaggtcaaaactgataaatacgctacgctcaaaattagtggattatatatgccgcattcttttctgattgattgagatatatattttacatcgatttttgttagcatgtttttttaaatcccttactgctatatttcatacgaaaacattctatatatatatagaagtatttttaaaaatatcagatactaatgaaaacttaattaatcatataatggttttcttgtttcttatgagctgactttatttttaatcttcagtgaaacaccctcatagtggcgtcgtctgttcatttccgcctcccgactcccgagtggcaacggcggcttgaagtactgtcagtctgtgctgccacgtactcctgactcgcgcttgtacgttcgcggcggccgtgtgcgcgaccgtgcgtggcggcctacacgcaatccacggcgccctcgttttggttccgccgtccgctgacttccgaggcgatacagccatacaggctttgcattggcgcgtgatctcaacccatcgatcacgccatgagatcatgttcaccggcttgaaaacgggtacgccgtacggcgtacgcgtatgcgtacggccgagctcgattgttccataggagtagatttttgcagagtagcccaacctttggacctttaattcagtcgagatctcga

SEQ ID NO: 48510 - DNA, 8064 bp, Oryza sativa
cgtccgagagaagggtcccactcccactccgacacaggccctgtccttctgacagcgggccattgggaccctactgtcagtcgcacacggcgtacctgcgggctcgccgctcgatcgcgtgatcgtacgtggacttttaaaccgcttcgcgtgctccgggcgctccgagccacgtgcccaccggcacctcgccgcgcgggatcctctacgcccaaatccaataaaaatccacttcgctccacccagcacacgcgggctacacggttccaacgcagatatccacggatctcgtgctcccgctcggttcccttccctgtacctgtccaggcaacccgtacccccgccctgcgcccaccgacaggtggacccacgatcttccgggcccacatgtcggtgacgtacaggctactgtttcggtgacgcggacggggacggagggggtgcgttgcgcagctactagtagcggccgtgctctccaaacagcggcagtggtggcgctcgcatttttttttcagctccgcggaaggaacgaaacccaacccaagcgaggcaaaagcggcggcggcggaggaggagaggagcaatggagagggcggtgccggtgaggaagccgcacacctcgacggcggacctgctcacgtggtcggcgacggggcccgacgccgccgccgccgcggcctcgccggtcgcctcctcccgccccagcctcaaggtaagctatgactaagccgtgctcgaatgctgctctgcttccccgtgcgttcgagtgcgacacgcgaggctgacttttttgagggtgcgtgtgggttgtttgtgctggtgttgtggtgtgatgtctggcggccacagccggccggggggatcacgccggcgatgttcggcgcgccggtgagcgagaaggaggcggaggatctgagcaagaggtgagatctggggggggggggggggtacccatcctgccgcattcattgtttcgtccctgatctgatcgatctatgatttcgttgtgctgtgcttctcattcgattaattagcctgatctggcattttgatctacgaacgtgtgttctctgtttgggcgtgtggtttagtgcatcaacatttcgaacttaggaaggttggttggggttgttgctctgggtttaggaagaagtagcagctgaagaaaaaattgcgctctcgacgcctttaatttcagggtggtttgctggagggagaatagtcgcttgcaggtggttggttggttggttcatgtgacgatcaaccgtgtccgtgtatgtgtggtacagtgcaaacatgagatgtttgctaatgtccaaatttttagtgctagaatccaagttttagcagtacaggcaatgatgcttgaaagtgatttgggctgaggcaaacggcaaatgcctggttcaaaatttggatatttctgtcgtgggtgccacaaagagaccagaaattatagcttaataagtcaagtcatgtggagcctgactgtttgttctgacctgcagttgtgaccatgtcattgcatacactatgttattacttcgcctgtcatagaattttgtggagtgttggctgtttatatttgtataatttatggaaaacagtccatgaaaatttcttgatggaccactttctgtggtggccgaattatggtagatgttcttttttatgcacctagatttttctagtttatctgcctttgagtattcctgcttctctgctagaaatttatcttcctctgcggttgaagctttggcttgaaactgtctatcttgcatgtaaagctcctgttgaatttttacagcattttcttattgtagtgcagttaatggtacgtactgcctgttttagttttgacttcattggttttgtataccaagacatgaagttagttcgacgaccaactcttaagtgtctagttgtaacaaaatcagtcaaatatcctttattcatatgctatactttttgaagatatggtatattgaacttataactttgttggcctgttatagtgaacgaaaattttgctcgggctcaaagttaaaagaaatgactggaagtgggatattcgctgagaatagtgaaaatgatgattcagaggcttcaaatcctgcaaacaaaacttctgtaaggatgtatcaggtatttcttctttcttgttcagaaacatgccaatcttcctcccttttattgagaaatatgtgtttctcttgttcgtgttgctgtggtgtggtaataagcaggattccatataatgtgtgctatggatagagtaacaagcaaagacacttcatacttcagttaagatttaagaaaaaaactactactcttccatgcatgaaacttgacaaaaaaaaagacacatctggagaaatatcttatttcgttttggtttatgtaattttatttttagttgcatcaatgtcccgagatatatctttctcttgggttgattattcaaaatctcaaaacattatattcttccagtaatataattactgatgccctaacgtcttttttcataacagcaaactgtaactggaataagccaaatctcattcagtgctgatggaagtgtttctccaaagaagccatcgtcattacctgaggtggctaagcagcgagagcttagtggtacactggagactgatgctgaggctaaaatgaataagcagcattctgaagccaagagcaaggagctcagtgggagtgatatttttggtcctcctccagagatccctgcaaggccattggctgctcgcaatatggagctgcaaggaaatctagattttgcacttccacaaccgagaagcgtccacacatcagtgaaagtatccaatgtaagtgacatgagtatgaatatcctgtttatgtttctattccactatgtatcattttactgtgtattctccattagtgacaggaaatcaaccaagcacttactataggaaaaaaaatagtagtacgtcttgatgtatatcttcaatataaacaagccatcataactgtttctgtttcatattggccaatgtggaatttcaggcttttgttattgagtaccgcaccacggcaccaatcttttgtagactgaataatttactggttagatacgccaaaaaggaattcataccacctttctttaggaaaccacaactacagaagggaccttttcttttgttcctcttggtgatacaggatatccatacaccttacagggaatggatgctcaaattaggttgcattgatataggtgtaagatgcatcagctacagtttttttttttaagcatcagccagaaatagcagcacaaaggatgacatttctatttgatagatatacggcttgcatgacatattgacatgttgcattgccatatgtcatcaaaatgtatttggatttaccttgttatatgaacatttcacccttaaatttgtatgaactgaatgcctttgtagcctgctggaggtccaagcaacatcacgttcagtgaggagcctgtagtcaagacgtcaaagaaaatccataaccagaagttccaagagttgacaggcaacaacatcttcaaagaggacgctacccctgcatcagctgagaaatctctgagctcagcaaagctgaaggagatgagcggcagtgacatctttgctgatggagcggcagctccccgagactatctcggcggtgtccgcaagccccctggtggcgagagcagcattgcactgatctaatcgccgcaggctgccctaatctggactggctacttttaccctcatcgctgaagtccgtggcatgtgctcttcctggaccctggttcttgatcatggttgagagctgatatcttggccctgatatcatctagagtcagcagaatctgactcagcttatgtgttgtaaacttgacttaatctcatctgtcttatggtacttatgtattaatctccttggactgagactgaaataagttttattggttcatttttgggagctcatggtatcatcaggaaataatgtctgtcttgtatcaaattaacttatttgtgagttatgcaaaagataacgaaggtatctacaataccatttcctcttaacctggtttcctttgaaatttgggagatacaacctggtttcatttgaaatttgagagttacatggatgaagggagaaagaagaaaatactatttcctctaacctcgtttcctttgaaatttgggagatacaacctggtttcctttgaaatttgagaggtacatggatgaagggagagagaaaaaaagagacgaaagtaaatcgactccactggggatcgaacccagaatctctggttccgtagaccagcgccttatccattgggccatggagtccttgttggatttttggacattacggacttgtttactaataaatttcaacctttccgaaatttcacattaccttttagtaggataagttaaatatgatgtcaattctttaaatgttaccatacatttatccaaccaaataatggtatggtttaatggcatgaatctgaataaccctgccgtgcccgttcaagcctaccaccgcttcccaccgctggatccgccaccacctcacctccctaccaccgccgtgcttccgcgggatccgccgtgcctgctcgagcccaacactgcactcctgccgtcgccaacctgagctagagtgaggagagaagtgtgagaggaggaggggagagagagagagagaagaggctctggaaaaaaaaagagaagtgagagagagaaggtgagtagataaggatgatacttacaaattatgaaaatgctgagacggaggaaatgaggaaggttagacttgaaggtgggcctttaagaagcccacgcatgtggccgcttaagaggcccacctgtgaaatagtcttgtttctgcatgtgggtgtgttaagaggtccttctataaaaataggtttttgcatgtgggtcttttaagaagccgtatgtgaaaatgtaggttgatttttgtaggcgcgaccagttacggtccgcctacaacttgtatagaaaaatcgtttgtaaggtacgtacatgcttgaaatttggaaggaatacaatgtctcctctcatcgtagcactcggatccactttgactctctcgtgcgtccgttacctccttgcatcatggaaggattgtcctctctccatccaagccacggccttagtagaccgtctaaacaccacgttctctttttttctgatccttctcgttttattaaaaaaaaccgttgtaatgcgctggtactttactagtacaaacaacacaaaaggtgtcttgacactcttataaataatctgagcgatccttgactctacacagcagcatcctttttttgttcaggtccagaaaagctggtacgcttcacgaaatttttatccagaacatcagatggtaaagttcccttgaggctggaaagattagaacaaaataaatacaataaattctctcaatgggtttgcatgttcaaacaggttttagctctgcattacttgtataaggcaccgtgggccactctgatcttgctttcagttacatcaataggggccaaaagctgcaacgtaagatctcccattaatctgcataaaaaggccatcagaatggtgggtttctttttttttgttgcatttttggaaagttgccctggggaaaggatatatttgttctagcaaaaaaatcatgtaattaccgtaagtgttcagaaacaacataagtgccactgtcactatttgagctatctgcctcctgtgtcaaggtttttacaaggtaagtttagtatccgtaatctaaaaaggagtagagtgctatgccattaagcacaatttagaactaacaaattttaagctcgaggaattgattatcaaaacatacatggatgtcctttgccctggtcaacatatcgaatttttggatcgagagatgatgccgaatcagagaagaccaatggcatactccaattgtaccttctcttcaaagattctacgtttgtctctacaaaatatataggcattatttcgtgtgcttatgattggtatcatgctaaatgtgacctatgaaatctgtccaatactgacataaaaaatggtattctcagaaatagacttatcggttacctatattctggagctgctccaatgcagcaagaagattggtatctaacaattcaatcatttccctgatataattcaacaatagcaataagtggcacacatgtcaagatgcagcatattagcattagacagcaaatgtgtaaccactgtaccaataacagctacaaattacctgttggtgtgtttatccagtaccttggtcaagtgagactctcaaaaaataagggcacaacaaaactgttacacaacaacaaaagaaaaaaaatgcaacactcaagtagcagatgcatggttgttaaggctaggtgacatggcaaggtccacccacaccttaagactaaattcataagactaattgcgtactactagtgccgaacctcttctttacatcaattaaaatgcttcccattattaagctagcaaagaattaatatagttttgcatggtagtggaaggcgtatcaataagatcacctggagccttgccgaggtgcttgaaaaggtcacattgcaggtagatgcgatggaaaaacagaatttcctgggaaaacggtgagactttctctagcttcttgttctcggtgttgacagagagcacccaaccacttggatcagtacccttcatcttggccattacataaagaatattgtcatcgtacaaatccattgtggggtaagtacaaatcaagttcgtaaaggtcagctggttgtccttggaatcccaaatcacaggcaacaaatcaagggaacacgaatcggcgcacaccagctctgcagagtcagtttcggtgccgcatggctcccattggcattcctctggacgaaccaacctcttgaacatggtggcctgccaccgaaagtttaactgtccagtgctgccatccaacagcgggaatcccatctcaatgaacctgaaccagccattactacaggtgatatctcgatttggatccacagaaatataggtatcatccaaaccccctcctctgaggtacctaccgttgatgggcatcaacgggggcagctgtatcaggcgcacctcggggttgctggtgaccgagtcgaagagcagtatcccgttccagagatcaacccaggcaatcgatcgtccttcaacggacaacactttggtgggtataaaatcaccgatatacgcctccacgccacatggcagccttgcgaccttactttcccacgacgtggtcttgctcgagaagacatgcaggtcgcacctcacctgaccatcggcgtggaattgccatttggggttgacgaccaagaagtgctcgccacaggatagtatgccgaggtggtcggacaggtgcttaaccgggtaggggccccgaaggagctcgagcaccggtgtccaagggcccgacctgtaacgaagaagtcggtaaaacaacgtcggtcagagcggcaggggaagatgacgcgtatgacgaggaaggcgcagtccgcgccgatgatgaagggcggccccttcgagaactcgcccgccgtcaagccggagcagcgaacgacgcagcgggtgaaggtgggtgggtcgccggccacgaaagacacctcgatgggaaggccatcgctcgtctccgccctggcggtggttgcgtcgtcgccacagccgtccgcgtgcgctaccgtgtcgaggaggaccgaatcgggaaagtcgaagcgtcgagacgtggagccggagctagctggttggggcatggcgaatcggcgagaggcggcggcggcggacgacagcattgatcggggaacggaggcaagaggcagcgcaggcacagatttggatttgtcggttagcctcctactcaactgaagcccaactacgacccgaactctcactactagagatgtacgcggcaaagtagtatgatagtattgatgagtagtatcatcagatgacaagtcttggg

SEQ ID NO: 48511 - DNA, 11468 bp, Oryza sativa
  unsure (1)..(11468): unsure at all n locations
actgcatgatttcatctattgcaattggtcagatgacccaaaatagcatgtttcagtacaattaaattagaacttaaggccacacaatctaatgcaaaaaggacctgccgacaaatcatcacgacgagcgggacttggctaatttcaccatgagatgctccaggaatcatacatgtgtaaagagaaggtgcctaaatcaaatcaaggtaaattaggaggtggggatttgcaacaaatcttcttatagggggcatctaaaacctagagtgatatttggggtggtttttgcaattttcaatggcaataaaacggagaggcaacgagcgagccgtagaggagtacattaattatgttcaagaaagtagaaaatgaactcagacaataattatgttcaagttttaaaattccaatgacaataaagagaagactcatcaggcgggccgtagaggagtatagtgacaacgtttgacatgattttttctttaaaaaatataaaaacgaaacccaatgagacaataaactccaaaaactacaagatccaatttttaaaggttttaatgacaatgaatagaagcagtggtagatcgacaaaaaaaaaataagagtaaattccctgtgtacccctaaaaactcactcaatccctttcgtacccctgaaatttacccgatctcttctatacccctgaaatttcaacttgatcccttccatgcccctaccgttacattttccattatttcactattacatttggttgcaaatgtcttttttgcccttgatgctataggtttgaatataagcttaaaagcgattgaaaattttgtttgagtgcacagtacgtgcattttatgaaaaaaatgagactaaataattagtgcagaaaattttgacataaattttggaaataaaaaaggtaataaattaaaatttttatttgaaattttaataggacaatgatttttttttgatcgggagcattcataaaaaaattattatgaaaattggttgtcctatctttgtatgaatgatcctcttttttttttacttattttaaaaataaatacacaattttttatttcattatctaaaaatattttttgggataaataatgcatcgcacaacaaactcatagctataatagtttcgtgtgagaagcttttacatttttaacaatgtaattcatccaaagggtaaaatggtcatttttatagaaattagacggtcaactaacaatcaactgacgggaggggtatggaagggatcaaaatcaaattttaggggtatataaggaagtaagcaaaattcaggggcatagaagggattagttaaaatttcaagggtatacaagggattttctataaaattaaatgaggggtgacaaaaaagaaagtaagaggtaacaaccgatgtgacttttaaaaattataaaattagaaacatggggatgataaggctttgtttttcaaaatctttagattacgagatagctatttaacaatatttaagtaaaatcatattaataaatagatatttcctccgtttcacaatataagtcattctagcatttcccatattcatattgatgttaatgaatctaaatagatatatctatttagattcattatatctatctaaattcattaacatcaatatggacgtgggaaatgctaaaatgacttacattatgaaacagagggagtaattttgtatgggtgctagcagcgcaattgcgcgagccacccatctagtttttcttatataaagttagatgcagaatttaattatcttgtaaaaaggtaattatcttgtattatatattactgtaaagaatataatttaattccactacctctatttctaaaaaaaaatcattgtatcttaaaaaagatctgttggtgttcggtctcagcgtctatagcgtgaacaatcgcgcagtgggcttttttcgacttttgggctagcaagatcacacacaacacgcacatcacgaaccggaccaaacctccgccgccgcccgccgccgccgccgccgcctacacaaccccccctcgccccccgccgcgccctcctctccgtacgtggagcgcatgcaaatcccctcgcgctcgattcttcgcctcctccgacgccccatcgtcgcgccttattctgccctgcggcaccgcatctcgatcccctcccgcgatctctcctctcctccatggctacctctggtccggctcgcgggtggctaccggcgcttgcgcgaagaatcgcttcagtcacggggacgcttaaccctcctgccagtcgtgtttctcggtgtgttctcctgctctgatcctaaagtttgggcctttcgtctcttgctaaagttctcgatatagattctgttgaatttagttttttttttgttagaactatttgttcttatatcatgttggtgttttgagtataactagggaaattatttcaatcccgactgatggcacttgaatcggacgcaaagatttacccttttatgctctttgttcatagatttcctggatctcggaacatggccagcggcagtggagtggaaggcgagggattgggtataccatacaggcgccgcttcatcccatttgccaacgatcctatccacacaaccaaagataatatcatttctatggacaagcaccttcccatcacccaaggcaaggacagtgctgcaactaaggagttcatctcttgttatggccattgccgtcctaccacgtatggcgatgaagatgcttctaggacagctgtggaggtcaccggtggtaaacaagatccaaggggggcagttcagaacctaatagatggtgaagtggcagttcaggagctaatagatggtgaagaaattgcaaggaaccaaagggccagtgaggttagtgacaacgatggatatgaagagttcaatgatcgtgctgttaactaccactgtgactgtcatgtttggacgccacttattgcaagcagccaccgtgacggttctatatacgataccaggggcacctttggatctgggtggaaatgggattatcgtattgcagatcgtaacgagagtaagtgatatatatctattttcctgttgttatctattttataattaggacatttgtcaagctataggttcagctaatatattctatgttgaaaggttagtgtgcattatattttgtacttaaaatgataaattaaactactaaaaccgggtcacttcacccctgctttaaattgagattttgtaccataatatgacactccactctatgtcatgaatactttcgcaatttctcatgattatctgcatacattatcacatcccaagggtttgtgtccaggaggaaggtggcagcaatgctgccacttatgcaaccctagggtgccaaccagtcctatggctgctggggcccaccatgtggccatctgacctacatgccctgaacaacaaacaagacgagaaattctgtctattattaagagtctggagtctagtagactaggaagttatcaattaaatagaaatatatctcccatttaagttaagggtggcataatagatgatatttatatcaaaccacagctctaagtatcggaagaactttttatttgccactacagagtgtcctattctgggatacgccattggaaaatatcttatacggtctatggcatccacctcacaaatttcacccttatttgcaattgttgaccagtcaagacatgggaaaggtgtaaaattaggatgcctcatccacctcctaggtgatcattcccatgatggccatgatctaactggtgatgcctcctcgatggcactattgaacagaggcagcattctaccatgaccacaatcgatgaagtgtcacagaataaattgcagactttgtgcttgagggggacaattgtggaccagtggaacagagccccctcaactccaaaccatggtggtttgttcccttgtttgggacctgatgttcttttctttttcccctttttttttattttcttctgtcagtctgaattggttactagaaattacattggacagaaggtgttttttttttttgccttatattgtcccacatgaagtgatctggttttagtaattaggtgggggagtgaaatgagacgggaattatctagacaaccaaaaagctttagtcattagaatggactttctacctttatttttattgtaccatgcatgtattttatctactctttaagtttccgttacaatttggcatgtcatctttgttgtagctcggttggaggcaatgatgttatcacatcccacgaaagattgctacatgagggatggaacttgcatatggcatcctgcaaatagcatgttgcaaattttctcagtaaagttggctaaaactcctgtagttgatggctcaattgaattgtatggatacattgctgtgcgggaccttcaggatccattacttaattatatagtcaaaattggcagggatgatcccatcattgtggagcaggtatgcttccatgctctctacaattatttcaaattactttatttgtttcacattataagatcaaacttacagcatgcatggaacaaatgtgattagagcttacccaacattaaccttaacactaaaccgtccttcacccatggttagccaattttgtgctaaatggtcatttaaacagaaacggctaaccaccatgtggcgtttaaacaggctaaatgaccattcaggtgaacaatgaggttaccttttgttgttactccctccgatttcattttaattgacgttttggacaatgacacggtctacaaaatatatctttgaccttatttttctattataatatatgcaataaataaatgcatgtttacttttattatagtgctttgaaagataaatctatatatgttgtcctagttttctttaaactagatattttaaaagttattgatggtcaaagttataaaagttcgatctcaaccttgtccaacacgtcaattattttatagagccggagggagtattttacagccacaaaatatcttttacattactgaatttaggatagagtggaaatggtgtattaggctcagtttgatagtgtaggctcagtttgcaatctttttttcttaaaaagaaatgaaatagtagtagtctatggtttccgccatatttctcatgtgaatgttttcttttcttaacagaaacaggctgctactatgattttcattgtcccaccatgatctaacggcttagtttttttttctttgataatgtggtaattttttttctgaacagaaacatgccgctactatgattttcattgtcccaccatgatctaacagcttagtttttttttctttgataatgtggtaatttgtaggtcttcaaagtgaacatagtgcctctttttcaagctttctttatagtataatagatacataacatacgtgcccgaaaaggcagctaaaatattatagtgttatagctgcaaaaaatttgcttccataaacacatgtctggacagtgaggaaggtgagttgggatgcgattagtgtgtccaaaagtaacaaaataatattatggattgataagacctttatcaagtactatattgtggaatgataattatgatcagacctgtattaatcatgaactaggtgcaagtgagtgtacgtgttgcaaacagaatcaaatagaatagtttcgaaccctttggttcctgcctagtaccacataaaattgttctttttttggttgtctacagacatatgaatgacccttcacaacaaagtccttttttgtttacatttcacacaagcttatatgattaatattttggaattcaaaattaactcaaataaatagcgtgggacaaaccttctctaacattcttgcacacattgtaaccgttctgtttgacacatgacgaatatcttgggcatcaactgtaaaatgatccgtttagctaggcattattgtgactaaaacgttaatattttcttagttacttactttgctatgaagagctactaaatattaatatttttttagggttccctcatcgaaatgactggccctaagcgagggatcgacttttcttgtgctgttctagttgaatatgacatgagaatcaagacaggagaacgagaggaagatgatctacaactgattgatggtgcaacagatcttgaccatatattgacatcacatgtaccagtgagaaatcgcatttatggagattgcggcgcagttgacataactcaagcgaatcttttgtatgcatttgaggcgactgtagaagtcgtcatatcagaagtgcagactagttttgatttgtgtctcagctgttttaccagtgggttacatgaggaaattcggctctttgatggtgcgatcagtgagtcacgtgacttgaggaggtatgtgattgctgtcatggaacatgagtgtatggatttgaagttcaaggtaggtttagggtctgggtgtttcgctgaacattgtcgatccttcaaagcaactaatcatggatgtgccagtgaacaaataaagattgagttcgcctcaatctcggtgaaggtcacttggtcggctatggagttctagaagggtacttagcgtttggacattttttttttatttgttactccctcagttctatattgtaagactttctagcatgttcatattcatctagatagatagatagtgtgaagctagtgttgctagtgttgagtgtaggcatgtgtgtgtttcagcccaacagggcccattacaccaatgcatatgtatagtagaagagagaggaaatagtgtgaagcttctggagaaaaacaatcacctagcaacatggtatcagagggcgaccgcgtcgaggctaaaccctagctagcggcgcgccggtttgtggtgctgcagcttggagcaacggagtggtggcgttgacagcggagacggcgacagctgctacagaggatctcgacgcagccggcgtgaaggagggagcagggtgtgcgctcgctggttgagccgcgcaaggggaggacgcacggcgggtgagaggcgcactgtacgagctgcgtctagacttggctgtggtagtgttcccgaccattatgggtctagacttggctatggatacaaaagcacaagctaccgtcatctcggaaatgcatgccaactgtttagagttgagccatggagccatggtgtccatactagcaatcctgatgtcttgtcaataccaatatctaaaatggccagtgtcaaggctgctaacaacatcaccatcgaaccagtggttcagtatgttgataaagagctggacaaggcatccaatagggataaaggggccaaaggaacagaggtatggtggtggctgatcatttccaactgtggccatctctcttatcagcttannattngtgaatggtttctcaacactgcacgcagcaaaccaaatgngcncactcgccttactcaagcaggagacattggttgtcaagttgcgctgcgacgagtgctagggtcatcatccaaatgcagccaaggtgacttaatgccggtgacaccaccaaggccactgacaataggaaaattgcataactcgaggagccgttctgctggaaacacaactgaagccgtacaatcaattattgagtctcatgcaatatctttacactgtagaatttccaagtcaatgtgcattgcacttaattttgttgagagctggctacaaaacacagccaagaaattatgcaatggccagttgcttaacctttcagttgggatacattttgacgacagaaagatttctactacattgttttttgctgagttgcttgagcacccaataatatattttcaggtttacttaactgcttttcactgtgttcattcgaacaaaatcctgagaccatggattattgctagagctgctaatgagaagcagaacaggaaggtcaagagatgtggttatgattccattgttggttttgatggaaacaatcctattgatgccagtattgcagtaaaggtttccattgatgtgattggtacttggacagattcagagacgctatatgcataagttgcaaacaaggattatttgtctgttaaattacttgagctggtaagaaaggggtccaatacatactggttattagaactcataactaatgagctgaatccttggtgtttactcagatatcagagatggctagaaattctggggctcccacctttgactagggctgcgtggacaggacaagggaagatagaacaggacattagtgtggacataatttcagcatctcaagttatcaagtctctctgtctgaacaagtcatctattaggagctactcaagttattttctcctgatacatgctttggtcagtaaattgagagcttgggaagcattggtggaaaagcatgtgcatcgtatgcactccaaagataacaaaagtactccctccgtctcaaaaaagacaaaccctggtttccgtgtccaacgtttaaccattcgtcttatttagaaaaattatgaaaaaaatttaaaaagataagtcatgcataaagtattaatcatattttatcatctaacaacaataaaaatactaattataaaaaaaatttatataagacggacagtcaaacgttgacacgggaacccacggtttgccttttttttttttaaggacggagggagtattgttgatgccttgggatccaggaggtttccatcagcttggggacaagctgaattttatgggggagggaatgttaggatcctgcctccttccatgggcctgtcaggtcaaatgcatatgggcctagccaaccatccacccccgccaaagcacaagcaagcaggtagaaggtataaaaagaaacagatacttcacattggaggcatggtgggatcaattggcgagctgaggctcacgacggcgacctaggcggccggtggcacccttgtcgatctcttctctttctcctcttcttccttgagttactagcaacttgtatcccctattttcttcctttgtttcaccaaatacttgcaagtggtaacaatctggttgctaattgaattggagcaaagggtgctaacaccacgtcagcgggccccacgaccacccgaacgccgccgagaagacacacgtcagcgccagcaccgccacggagtagcgcctcgccatcgccgactcgccgtcccgcccgatctgcgaccccatgatccacgccaccgcgacctggcaggcgatcatcacgtacgaggccgctggtcaagaacagtacccggcggccgtaccggtccaccgtggcgatggagacgagggtggagccgaggttgacggcgcccatctcagcgacgcgttgtttcggtgcacgtgtgctgcaaagtcggatggtcacgcccggtagtggtgggccggttcatgcgatgtattgcgtgaatttgggatcggtttgatcgatctgctgcccggaaaagagctatttcgggaggatttttagtggttttgctacggacctgcaggttggtgaagccaatgccgaagccgagcagcatgctgtcgacgatgagcatggcgatgttgaccgcagcggcgttgacggcggcgccggcgaagaaaagcgccgcacccgcgagcatgacggcctgcctcccgaccgccctggtgacgcggccagcccggccaggtacagcgacgacgtgaacgccgtcagcacgtggctgtcgtagacgcagtactcgtcccgccgtgccgccgccatccgccggagcacccccgggatgaaggccccactccatcgccgtcactccccctgaccacatcatctccctcacagacgacggtatatataatacaagtgatgaatgtcgtttgcagccacgtgtaagtgtaacgacgtatcgattttgctatttatttgtcgacaaattttttcccaaaaatttgacagatataattacagtataatcgtagtataattacactgaaacttgcatgtaattacagtgtaacttgtatgtaactttcaaaaatctctccgtaacatgttatttcggtaaaatggaggtcgcgggaacaaattctttcacatatgtgtgtgctatgatttgttttcttcctcaccaaaacaaatcttgtaatagatctaacgatttaaaattatgtgaaacttatatataagttacatgcaagttacagtgtaattacatataagttacagtgtaattacactatgattgtactataattacatctgtcacatttttgagaaaaaatttgtcgacaaatgtataggtagtcccacgacgtatacgtaccggagatgccgatgtcgtagccgaagatgaggccgccggccggaggcggccatgaggcaggtgaccacgacggagaaggttatgccgccgcccatggggaacccacctccagccatatcgcgcaacggccggccttgtttggcacgcaatagccgcgcgctcactcgcgcactagttggttgggctggtagctagctatacgatagcaaaggccgatcgatcggggtgtctggtttttgtatatatccaaatccacggccacgtgcgggaggacttgtgttagttaattattaagcgcacggagcaatcgcgtgccaaaccatatattggaaattaactcgttcggctgctcttgctttatcaactcgttttgttttctttttcgttttgttggggcggaattattcagtcgtattcttgaagaggccctacgtacaaactaaacgtactccagattccagaagatcctcagtcctcactggcagactggcaggcacgctgctactcagattgcgatgggtttcacgggtggggtggttgttgaggatcgaatggttcaactgcaccgctgcatgcctgtggtgcagagtgccgttttgcatgccggcgcggcgtggcttcgtttagttctgaatctgagagatatgcgcgagttaatggcctaatgtgtaatgccatgtaccaaggcatacatacatacattgtacgtgtttgtgtctgtcagccaaaagttggctgatgacagacgcccatctagctcttgtcagggggcttggttttgctctcccttgatcagcctgtcatcacaccggcgggctgacgcatcacgcacgtaacaatttattgcactatctcgcggttagccgaaacaccacagcggtacaggcttgccacgacagctaccacagtttgttgtgcgtgaaggctgatgttcagtaaaaaaagttggtccgtcttgtactcttgtatcatgtatatgggcatgttgaattgtgtgtgatgtatcactgtaccttgcacagtgcgcaccaacctcccgagaagaaggggagtgccggaacaaagctgaaagagaaagcatggtaggaggaatgtcatagtgggccatcagaaaagcgtg

SEQ ID NO: 48512 - DNA, 2600 bp, Oryza sativa
agggaaaacgcaaggcgtccggcatggatgggtggttccggctacgtcggcgggagaagcgacaacgtcggcggcggcagcgaggcatcgggcgctcggaagccatgggggatgggagcgagcagggctagtgggtcaccaccggaggcatggctgtggattgggggagaggccgccggtgacggggaggtcaatggaggaggcggtggcatgagcaccgacgcccaactcctctccaccggccgccacagtcgccagagccatgcctccgtcgcgagagaggagaggggagagagagttgatgagaggggatggggattgaggaagaagggggttgagaatgacatgtggggcccgcgtgggccccaccattttttattaatttcagtgtgaaactgacatgtgggtcccccgaggtttattattatttttaattgaattgccaggtaaaggccacgcgggccccacatcagatcaagacctagtcaaattagtcatataggcgccacatcaggcaaaaccgccatctaaaccgccgagggacctaatctgaaccggttttaatagttgagggacctgtaatacctggttttgtggctgaaggacgaaaatcagattcgttgacaagttaagggaccgagatgaacttattcctattcatctagatagatagagaattttttgtatttttagatttttttttttaatatttacagaaatattatagcgccgaaaaaatttgcaaaactagaccctgccgcccttcgcaagggcggcaagccgacgtggcacacgccgcgctggacggcgcgggacggccgtcctcctgccctcttgccgccctggcaaagggcggcaggacccacttgccgcccttacagagggcggcaggcctggccgcctataaagcccagccggctcctttgaggagcccattccctcctaacctctccacatcaaaaaaaaaaaaggagaaggggaggagaagaaaagaagaggcgaagccctgccggtttcaaacttcgatttcaggtaatattcgtagattatatacgtgactaaatatatgatgttaactaggatatcacttgtatttttgtagaactttggttggataaatgcattgtatgaaatagagttttacctgtggtactatataaatatatattgttagatgtaggcagggtttcaaaaaccgccgggggctcggttaaacactgtagtcgtttattatgtaaaataacggcctagtaattaactttgcagatatgtccagtaaacttatatttcaactataccatggtcaaggaaacgtccgttatgggccaactggggtagatctgtcagaatttattgtaacagcaaggggaattgataggccagccgagaggagtgtaccttctattaaaaaatggttgatgcggggcttgggagttgatccacagactagtgacattacaatctactgttgtagtaagtcgggcaacagagggtttttattgggaactaatgccggttcaaaactctgggatgtggagatggtatgtggagaatgcattgcaacgtgggtggcctctagctatggttccgtatgttcatccgaaggatccaagtgtacagatgaacatggatgatggcgaggggccaagtgcagaagtgaatgagattgaagtggatcaggtcaacgcaccagaggaagatggagtagctccagtagtagctccagtaggcatgcaacctggtggagtggctgacgagggggagactgtgggtgccattgtggacgaaatggaaaaagaggatcgtgacaacgagcgtgtcgaggaagatgattcgtcagatgatgacgagaacaatattaatccagctgaatgggctagtgatgatttttctggtttggtcatctctgaaggggaaaatgtgagatgggagtacaaggaaaacgagattatcgagggagcgaggtatggtaatggagaagacatgaaggaggcggtgaagcattatgcagtgtcacttcatagggagttttgggttgccaagtctaaccggacacaatatgaagttaggtgtgttaatgaaaaagatgggtgtccgtggagagtgcacgcctataaggggaaatggaaggactactggacagtgtcggtcgttacgaaacatacttgttatctacctggtgttcaaaaataccacaggaacattacatgtgcatttgttgcatctgagatgtatgcgcatgtcgtggacaatctggcatatgaaccgaagtcaataatccgacatatcgaacagactttcaagtatacaattagctatgccaaggcgtggagggccaaacagaaaataatagagatgagatttggaacttatgaagcctcatatgacaatttgccacgtctgctatctgttatccaacaaagaaaccctgggacctcttgtgcactcaagacattcccctcaattgaacatcctggcaagactgtgctgcaaagagcgttcttagctctacatgcatgcaagatggcattcgtgcactgtcgtccagtactttgtattgatggcacatttttgaccgggaagtatcggggccagatact

SEQ ID NO: 48513 - DNA, 1515 bp, Oryza sativa
tataatgacaacaaatttggcggaagtttacaactgggtgatgcgcggtgtccgtggactcccactagttggtatagtggagttcattttacatgggacatgcaagtatttcagggagcggttccaagcagtttttccctctatgccgaacaacaacattttatttggaactttcatggagaaaaaactagcggagtggcgtgcaaaggccatgaaacatcgagctctagtgcaaggtacccaacaacacaggtttgaggtactctgccaagacaaggcaggcaggggtatctaccgcaagagagtaaagcaggagtgcgttctcaaagacgacggcacatgtcactgctcctgtagaaagccgacgctgctccacaggccatgcacccatgtcatttccgcggcatctgagtgtggcatccaagatgcagtatatgtgtcacaatacttctccaagcaagcaatatatcacacatggagtggcgagatttttggcttcggtgtagctggggagttcacaaagattaacgatccgataatctatattcctgacccaacgaaactccgagacaaggcgggacggaggaagactcggcgcatccgcaacgatatggatgagtcggaggcaggcagggtgaagcggtgcagcaaatgcgatgaacgtggccacacctacaagtattgtcctaaagacaaggaaaaaccaagtgcggcggaggcaggtctatcaggatcagcagcagatggagctcgccctacgggtgaaggcactacttcaaggcgaccccgtcctagacgttctcgtggaacgaccggttacgtggtgtagttcgtgtgttgtatgttggcaaaaggctttgcttgtaatttcgttcgaacttatcgatatgttcgcattgtgttgtgttgcgaaccacttgttagacttccgcatgtaatgtcttcatgttttacggcttgtaattttgttttatgttatttcattctcgttacgtgcctttgtgtaacgaaagttatgttctcaataatctgcactcttgcatgtctctataagtattcttccgtttcagataacttgtttttacaattatattattaccttcttatttaccctaacatgtaacacgttacttgcagagatggcacatcctgagttgttggatccggcgatagatcagcgccaccggtcgtaccttactgcggtggagggggctcagcttgggacgttccgtccacggtcgtcacgtgagcgacttttggttcacgactccttcgtcgagaggtatggttttactgtattcacgacaccgggcttaccttactacggtggagggggcttagcaatgtgttcattttaacgtctggtattatttcgctttcgcaggttgcgtgaggccggtctcttaccgttggctcggctagttgaggccgcgaccggcgacgatgacgtgacgagacgttgggacccggacaggtccctcctagcagcgttggtcgaccggtggaggccggaga

SEQ ID NO: 48514 - DNA, 2806 bp, Oryza sativa
tcggtcgaccggggtctcgtgcactacgccaggagcatcgccgacgccgcggtcggtgaggtgcctcagtggagttggggctccgcgttgctggcggctcagtaccgtggcctctgcgaggcttgtaccaggacggaccctggcgcgatcttcggtgggtgccctctcttcatttctctttgggcggctgagaggattgcgatcggccgcccccttgtggagcaccacccttacgacgcgtcgctgtacgagaacagaccggcggtcgactacccaacgatgggtactctgtggtgccggcgtcaggtacgtcgctagtatttggtaatgttgtcctactattgttaacttcatcctacgtcacactgaccttattgtattgcagcgccgatgggctcacgtgcaggttaggcggtcgtacgcggagtttgtgatggagttcgaccgccttctgccgacggacgtagtgtgggagccctacagtgccttgcttacccacagtcgggcgccgctaggcctgtccacactctgcacgagggaccaggcgtactggatgactacggttccgatggtgttcgacatctgtgtcgagccgcacgcaccttaccgcgtgatgcggcagttcggcttccgtcagtcctttccagtcccgtttccggcgggcgtcacggctgccgttcaccggtaagccgttttactacgatttaatatgttgcattaacatcgggctgtccataataatttgctttgtttgtcgtttgccctaatacaatacattaatttgcaggtactcgcgcaagggtcagcactcagctggtcactggcctgccaagttggggccttttctcgacgactggttgcttgctaccgaggaggtcgtggaccacgcgggagagtcacacacggaggaggggtatgaggcgtacctacgttggtatcagccacgcacccgtactagagtcacctacgctccgacggagcaacaggcccacgccgcgagcgccagagacctctacgccaggcaccgcgaccaggacttcgctcgtgcggtgagtaccttgcatcgcacatcgtctcatcatcctttctgttggacaaaggctacgaatatttacgttgtaattaaccgtgcaggccgttgagtgcaacagggtcgtcgttgatgctacaacggcgatccaacggttaggcgcggggattgaggtgggggcagacgagcacctgtcgacgtacacgcggatacgggactcgatgcgctcggttctccgtgcgctgacctgtcgtgctgccgacgttgctcaggcagacgcagcaccacaggtgcgtccccgaccgactgctcctcgtccagctgcgcacgttcctaggccgacaccccctcccttcggaggtacgtatattcaaggtctatttgtacatcatcaatcaattgatactcaatttatgtgtaagcttacaagtgtcgcgtcgtcgatgtgtaggcttcgctcagcctgggacgacgccgggcgcccactcctggcaggctgcggggtcatcgtcacaggcaggtgtgtcggcctcgctgtctacacagttttggcaggacgccgggagttcgtcacagccgggcggcacgtctgttgcgtcggcctcgctggctgcgcagttctggcaggacgccgggacttcgtcacagccgcccggcacgtcttggcagggtcctaccgggacttcgtccgagcacgggtgggcttccgccacgcacttcgaccttagtgacttcgacttcccggacattatcggtccctcacagcttggaggcgcaccgccggtgcacacgcaggagcagtcgccctccaccccactcccagaccctcgcgctacccgtgctgtcccaccggatcgcttcacgtactcccaggaccacgtgcgagcacaggcccggaggaccaagcggggtcgcggcgcgagtcacggccagtagagcagacatctctttatttttctttacattcttgtactatatggttgtaaactgaatatgttgttgtttatattcgggactcgcattcctatacttcgctgttacgttttccaaaaacaggagtcccttccagccgttgtgcagaggggagcagtgaaggaagctgccgcccttgcagagggcggcaagccctcggcacaccgcggcccgtgcgcgccgtcaagacgcacacggcgccgtgtgccacgtcggcttgccgccctttcaaagggcggcagggtctagttttgcaaattttttcggcgctataatatttctgtaaatattaaaaaaaaaaaatctaaaaacaaaaaaaactcgatagatagatagtgtgaagctagtgttgctagtgttgagtgtaggcatgtgtgtatttcagcccaacagggcccattacaccaatgtatatgtatagtagaagagagaggaaatagtgtgaagcttctggagaaaaacaatcacctagcaacatggtatcagagggcgaccgcgtcgaggctaaaccctagctagcggcgcgccggtgtgtggtgctgcagcttggagcaacggagtggtggcgttgacagcggagacggcgacagctgctgcagaggatctcgccgcagccggcgtgaaggagggagcagggtgtgcgctcgctggctgagccgcgcaaggggaggacgcacggcgggtgagaggcgcactgtacgagctgtcgtcggcggagaaggggaggtcagcgacgcagcggtagagcttcgcggctgagaagacagagaagagcgaggtgtgcttgtgctgcttggatttggg

SEQ ID NO: 48515 - DNA, 1524 bp, Oryza sativa
gtgctactaatgctcctgtaacaactaggctacaggccctttcacaggaatgaggttttggctttgctgattgtgtgcttgagaacaaattgagggtgtagctaatgggcgatcgatcgccatccccctatacgctctctccccccttcctccttcccttgttctcttcctagtacaccataaattttaaaaaaataaaaaaacaaagttgaaaaaaatatgtgtagaaatactatatataaaaaatatttgaatttaaattcaaatttgaaacgggtatgtaaactttttgacttataaattttgggtctataaactaatatttgaattcaaattcaaatttgaatcgggtatgtaaacttttgacttataaattttaggtctataaactaatattcaaattcaaattcaaatttgaatttgaatcgtagcgtctcattacctccttcaatcatggaacgattgtcctctccatccatgtcgcggcctcggtagaccgtctacacaccacattctcttttttccgagccttttcatttttctaaaaaccgttgtaacacacttgtactttgctaagtacaaacaaaacaaaagaccaatcctaagtgtcttgacactcttataataatctgagcgatccttgactctgcacagcagcatcctttgttcgttcaggtccagaaaagctggtacgctccacgaaatatttatccagaacatcagatggcaaagttcccatgagtctggaaagattagaacaaaaataaatataacaatatctctcaatgggtttgcatgttcaaacaggttttagctctgcattacttgtataaggcaccatgggccactctgatcttgctttttgttacatcaataggggccaaaagctgcaacgtaagatctcccattaatctgcataaaagggccatcagaatggtgggggctctttttgcgtttttggacagttgccctggggaaaggatagatttgttctagcaataaaatcatgtaattaccgtaaatattcagaaacagcatgagtgccactgtcactatttgagctatctgcctcctgtgtcaaggtttttacaaggtaagttcagtatccgtaatctaaaaaggagtagggagtagactgctatgccataatgcacagtttagaattaataaattttaagcttgaggattggttatcaaaacaaacatggatgccctttgccttggtaatgttaaactcgggggaatatgactagggaacttacatatcgaatttttggatcgagagatgatgccgaattagaggagaccaatggcatactccaattgtaccttctcttcaaagattctatgtgtgtctctacaaaacatataggcattattttgtgtgcttatgattggtatcatgctaaatgtgacctatgaaatctgtccaatactgacataaaaaatggtattctcagaaatagacttatcggttacctatattctggagctgctccaatgcagcaagaagattggtatcta

SEQ ID NO: 48516 - DNA, 1534 bp, Oryza sativa
aatttttttaaaaaattgacatgataggttagtatttaatatatcacttcacaaacatacaaatccaaattcgacttctacaagttgtaacaaaaacaataaatttaactgtgaatatatgtatactagttagagtttgatttgttactttcgttacaacttgtagaagtcgaatttgaacttgcatgtttatggagtgatatattacatattaacctatcttatgaatttttttgaaattttttcataatcatttaggtggcatgcaagaaacaagtggacgtccacccgaaagattagaatccatcctcgacaagtcttgcaatcttggtaagaaactaaaatagaacacggactttggatttgttcatatgtaaacaatacaaatttttcgcaagaggacaaacacgggatggtattcaaccatgtaggaaccgttaaaccagaaaccagatttaattttacacaacttcccacgaattaatgcagcgccgccacacggtcaaggcagagaacacgtacagtatacgttgtcagttcacgaggacctccggcagcatggcgtccttggccgccggtggcggctgcacgaagcgcgccagtaccagtgccgcgcccagacggcgcccatggcctcgagcggcacccccttggtctccggcaggaacgcccacacgaaggcggtcatgacggcacccaggccgcgtagtagaggaacgtggcgtacttgaagctgcacagcatggcgaggaacgtctgcgtgagcacgaaggtggcgccgaggttgacggccacgctgatcccctgccccgccgaccggatctccaccgggaatatctcgccggggatcacccacgtcagcgggccccacgaccacccgaacgccgccgagaagacgcacgtcagcgccaacaccgccacggagtagcgcctcgccatcgccgactcgccgtcccgcccgatctgcgaccccatgatccacgccaccgcgacctggcaggcgatcatcacgaggccgccggtcaggaacagcacccggcggccgtaccggtccaccgtggcgatggagacgagggtggagccgaggttgacggcgccgaggatgacggcccccatcagcgacgcgttgctgccgaacccggccgtctggaagagcaccggcgagaagaaggcgatgacgatgacgccggtgagctgctggagcagcggcacggcgacggccatcaccaggtgggggcggtgctgcctccagaggatcctgcggtacgcgccctcctcgttggcgcgcgccgcctcgaccgcgcgcgccacgccctccagctcggcgtccacgtccgccttggcgccgcgcacgcgccggagcgcggcgcgcgcctgctccacccgcccgcgcacgaggaggctgctgggggtgtccgagatgagcagcgtgccgacgaggatgacggacgccggcgccgccgccaggccgagggagagacgccacccccaccgcgggatgcgcgccgcgccgtagtttgtcaggttggccgtc

SEQ ID NO: 48517 - DNA, 1543 bp, Oryza sativa
agcctaaaaagatttgataaaaaataatcaaaacgacttataatataaaacaaatgaagtatgtattaactattgtatcatcatccaacatgcatgacgcatgcggagaataaggcgcgaaggcaaaagcaacttaactcgagacggaaacatgggagctactcccactctcccgtcccggtcccaaccaattgaaggtatcagtagagtggagagatggagatgcttgcaatctttatctgaggcgtgagagcgattggttgacacaaaaccagccgctcaccctagctaactccaagggacagagaacaaattgaagcaagacgcaacaactaccttccagtctacattgccagctaccccgtttggtcgacagcaacttatccttctttcatgtcttttgaagtaattattccagacaagctgacataggcctactagcttgtgaatttgtttccattttgaagcaaacacaatgtctctatatttcttgaggattagaaactttgtatagttggggtgacagtaagtatggtttgagaaaaataactctgttgcgaccaaaccaatcaattctacgacacataaaaaatgccatggcaacgtatgattatgaaactacaagaacagagtgtcatgctccttgaatttctataggaattaaaaaacaataaaatcttgaaactaccattttagatgatacatagaaataggtaagaactttgtggcatgggaagagacaaacatgcggtaaaacctaatgatagttttcctccaaaattcctgtgaaatgaacaattctataggatttttaaaagaaagtgacaaagctagccattcctttgttccaggtgaactttagtgattgtttgtccgtttctcctccatatctctacaaacgtaaaggtggaatcctcttcaatcatccccatgtaaaaaaaccaaccaacctaaaaaaaccatcgtcccaaaaactaattttacacgaaaattgacccatctcaaaggactggatagaaaaaaagaaaattaaacctagtgaaacctattctcgtccgtcttccttctaaattctactagcaatgcacggagatggcactcgtactactttgaaattaaacttgatataaaaagctcaaaaaggaaataaaaggactacatcatgcaagtacacaggacatttcatcacttctgtacatcctcgattgtgcaatcaactatatatctcctgcatagtcgtttatgcttttaaaaatagagaaattttatagtactttgagaaagtattttaagttatctaaattttacactaaaattttagtaacttaagatacttatagtatatgaaggtaccaaattttatataaaacaatatagtactacattccagtatcttttcaatgatggtataacatttcccttaaaaatgcgaccatttctttccttcaaaatgtttcggtgcacgcccggtagtggtggaccggttcatgcatgtattgcgtgaatttgggatcggtttgatcgatctgctgcccggacaaga

SEQ ID NO: 48518 - DNA, 4086 bp, Oryza sativa
  unsure (1)..(4086): unsure at all n locations
gtacttgttccggcgggccggcggcattcggcggaacacccccgggaaaaaaggccgccagaaccaattccttggccgtacttccccttgaccttcaatattaaccaagaccagactgggttaaaaaaatggatgcgtttttttgcagcgcgtgcaattgtaacggccggcgtacttccttcccgaaaatgccaatgtcgtacccaaagataaggccgccggaggcggccatgaggcaggtgacgacgacggaaaaggttatgccgccgccatagtcgcccggcgggcgccgccggccacggggaacccacctccagccatcgctcaacggcacgccgtggcacgcaatagccgcgcgctcactcgcgcagttgttggtgttggttggactggtagctagctactacaatagcaaaggccgatcgatcatggtgtccggtgtttgtatatccacggccacgtacgggaggacttgtgttaggtaagcgcgcggagcaatcgcgtattcgcgtgccaaactatattggaaattaactcgttcggctgctcttgctttatcaactcgtttcgttttcttttcgtttttgttggggcggaattattcagtcgtattcttgaagaggccctacgtacaaagtacaaactaaacgtactcgagaagatcctcactggcaggcgcgctgctactattgcgatgtgtttcatgggttggtagctatgttgttgtggatatcgaatggctcaactgcaccgctgcaggcctgtggcttcgtttagttctgaatctgagttaatggcctaatgtgtgatatcatatgtaccaaggcatacatacatacattgtgtttgtggttggctgatagccagactcccatctagctttcgtcagaaggcttggtttgctctcccccttcagcctgtcatcacagcggcggcctgacgcacgtaaacaatttgttgcactatctcgcggttagccgaaacaccacggccctcaggctcgccacgacagctaccacagtttgagtagtttgttgttgtgagtgaaggctgagatttttcacgtcaacttggtccgtcttgtactcctgtgtgggcatgttgagttgtgtgcgatgtccaccaactaccatgaacgcctgcacagtgcgcacaaacctcccgagaagaaggggagtaacgaaaacaactcgccggaacaaagctgaaagagaatgcatggtaggaggaatgtcatagtgggccatcagaaaatcgtgcatatgggctagtttcgctggacctacaaagaaagaagacgcaccaaccaacgggtttggcaaccggaataaggttatttcaaatcccttaactttaccaacgaannnncaggtggtctttgaccacaaaacttgaatcaacgggtctctcatatgttaaaaccggtacaatataagtcccaagatagtatggcaagaggttttattctacgtggtaatttgacccaagtcaacaacactgagtcagcgtaggctccacatgtccgtggctcttcatctctctctctctctctccaatctcaacggattgttggaggacggcgcccgtcgatttagagtgcgaagcaggaggcctagccgaacatatcggtgaagggctacgacatcatcaatgggatcaagacggagctatagaagatgtgcccagaggtggtgtcgtgcacggatatcgaggcgctcagcacgcgagacaccgtgcacctcgctggggtgcccaattacaccatgcgcctgtgcgcaccaatcgccgtctccaaccacgaggatgacgacggcctccctgggcggacatcgttgtgggccatggaggaaaggatggcggctgatgaggcgaagacggctgctacagtgtcacgccccggactagtaccgaccggaactagcccgtgacgctccaaattaacctgttaatcgataccagtcccaggaaatagtgctggtatcacaggaagacggattatcacagcaacagaggtctctttattatagagtagaggtacagtcatgttgggctacggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactggggggggattatttatatagagcaagggtgagtacggaagtactcagcaagccatgggaaataagtgtttaatgcaggcttcaaggaaaggctgttgtttttgcaattgattttatttgaactcttttctgaaaacaactaagtgagtgcttctcaaacgacacggttgagacagtgcatctcgtccggtcggagtatgtgcaatgtatcagtctttttgaattgattcaaggttggcacccggccaacaactttcaaacggccacccgggcctacaatttcaaacggccacccgggctagctgatcccgtcagctgcagattttccaaacatcgaacccctttccacaacagcaatttcacaagcagtagtcaaacaaaactacgctaggaatcacctcacatccgctcatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgctgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtatacccggtacgttccccggtccgcggttctggaaaatccatttagttcgcaagcaccgacccaggtgtcgggttttccaagtcttttgtaaaacccaagttttacccaagttgtttttcagattttaagtttgaaggcgaccgtcgatactcgtgcagagtgcacgatctccgaggcgcaactgggtggttacaagggaacatggtataacaattatcaagggaaggatcaaatgcaacaaactaggtaggtctgccaatctgccttgcagacgggacaaacagattaagtgcgatcctatcaatgcataatatttttcaggcaacataattaaattcaaatataggctcaagatgttcaaaggtggcttgccttgctcgagatcttgagcttgatcctcgaaatcctcgcactgcgggttttcgggctccgaaactacacgcgaaacaggacaactcaacaaactgcaaaaataaagccctattaaagacctctaagcgtgccattagatagatctcgagatttgaggaattttggaagttgaacggagtcaaacggatttacggttgggaagatattgaatttctaagattattggattttaggtctaaaggaaaaaggatttaattaaatcctttttgaaaaagaaaagaaaagaaaagaaaagagggagggaaaatagacttttcctcgggcggctagggcgcggcccgagagaaatggagcgttccggccgagctaaatgggccggccggcccaaggcgcgcgcgcgcggtaggggaggagagagagagccggtggaccgggctcaccacgcgtggtcccgggtgggacccgcttgtcggtgacacggttcaccgtgcggagcgagcacgcggcgcatgcgcgcgggcgggggagggacgcggtgcacgcgcgtggttcgcggaggaacggatgcggcgggcccacgcgcagcctcatggctcgcggtggaacgcgcgcacgggaggggctgaccggggtcggcccgacccgatctcggccgagctggc

SEQ ID NO: 48519 - DNA, 6578 bp, Oryza sativa
aatttcgcaatttaggttttttttaagagataattttcccgctaggcgccacgacgaacgggcgctacatacagccaccgaggggggaagccaaccaggacgccaccaccaacgatgcacccaacaacatgccacttatattgttcgatgaaaaccaagcggcagctagtggcgccgctggcaatgaggcggcggcggaggtgaccaaaacgtccaagaagaagaaggccagcggcgccgagcgagtgaccgcaaaagtacttgccggcaaggcggcgcgacaaagaaggcgaggggctgagggtgatgggcgaacaatcattcagcatggccggcgccggcgccggcagcgagcaggcaacaaagtcgatggtgatgaagagccaatgctttagcatggcgggccagccgtaacattagacgaagaagatgatgatgatgctgttgtgaggaggacagtgtcaggctgaggagaagacccctcctcgcatctccaggtcggcgtactctgcccttttccccgctagccactactcgtcgtgctgcccttccggccgccgctgcatggatctaaccgccaggtcgccgcattggggaggaggagatagggagactggggaggaggagaaggaggagacgtagcgtcccactgtaaatagtttatttttaatataacagtcacttatatgtgggttctaggtttttcttttgactttaattgctacgtcaacgccaagtaagccaaaaccatcatccaaaccgtcttgggtgaaaagaaactaatctaggttaacgtcgttgatacgacgatccgtgttaattagcgcactcaaacgtgcggcagtaatatatatagctgtgcgcacaggtagaggaaaaccgaatccctatttgcatgtaacaacaacaaccttatctctatctagttcggttttcctcttatcctgtttacacgtgattacattatctctaacactccccctcaatctaaactagtgatgttgagattgctcttgaagtcttcaaacggtcgcacagccaaagctttagtgaaaccatctgctacttgatccttggaagaaatatattctatctcaagtaatcttctagatacacgttctcgaacaaaatgataatcaacttctatatgtttagtacgagcatgaaaaacaggattagctgataaatacttagctcctatgttgtcacaccacattttcgcagccttaggagcatttattgcaatctcacataggagagtatgtaaccacataatctctgctgttgcatcagctagtgccttgtattctgcttcagtacttgacctggatactgcggcttgctttctagcactccatgacacaaggttagagcctagaaaaacagcaaatccaccagttgaacgtctgtgtcgcgtcccaaaacgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatacgtaaataaattttagtggaattttcagagcacaaacaataattattaagaaataaacaaagttaaaatgattttataaaaagaaaagctctaaaaagtcttttttcccccctccccctcttgggccggttcggcccatctctctccctctctctcctcttccccgcggcccattcggtctcctccccgcgcgcgcgccgctgacgagcgggcccgcccgcctccctcgctgacgggtggggcccacccgtcatccccttcctcccgccgctcccgctgcctcgcccgcgccctagcgccgccgccgccgcgaatcccgccgcccccgtccgccccgcgtgcaatcaataggggggaattattccccgggatcccctccccctttccccccatttttccctctctctctccctcggattcgtttgtaaactcctcccctaacctcgccggcgccattaatggcggccgggactcccgcgcccgtttccccctcctgcggccaccccctttcactcccaaccctatataaaccctcaccgtgcctccctccaccgtttccgccactcgccgccctctctcctcgccggaatcgagctcgcgccgtcgctctctctctccgccgcgcccgccgagctccggctgccggcgtcgtcgccccggaccacccgcccccttggcgccgcctacttcggcttcgccgcatcctcgccgacctcgtccacccctccgttccgctcgccgaccgccggaagcaccgccgaccccgtccacccgagccggcccgccgcttcctccgctcaggtcgccgtttccgtcgtcgcccgcgacccggggtgagccgtggaccgccggttcgattccccccttccctccccttggcacgaccggaaataacccaacggtcattccttacgtgcgtgcattaatccttgtgccaggaggcaaggtacaccaaaaggtgatacaattcagaggttaacaagcggaagcggaaaaagataattattacatgggcagcgaaggcccagcacacacaaagacaaacgagaaacagcggaagactagggcgacgaccacaggcgcttgacggcaggcacgagctagacaccaaagccttcatcttcaaggaactcctcttctggggttgggaaaaattgagcaagactgagtacaaccaccgtacttaacaagacacacccgcaactgcagaataaatgcaagggagtacaagggaattatactataaagggttagggttgcagtaaacagcatttaaagacatttagttgctcaaagctattttgtaaacacgattctagaactatacactattattcatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattgaaacactaacttgggtacattgctcggcttgcccataaccgagggcgcggctattcgaatagattatactctgatcagaggtgtacatctttacccacaagacacctcttcctcacgtgtaaccacgtgccacataccaccacggtatacagacggaagacgtgacatagtttccaacccatcctagctatagacaagagtaccgacccaatcccacctacggccggaacccccgagacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacagtagtgctttgcaacagaggcccgaagaccggtccttatatggccgaggtgctaccatcaaaaccatgcaccccgagcccagcctaaaaccattttaggggattttgaatagagggggcgatgtgaatccaattccacaatactccaacaattccacagtgtccaggtgatatgaatattcccaaagtctagagttgtaaaaccgcctaatgttacctaattaaaagcgaagcatctacctaaaatcattctagtggtaccatgagtagagtgtccactagttggggttttgtttattctagggtgaacaaggaaataataacaaaaacaataataataaggtcataacaaaggtaaataggcatggctaaataaaacagtgataacgcgggaatttaaataaagcggatatgcaataatttaaatcaacataattttataaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttatgggaaaattagagacttgaacggtccaattccgagttcaaatggccaagttatggccatttgaagtttatatgctctttaaatggatatttgcgaatttcttcatttaaattttaattaaaaaacatatttattgcgtcagccgggggagagggcgcgcggaccgggtccacgggagtggggcccacgcggcagcctcacggtccacggtggaccgggtgcacgcggctgacgctggccggcgccgtgggtcccacgcgtcagccgcccccgaggcgtgggcggctgacggccgggccccacctggcagccgcgaggcgcgcccgaaggcggcctcgccggcacggccgacgggaggcggcgcacccgcgccccgatggtcgacgccggcgaccaccggcgcgcggagcggcgcccgagagagaggagagaagggggaagtgaaacggcggtcctcggctcaccccgggtcgacggtgacaacggaaacggcggccgaagcggaggaaggcggcggcgcggctcgggtcgacgaggacagcggcgttccggcggtcggcgggcgaaacggaggagtggacgaggtcgacgagaacacggcgaagccgaagtaggcgatgccgaagcgggaggaggtccggggcgacgacggcggcggaccggagctcggcggcgacggcggagagagagaacgacggcgcgggctcgaatccgacggggagagaaagcggcgagtggcggaaacggatgatgggaggacggggagcgtttaaatagggttgggagtgagaaagggcggcccgaagggaaggaaatcggcgcggcgatctcgggctccattgatgcgccgtcgaagttcgcgggggtaaatccgaacgaatccgagggagagagagagggaaaagtggggggaaagagggagggaatcacggggagtgatttccccctctttatggcgcgcggggacggcgggatgcggcagaatcggcggcggcggcggcgctagggcacgggcgggcggcgggagcggcggaaggtaggggatgacgggtgggccccacccgtcagcgagggtggcgggcgggcccgcccgtcagcggcgcgcgcgcaggggaaggccgatgggccgcgggggagaggagagagagggagggagctgggccgagccggcccaagaagggaagggggggggaaagaagacttttagggattttctttttataagacccttttaactttgtttatttcttcttaattattatttgtgctctgaaaattccactaaaatttatttacgcattttaggcttttaggaaatatacaaaaatcctccaagccttatttgacttttaaatttgcacattttaattgttggaggctttcacatggattttaattattctcggcataattttgaggatgtattttagagtcgttttgggacgcgacaaacctaccccccttaaacggaatctcgaccccgagattcggaagaactggcgaagagatcgggataggctgccttcagctcgtcttcacgctcccaagtagcttcttcctcggcgtggttgctccattggaccttgcaaaaacggattacccggttcctggtcctgcgctccatggtatccaggattttcactggcctctccacgtaggtcaagtcttcgcgaacttcaatttgctctgagtcggcctgctcggatggcactcgaagacatttcttgagttgcgacacatcgaacacatcatgcacgttgcccaaggaggcgggcagatccaactggtaagcgacttctccgcgccgagcaatgataacctgtgtacacctcgcaatggcgtgacccgaaggtacacaaaatcgtccactgcgaattccaagttacggcgacggttatctgcataacttttctgccgggactgtgccacctttagattatcccgaatggttcttaccttcgcttcagcttctctcagtatatcagtcccgaacacttggttttccccaactaggtcccacaggagcggtgtccggcatttgcgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatcgggtatccatctcttcttggagcttcttccaaaagtgagaggtgaattggcttcccctatcagatacgattttcttaggaacgccatggagacttacgatcctagcgaagtagagttcggctagtttgttccctccataggtggtcttcacaggaatgaatcgagctaccttggttaatcgatccacaactacccatatgga

SEQ ID NO: 48520 - DNA, 7342 bp, Oryza sativa
agctgacttcgactggattgtggcacttgaagatgggacttcagttccagaacttctcataattcatatctttagcgtcaacctcatacaagttacccacttcacgttatgcgtcgatatcagcttgtcattactaggataccatgcttgttatcatgagaatatcatgcttgtcatttgcttcttacttgctaccaactgcctcatattaactttcctggtctccgggtgctagctacttctgttatttgacgcaagggtcgataactttgcctttaaattatgttcctcaacagaaccaacttatcccacttgacatgctttgacgtccccccaaatgactttactgctggacttgttatggtttgatcgttatccagccaactctgaagcttcgttgttagatgcgatttttaatctgacctctatcgactatcttcgaacatatcacttggttcataactgggaatagttcccacgaacagacaactcggattcactttctttatgttcagtttactttccactattctcttcatgttgtcatcatttagcattcaaagtattcctttacacattcaatcctgatgttttcttttcagatttctcttatcaatcacctttcgacctacttctttgcccggtaataaacaccttggctggtatcttctatcaatcaccttttgaacttggtcaaccaagtactcttcactccgagagttgtggatgcttctggtgacactgtggtacttgagcctgctgcctttcagagaaccttcaagtggttcgtcaaaagctagactgacggttgttgcctttgatccgaagaagtcacatctgaaacacttagtccaaacaaatgtctctttggttaatcacttgattttcttttccatcctcaggttggttattagctcgaggttagaatatagttcctctggcacgagaccctaggtctcctttgtcagtaaacaattatacacatgatcacatatccgcatcttccaaaagaatcctcttagaacttgtttttattacaaatttctcccatatttcatgaatacaaggcactgtcttaaacaaaaagggaaggtgcttaacatcggtacattgtttctactatgggttagaattaacatgaggcctcacaggtacggcgtttgctccagtgaccacaaggcgagtgacttgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacttggagttggaattggtggttggaaatccttgctaacattggcatcagtggtaccatagttgctatcaccattggagtctttctcagtgtcgaaattgctaaggttgtcattctgggttccaacattgatactatcgttgacatcttggtgaatgctactgacattgcacgccttattcgagtggtcactaatggggcaagaaccatggttgttggtggtatcatcatcattagtattgctagtgttgttgtctgcattgcgtccatcttcttggggcggaaactcttgatgcgcaacagaagatccggtgatctgaagtggctcagtgcgctgtctttggttaccacctggaaatactgggatgttgacaatccttctcttgcagttcgtcatccgattatgctcactttcgagttgcatggctttgtccacaagtttctcaaaatcttcataatcctctagaagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcttagtgtgaccattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtaggcacttgaacgttggttgcccctgctgggtggttccaattctgtaatagttgaaaggctgttgccaacatgttggtttggttaaccacaacttggattagctctggtgaggtttcgttggtgcttctctcattcccattggcttgggttcttgagtcatcggatccatcattcccatagcctttgttactagtattatccatctgtcacaaggtagaggttgagaggggaagcatacaaggaaagaatagaccagaactagggacaagaccttaaaggaactaactcttcttgctgatgtgttgtttgtttcacttattctgcaagttgattaagctaacaacctagcatggttacatcacaacccaccgatgcaaaccacgcgctacacacacaagcaagaaacacacgactaacgacactaccctagagggtggcttaggttctgcgacgggttctccaagatcttcactccttcacagctggcttcactgcttcctttgcttcgccagcggatcctgcagtcttccggagcttcggcaaacaactgacgatgtcttcttcttcactgacctgattatctagtactagttgaaatttgaagaaggaagaaaagagtaaaccttttgcaaatagcattaggggaaggagaaaaagaggaactttcgcaaatagttttatttataaaatatgtccttaggttttatccacttggcttatcctacagtcgagatggctctgataccagcttgtcgcgaccgggaaaattgccttttcccgaacgctagtgtattagtccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaacgcttctcttactgaagagggggagaaagatagagcaagaatgagtacaaccacagtactcagcaggccacaccggcagatgcatgattaatgcaagggggtacaaggggataataatataggggttaagttttgcagtaaacagcatttaaaagtcacttagttgcccaaagccattttataaagacgatcctagagctatacagtattattaatcacggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccgacccatcctagccatagacaagagtaccgacccaatcccgcctacggccggaatacccgggacaggcaggcagaactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtttgtccaattccaacataagccaaccattccatagtgaccaaatgatatgagaattcccaaagtctaaagttataaaaccacctaatgttgcctaattaatcagcgaagcatctacctaaattcatactagtggaaccacgaatagagtacccactagttggggttttatttattctagggtgaacaaggtaataaaaacaatagcaataataatgtcttaacaaaggtaaataggcatggctaaataaaacagtgataacgcgggaatttaaataaagcggtaatgcattaatttaaatcaaaaataattttgtaaactgggattcaatatgctcaaggatgatgtgacttgccttgctcgttttcccaatcgacggctgcgacttccacgaagagcggatcttccgaagctgcagcgtctacacgaccaacggaaaagaaaaaggctttaacactaaataactccacataacagcagaaacaaagtacaaaaatgggttcttgacttcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcgggcgcgcggaccgggtccacgggaagtggggcccacgcgtcagccccacggtccacggtggaccgggtgcacgcggctggcgtcggtcggcgccgtgggtcccgcgcgtcagccgcacccgcgggcgcgggcggctaacggccgggcccacttggcagccgcgagggcgcgcccgagggcggcctcgccggcgcggccgaagggagggggacgcgcccgcgccccgatggtcaccgccggcgaccaccggcgcggcggagcggcacccgagagagaggagggaagggggaagcgagggggacggtcttcggctcaccccggtcgacggcgacgacgggaacggcggccgaagcggaagaaggcggcggcgcggttcgggatgccgagggcgacggtgctccggcagtcggcgggcgaagcggagcggcggacggagtcggcaaccactcggcgaagccgatggaggtggcgccgagtcgggaggaggtccggagcggcggcggcggcggaacggagttcggcggcgacggcggagagagaggagcacggcgcgagcacgaatccgacggcgagagcgagcggtgagcggcggaaacggaagagcggagcacgggcaacgtttttatagcgtcgggagggagagagggcggccgaggaggaaggaaaccggccgcggagatctcggccgctattgatgcgccggcgacgattgcgggcacgattcaaacggatccgagggagagagagaggggaaagagggggaaacgggagagggaatcacggggagtgattcccctctctttaatgcgcgcggggacggcgggatgcggcgcattccgcggcggcggcggcgctagggcacgggcgcggcggcggccccgccggaaggaaggcaatgacaggtgggccccaccgtcagcgagagtggcgggcgggcccgcctgtcagggcgcgcgcgcgcgggtagtccgatgggccgcgggggaggagagagagagagggagggagaagtgggccgagccggcccaagagggaaggggggggaaaagaacttcttttagggtttttctttttataaaaccttttcactttgtttatttcttctcaattattatttgtgctctgaaaattccactaaaatttgagggctccttttagaccaaggagaatttaacaaaaattctccgggccacatttgaatttttcttgtacgtattttagggtttgccaaattcttttcgaattttaattaattctatttttccttttagaagatgatttttatttcgggatgaatttatcaggacgtgacatccttggaggcgatcttttcgagcatgcgattgtgccgcacgccccccctgaacgcgtagatcaccgcgtgtgcggggatgcacggtatggtgttgcggacttgacagaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtgtaccgacgcgggtggcaagttcatcagccaaccccgcgcctgacctttcagggccatggggaagaaattcgccatgaccctgtcgtcacccccggcggcctcaatcccggtcgtatagatctggagaaactcggcggggttgacgcttccgtcgtatttttcagtgatggtgggccggaaccttgggggccaacggacgttccgaaggctcgccacaaaggctcgacagccggcaccgccaaccggggacatgggaggctggcccccgtgcccggaccgaagtggcgctccggacgaggaagcgccctccgttgcgtggcagcacgacgaccattgcgccggcgctcaatattgaggcgggcatccggccccccacgcacatcttcttgggtcggaggcgttgacgagggaatagcggacgaacggcgggtaacggccgccgctcgccgcgccctccgcctcgacgacacggagccggtggtagcaacgccagaggccttgggggcggaggaccgcccgccggcgactaggcgctgctgcgccgtcatgaccaagtcggccacatcatccagccaacgtcgagctggagtctctggatcggggacgacgggcgggtgacgcaggagcgcgcccgcagcccggagcgcgccctggggcgtgctgccatcgccgtagacgaggaggcgacgctccccatctcgccgtccttctccattacccgtgggtggcgaagtcgcggatctttcgaccccctcgagcgcctcctcccgcccaagacttcggcgagagggggacggtggagtacgagctcgacggcgcgggttctgctccctgtcgtcaccgctagcgctcggagagaaggttgtgcgccactgcccgttcggccattgggctgagcgggggaaact

SEQ ID NO: 48521 - DNA, 3563 bp, Oryza sativa
aggttgtgcgccactgcccgttcggccattgggctgagcgggagaaacttggcgcacacgaaagaggacgagggcttagaaaaacacacgcgccccctacctggcgcgccagatgacggagcgtggggctcctcaccgggagaccgcgcaggcccccctttgccggttcggccgggggcgctgagtgagtttcttcaccctcgatctgtggaacgttcgcgagagagcaaatgcacaagacacgggcaatgtatacaggttcgggccgctgagaagcgtaataccctactcctgtgttctggtggatctgtgtgtgaaggaattacagagagccggagagcaagagagaagctggagaggaagagagttcaggctctagaaccctccttcctctttttcctcctctcctagttctcgttctggattttgatcttcttcccccccactctctttggtgggcaaggtcctccttttatatctcaaggggataccacatgcaccacttctacctactcttcttttaagtggggaccctccctattttgacccaaacttggcttgcttcttcacctggaaactaaatcacagcttgttcttgagtgaggcccagcgccatcactcgactgacacaggggatcaccctgtcattccttcattaatgggtggagatttgcaatggccgccgtccgaatgaccctccgatgggatgggtcatatctacctccactttgccggaagcagatgcaacgtgggggcacgttttgtctgccgatgacgtgaccggcgtcagaccagtcacagaccggtcattcttgtcctccacgtgtcagattagcatgcctcacgtctgtctttcttcatacaatgacttccttgcaatggttgcgatgaagcctgggatgtatctggccgggattggcgtgtcaactccaggagttaacacgccggctccggctagggacgagtgcctggaggctctcatcattccgatgggacggggcgaggcgcgtgacaggccgcctgttgccacctaacccgcgatctgaccggtctgtgaccggtcacatactgcgaccggtcacggaccggataagtgagcgcgctgcactgcattaaatgcggcgtggcgcgctcgtccaacccgcagtaaacgtggttaggtgagcgctgctgtgctcacctaactcacacacgtggtgccaacaccacagggggtcggggcgccccaaccctcggggccgaaacgggagcggcccgacccctcggggagacagagggaggggtggccacgtcaccctcgggcccgaccccccccagggggtcaaggcacgtgggtgagcgcggccgcccaagcctttagtcacgatactcccggtcccttgtcaccgacatatctgatgctggttcagcagaaaatggaggagatttggatgtctcaggtacacatgatggggtgcacacagcacatggtgacgcccccttggaagacctgggatccatgtcgcaggagtctccaggatcggggcatcagtctccgggatccgtttcacatgcgtcgttgcatcacgcgtccggctctctgcctgccacgccgacccctgcgccctcggctccctccctggcacaatcaccgaaccagcctggtgctgccacgacgccaaccatcagcgcttcctccacctcagctgctgcgcttgacacaggggctcatgatgctcctgacacaaccactgtactctatcaaatagacccagtgcatcaagattcaatggttcctccacgacctcacacaagacttcaaagcggcatctgcaaggaaaaggtatatacagatggtacagttaaatggtcttgtttttcctcctctggtgaacctcaatctctagatgaagcttttgctactaaccactggagggaggctatggatgcagagtatcaggccctcatgaaaaatcaaacatggcacttggtaccactgcagcaggggagaaatattattgactgcaagtgggtatacaaagtcaagagaaaagcttatggtagcctagcagatacaaggccaggttagttgcaaaaggcttcaagcaaaggtatggaatagactatgaggacacgtttagtcatgtagttaaggctactacaattagaactatcctttccattgcggtgtctagaggttggagctttcgtcaactagatgtgcaaaatgcttccttcatgggattttagaagaagaggtacatatgaaacaaccatcaggttatgagaatagtaaatttcctaatcatatatgcaagttggataaagctgtatatggtctcaaacaggctccacgagcttggtattctaagctaagcacaaagctacaagcacttggttttaaaccatcaatggcagacacgtcactattcttctatagtaagggtgatgtcaatgtctttgttcttatttatgttgatgatataatagttgctagctccactccaagtgccacctcagcattattgcaggatttaactaaggagtttgctttaaaggacttgggagagctgcattactttttgggcatagaggtgaccagaacagaagatggaattctgttgacccaagctaaatatgcatctgatgtcctcaggcgtgtggggatgcaagactgtaaaccggtaaatactcctttgcttacttcagaaaaattatctgtaaatgaaggggatttgcttggtccaaaggatgccactaaatataggagtattgtgggagcactaccttgacaaggccagatatttctttctctgttaataaggtgtgtcagttcctacactctcctactactgtgcattgggctgcagtaaagagaattttgagatacctcaactcttcttgttagcggtttctctgatgcagattgggcatgctgtctagatgacagactgtcacgaccggaaataacccaacgggcgttccttacgtgcgtgcattattccttgtcccaggaggcaaggtacaccaaaagttgatacaattcagagtttaacaagcggaagcgtaattaatttattacatgggcggcgaagacccagcacacaagaagacaaacgaaaaacagcggaagactagggcgacaaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgtaagggagtacaagggagccataatatagggggttagggtttgcagtaaacagcattaaaagacacttagttgctcaaagctattttgtaaacacggtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggtttgaagaattaaaaacactaacttgggtacat

SEQ ID NO: 48522 - DNA, 785 bp, Oryza sativa
  unsure (1)..(785): unsure at all n locations
cggtggannagtgactgcttcatttcctgcggcccctacgtgngataagatcgctctagattgagtcgaggggctaatttgtcccgtattgaaccaactttggttcttcggtttgggggggggtaattcggccaaccgcaatagttcaggggggtaattcgtacttttttccggtggccctcccttctcctcctcctcctcccgatttgtggcggaggtagcaccaaaggctggcccaaagcacgaggtggtggccggtactaggaaaaaaatggaggtggaaaaggaggctcccccctctctcctggtggccctcctctctgttcacctcctcccttctcctcctccagatctggcgacgacggtggcggtggagaaggccggctcggagggcaaggtggaggccgttggctgggtangaggtggaggtgaangccgtcgcactccttccctcaccgagctctttcctggcctcgccatgcgcctcgccgtcagctgccggatccggcaatgacngcttcttagggctctttttgttatttcacttaatactataggtgttggtcatagggtaagaacctgacacctattgccggtttctaactggcacctatgggggttcatgtatactagcgatcattatcatagaatcattgaagggtgatttaaattgatgaaattctgtgatttngttgcaagcctgaaacagctcaataaaactctgtttctacccaatagtatattttatcaacgccacacagtttgaatgcaacctagtttttaat

SEQ ID NO: 48523 - DNA, 749 bp, Oryza sativa
cctgcagccctctatgcacaatgtggtcgccttaattacaagtttaaaattgcaaaatccaaattagcctaggaatcagacaaggagtagaagtcgtatctcaagctgcagcttccacccaacactttgcctccctccttggcgcaacccctcgccagcagttgatcaatggcggattccaggcacatcttgcagtcgccgccggagaggtccttggtgcactgtgccatcccgtgcagcctctgcgcaccgccgaccgccacggcctccccggcggcgaacagcagcggcgacaggtaggccgtgctgtcagccgcttcatcagccgggacacctccctgtcgaggtcggccgacctgtccgcgccccgcaggacgcgggccggcgggacgacggcgcggtgctcggcgtcgacctcgccgaagaatggctcgccggagtagcggagcatgcacgcgtcgagccagactacggcatacttgttggacgggcacacgcgccgcgccagcgcacccgccgcccggatgcactcggcgcacgttgcccttgcgacgtctccgcggcagagcgccaggccgtgcacgcgctgatcctccccatcgccgccgaccccgaccgtggcgatgtgaacacgatggccggggccttggcctccaggagcgagacgaaggcgccccaggttaccgcgtacgatctgtcggcggctaatctgtccgtggcggagcacgacgcgacaggctccaccacgg

SEQ ID NO: 48524 - DNA, 2375 bp, Oryza sativa
ccactcgcccgttataagatacttcctccataaaagaaaaattaagattagatgcaacgttttatctagatttattatactcagatatgtctgtcggtgacatggggccgggggtatcgtgactagaggcttgggtagccgcggtcacccacgtggcccgaccccctcgggggggtcgggcccgagggtgacgtggccacccctccctctgtctccccgaggggtcaggccgctcccgtttcggccccgagggctggagcgccccggccccctgtggttttggcgccacgtatgtgggttagatgagcacagcgggctcacctaaccgcatttatagcaggttggacgagcgcgccacgccgcatttaatgcggcgcagcgcacgcttatccggtccgtgaccggtcacggtgtgtaccggtcacagaccggtcagatcgcgggttaggtggcaacaggcggcctgtcacacgcctcgccccgtcccgtcggaatgatgagagctgcgaagggacgacgagtctcttcgctcgtacattcagcggttctgtcaagtccgcaacaccataccgtgcatccccgcacacgcggtgatctacgcgttcaggaggggcgtgcggcacaaccgcatgctcgagaagatcgcctccaaggagccccagaccacagcgcagctttttgagctcgcggaccgtgtggctcgcaaggaggaggcctggtcctggaactcctccggttctggtgtggcagctccggccgcccccgggtccgccgctcggtcagggcggcgggacaggaggaggaagaaggggtcggcccattccgacgacgaggggcatgtcctcgccgtcgagggcgcttcgcgggccacccgaaaggggaggcctgcgagcgacagaaagaaggaggccggcgctcccagcagggagcgcccgaccggcaagtggtgctccgtgcacaacacctccctctacgacctcgcggactgccgcgcggtcaaaagtttggctgagcggacgaggaagtgggaggaggagaggaggcaggagcgccgtgagggcaaggccccggcggccccagccggcaaccggcgaggtgaggccaagcagaaggcccccgccgaggacgtcgacgatggcgacgataacctggggttccaggagcctcaggccacggttgccaccgtcgatgggggagcgtgcgctcacgcttctcgccggagcctcaaggccatgaagcgagagcttctggccgcggcccctacccatgaggcgacgcggcgggcgcgatggtcggaggtggccctcaccttcgaccagacggaccacccgccgtgcgttgcccggggaggacagatcgcgatggtggtttcccccaccatttgcaatgtgaagttggggcgtgtcctcatagacgggggtgcagccctcaacatcctttctcccgcagcctttgacgccatcaaggccccagggatggtgctccgccgtcccagccgatcatcggtgtgacgccggggcacacttggccgctaggtcatatcgacctcccggtcaactttggtggttccgccaatttccgcacggagcgggtgaactttgatgtggcggacctcagtctgccctacaacgcggtcctggggaaacccgcgttggtgaagttcatggcggcaggccactacgcctatctccagatgaagatgtcggggccccggtggccccatcaccgtccatggcgacctcaaagtcgcgcttgcttgtatggagcagcgcgcggaccaccttgccgcggcgtccaagcccgcgggtggcgacgagagactcagcacctccatcccggccgccccaaggcagcagatggtcacgtgcgacgaggtcccggtcaaggaggttaccctgggggacggcccgtccaagaccacacgaatcggtggtcttctgaacgacaaatagaaagacgcgctcgtctccttcctgcgggcaaacgccgacgttttcgcctgaagaccggcggacatgcccgtggtccccagggaggtgattgagcaccgtctcaccgtgcggccgggcgcaaggccggtccggcagaaagtgcggcggcaggccccggaacgtcaagccttcatccgcgaggaggtggcgcgacttctggaggccggattcatccgtgaggtcatccatccgaagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagatt

SEQ ID NO: 48525 - DNA, 788 bp, Oryza sativa
  unsure (1)..(788): unsure at all n locations
agggcatggcgccctagttgggttaaatggaggcttggagaggaggggctaccccttatttaagttcctcaaacgctccgggcccgtttactaagacggagaaggttgagcgggctttcactcagttgaaggcgtacctcagttctcccccagtcctggtcgcccgggagccagatgagccgttgctactctacctggcggcaaccccgcaggtggtcagcgcggcgttggtcgtggagcgcgacgaggacaaccctcactccgcgcatccccaccntgtgtcgactcgacccgggagagagcagggaggagaggcccccgagccgaacggcggcccgaggcccccgacggccggagctggccctccgcctgcttgtccgacggtgccaggtgcccccgacccccaggatggccccggggccattgcgggaaggccgcgcctgtcgccctctaaccccgaggtcgtcggcacagaagccgagtgcgccccgcgtggcctctcggacgaagagcgccctggagatgcggcccctggcgaagaggatcggccccgccgaaaggtgcagcggcccgtctacttgttagcgaggccctccgggacgccaagacccgataccctcaggcccagaagatgctttacgctattctgatgacttcgaggaagttgcgccattatttccaagcgcatcgggtcacggtggttacgttttaccccctcggccaaatcttgcataaccgagagggtactggacgggctgcaggaaagacgtcagtcactnntcaccacc

SEQ ID NO: 48526 - DNA, 763 bp, Oryza sativa
aatactgtcaagtgcaacgcacgggtgagcaactagtgttatataacgaggctagcaagtcctgcacaaaatattgaatgatctttgattctgttgttcgatttatgttaggaatctgttatgtcactcagaagttggggcaaagtagtgtttgactgaagaagaatttctgaattaccaaaatctacaccaaacataacaagtagttgctaaaaaaagcacagtcatgccaaacgttcaagttacaatatttcatccaaaattacagacatgaaaggaaggtgaaattccatacctcagaaaccgaaggaagaaaccatccatatcgtctgccattgtacaagcatttacctccagctgctgggccagaaggtatgaatgctatatccagtcttccagttatccaaaagaatcaccttcttcactgcccaccacccaattatcatgaccgccagcatcgtaaaacgctggatctgcaggctctccaccctcaccagcaagtgtgtcaccatggcgatcatgagccccacgagagtgtacaagaacccaaccgcaaaaccctcggcgccgagctgcatccagacccctggtagaagaacacgagcttgtttggatcggaccggtcggtgatgaacatcggcgtgtgcctgatgatcccgtacatccccccggacacgctgaagaagtaaatgaacagcgccccagccatccacacccgtcggtcatggaacaaggtctccccgtccatgatcgggctgcagga

SEQ ID NO: 48527 - DNA, 1696 bp, Oryza sativa
ggtctcaatcgaaaagttcggcggataacggaataaacactagctatgaacttgtagctcaaacaaacaaaatgtatatgaatcaaaaggtgacaaataaggtatttaagcaagaaataaggtcccccccttaatcaattaagcatgcaagtagatcaggtaaaaacaagctcaagcacaatatgagagaatgcaagaacgggcaaaccaagaggggagatgcgtgatttgtttcccgaagttcggatccacggatcctacgtctccgttgaagaaccacaaaggccgaggcctatttcaaccctttcctcacgagggtgcacaaatgcactcctcggtttcactattgatttcttcccttgcggaggcgaaatcgaagccttcacaaactttccatggcacaccacaaccttgggtgctcaccggcaacgcctagccgtctaggagaccttagtctccaagagtaacaaacacaatcgaagatttgcttgctatgaactcgagtgctcaaagtatggagtgaagctcactagctctcaacttctcaatcactcaatccaactctttccccttctcaaatccctctcacaaagaggcacacaaaggatggagtgaagctcactagctctcaactcctcactctctcaatccaactctctccccttctcaaatccccctcacaaagaggcaccacaaaggtagggaaatggggatggctatttggctttggatgtgtctaatactccccaagagcagcagcccctcaaaagaggggtggaggagtttatatacccgagcccctcaaaaactagccgttggaggccaagactgtaatttttggagtttccgaaaagcattttcggacaagtccgaaaacttacagaagcaaatctcatattcgcagccactttcggaatgtccgaaaattttcggagtttccggtaatttttcggactttccgaaaagcacagagtaaaacgactataacttttcactcgggagtccgttttcgatgaacttggactctatagaaagctcactcagaggactacccaactcaaccaaaaacaaggtctaaaaccactcaaaggataggttaaagcttgggcttctctcaaggtagcactatgataggtcactttgagcaccgagacatacacaaacacctcgacgttgcatccctcttaatagtacggcattcctaaactcaaatgtaaataagaagataattataccattaggaatgcctttttttcatccttctttcattgtctagagggacgccaatgccgataccgtttcaccatatattcttcaaatgattgatgcggttacttgtagcttcaaatggtctctcacggtccatcatgacaaagccggcactcgccctttaccaccaccggatttggtccttcggcgccaagccccttgcttgcccttcaccgccgcatggtccatcgcgaccgagcatcgcttgcccttcaccatcttgccataatagccacttcgtatcacacatcttcaatatcttcactttgtcattcttggtattgttaggtgtaatgatatcacttgagcatcaacacctttgtaatccctgggacctatttctatcattcaactcaataaaattattagtcccgatgatccggttgtcaaccttcacatgttgaccaaccgatcgcatgtataaaag

SEQ ID NO: 48528 - DNA, 1879 bp, Oryza sativa
aattttgtgtttaactaaacacagccataattaatttgtatatgtcgttcacctcttgccaaaaacaaaggcatcctctgaatctcggtttagggatatatcagtggaaaatttcatctgcaaatgtcatttgcaggtacatcaaagtacatcatgctcatgtgaataaaatttgatataggtgaacaaacagtatcacatttaacccggtgatatataccagcttggtgatatattaaatttataaagaattaatttgtgtatgtagtactccctctgtctaatatgatacatctacatcgctaaattagttttattaaatataacattgaatatatttttaataatatgtttattttgtgttaaaaatattattatattttcctatagattaggttaaatttaaaagagttttactagaaaaaataaagtgacatataatataaaacaaaggcaatacttacctagtaaatatttttgtaccaatgacatgttccttttctcataaataattaaaagtgcaactatttaacgcagagctgaaattttgaatggatttgcatgtatttctagctgtaccgatgtaatatagtattattagggcaagtttggtatagttccaactcctaaatttagctccaggagttgggtctggagtagagttgtggagtagcctaaatccagctccaactctctagcttattttgtgagagatcttcacctagtgcagctcccattttagctgtaactgaaactgtttggctgagcatcagtccaagagagttggagaaactggagttggagctgtgccaaacatgcccttagattaacgtttgaatttactttcatatagcatatgagaattaaagctaaaaattagttttacttgaagaccatgataaatttaactatgctttatattatgagatagcagggagtactaaagacaaattatcctgccatttaccataggaaagtatgaattatccctctgaactattgcgacagtacgaattaccccctgaaccacaaaaccacacatattaaacctcgaactattgataccggacaaattaccccactgactcaatcctgagcggtttttctcctacgtgccatacacatggcgtcgacgtggaaatccaattagcaaaaagaaataaaagaaaaaatagggcccacctgtcattacccctctcccctcttccccttcccccttctctctctcgggcgcgcgtggacgggcagtgggcggcggcagcgacgtgcggacgggcggtcggcgtgtgggggcggcggcagagcacgggaatggcacggtgtgcggcgctgaggagggtgttggaggaggccagctacgtcatcatcatcatccctctctctctctctcctcaggctagcggcgagcccggtggggagggcgagacgagtagcgggcggcgctaaggacattggagatggtaggcgtctctctctccccctcgttctctctctctctatggcgccgtcaggagagccgagcaaggaggaggcggcagatcctgaccggcggcctccaaagaagaggacaggcggatgaggtggacggcatccagctgccgccaggagggggcgaatgaggttggaggatgcaccggcgagggtgcgccctcctcgccgcagcccgccgcctcccgcgccctttccgtgagtccgtgacgccacagccccacagcctcctcgctggcatccgtggcccgcggtgcgcctcccacgctgccgcccatcacccgcccccgcgcaatgccgtgggcgccgaccgtccaccgctgctcgacctgcgctagacgacccgaaccccaacgagaacgtcaccatgaacgccgccgccaccgccacg

SEQ ID NO: 48529 - DNA, 1830 bp, Oryza sativa
  unsure (1)..(1830): unsure at all n locations
cggcggatacgtcctcgcgtccggtggaaaggaggcggaagggcaccgccgcactggaagcggaaaccaggaccacagcggctgcgtgtgggctcaggagcggcggatccaccctcacacgtggcggaaaggaggtggaagggtggtgtggcaccagaacggcaaccacgaacttgcgggtacgtgcgggctaaatcgagagcggacaacccaccgtcgacaagcttaggaatggtggattcgctgccggagtgctcgagagtggtggatccgcccttgcacatgtggagaggaggcggaagggtggcgcaacaccaggagtggcgaccacgaccacgacggcgatgtgagtgcttggaagagggcggatccgtcctcgcgtgctgcacggaggaggcggaagggcggcacgacatcgcgagcggcaaccacaaccgcaggcagcgggggcaagggctgtagcgcggcacacaacggcggcgaccaagggtttggttttggatttttttttctttttttattttttaaatcattgcaatcaagcatccttatttgcccgcatgcaaaaatcgggtctttgcaagcggctttcttaggtcatctgtccgcgaaaatgattttatgcatgcaattgtgttgcccgcatgcaaaatgccgatttttgcagacacctggcgctccaggcgagtgtcactcgcctgtgaaaattagtttttgtcggcatgaaaagatcatttatgtagtatagtggtatattgtgcagacatctaaacaacacattttttttcttctctctttctctcggtcaggaaattatggagaataaaaataaaatggtattacactttacaagtataatgggatgcataaaacccacgaaacactagactcacacggtcatggcgtaaacatgtacaccaaaatgctgtctaaatatctttgtatttagaataatccctctggtttttgacggataatgtcgttaatttntgaactaccatttgtctcatatttttttgcaaatattaaaagcataagtcatgcttaaattatttaatgattaaaaaaatcagaaccaaataaatggccataacatattttttttaacaagataaatggttaaatgtatatttaaaagtcgatgttatcgtactctagaacacgtaggaatataatgcatgtgtatgtgatttgttgggttagaacatctatgttcactagctataactgaagaaaaatatatgaaacttcttgaatgtataccatgtttcacaatgtttatttcagattctgtgaaatttcatgatagttttataggtttgatgatgtatcctggtgttaagaacttaagtgaaacttatttcaagataacctggtgtaaagtgaaagtatatgctaaacctagtgcaaaacgaaacacgatgcggtttatacccgatgtagtacaatttattgagctagtgtcatagtgatcacgccgttgtccaaaacatcacatattctgtgactggagatagaattcgttccaacatgacaagaaaacacgcgggaagtcatgttgtccttaggatcttgtcaagagttttgacttgaaaacagcaaaagtatttagttatccaaaaggtcagccgtgcttattgcaggacattgaattcatcttgttgaatgtgtcgcccatcgcacttggttcatccgtacttggtcctgcgcgttgccaaactcccgtaaaatctcaatcctatgagtcatgaatctcgaatcaaatttgtaccatgccaagttaccaagttgcctcgttgtagcgcgtcgctgtttgaactctttgcaaat

SEQ ID NO: 48530 - DNA, 788 bp, Oryza sativa
  unsure (1)..(788): unsure at all n locations
cctgggaannagtgactgcgatcatttctgcaccctatgagtgtatgaacagagactaaattctttgattgcttggggaccatgaattatatttttaagaggtaagggactactaggggtaggaacaatggtatgaccaatatgttaaatattcataccttcgccactagcagtgtggatctgatctgttcccttgtacttctccatgtagtcacgtttatctagctgccctgtgatgtgatctgttgccccggtgtccacataccaattggtgtcaacaccatacgcatatgtggccgcgtcgcctagcttctcgtcggagacgtacttctcatcatagcggtgccagcagtcacttgcaatgtgacctcctttatggcacgctcgacacaccgggtgggtgtccttaccgcgccctcgcccagtgttggccccgactgcgccaccacggccggcactgcgaccggcgggaggagcaccgaccgcgatttccaccgcgaccaccacgaccgccacgatttgcagcgtttgccgaaatacggaggtaagtttggcgaatactgatcctgttttcatagctcaaaagttgggaatacacatgagagattaagagaggagcaattcttgtcgctggcatcaatcctataaccgatgagtcaaagtctgagtcgaagccgttgatgatgtacgctatcagctcttcatcgtaaggagctttccttgccccgtcatctcatagtcaaaggatcgcatcttggcaatgaactcacttatggacatgggtccct

SEQ ID NO: 48531 - DNA, 760 bp, Oryza sativa
  unsure (1)..(760): unsure at all n locations
tgttggannagtgactgcgtcatgtctgcagcccgtctcctcagctcctcgggagccgctcgaggcccccggcattttttaaaaggccttggccaaggcccccttggttggcggcttacttcgcgttttgcccgccccaaaggcccgcctgccgcccggcgcggtctaaacgggagacggcgtcccgaagcatgccgggccctacctcgttcgccaagcggagggcctcgacctccccggcggacaagtccagcgcgccctgcagctcggcaatggtgtgttcggcggctgcaaggcgggcggttaggtcgccgtggcccgtggccgccccgccgttgtgcgctttcgcgtccagctccttcgcccgcgcttcgagctcacgggcccgttgatccagtggcgccctttcggggcgggcgctttcagaattgcggggcgcctgctcttccgcgctggctcgcggaggaacaggctgttcggccagccctgggccggggcctcggcttcttaaagctcgccccgctcgggagcgcctcctccggaggcgagtgcgacttcttttcggcgcaagcggcttgtgcgccgccaatgttggcttccgggtgcgaacggggacttccggtcccccagtttttttcttttcgttcaagggcgggggcccttcttcaaacccaggggggagcctaaaggcttttttggcttccggaccccaattttttttccgcccccctttcccggcagggaggttgaaggatttcac

SEQ ID NO: 48532 - DNA, 789 bp, Oryza sativa
  unsure (1)..(789): unsure at all n locations
cggatggtannttacgatctgccatcttagtactgcaccncctaccccttcctacctctctcctcccgttctctctcctctccatcatcttccccatccttcttcgagagccgcaactgggtgtgggcggcggcggcggcgtttactttggcagcatgcgggggtggcgagcgcgggccacggcgtgttggcgtcggctcgcgggcggcggccgcgttctcaggcggcagcgtcgacaggtggcggcctaggtggcggcgtgcgcgagcagccggggaggcggcggcgtctacagtcggtggccagaggcggtggcggagatgcgtgggccaaccggcggcggtggctcgcgggctgaccggtgccagcggcttgcgggctgcccggcggcggcaacgccagggtaacgcctacaaggtgttggacgaaatggcgatgagggatgtggtaacgtggagctgagtaatctagccaaacacttttttacctacctcaactcctaaaggagccagctctcacttggagttgaagtttacagttgtgagtttgaattaggagctctactaaatggcgcctaaatatgaaccaagaatttgattttaaatttcttaattggctttgcactataaaaggccttgaaaaagccaaacttttggacataattacaacctattatctcgcttacacttacccttgaagccaaaattggtgacttttaaatttaattttgggaatggtcttcggggcttttccacatagtgtatcttatagcccatactgtaaataaag

SEQ ID NO: 48533 - DNA, 796 bp, Oryza sativa
cttcacttcttgtaccaagatgtggactatgagttaggcaccatcaaaggtctccttcctttctatgcctatctcaacaagctcttgcgcaaaactcttaatcctaaggaaggtgatgctagcaatgtccttgcctatacaagaaatttgctccacaagatgaaggcacacccacagctctttgatgcttttgacttcatctttgaaaaaatctggcttatctccatgatacctaagcgaggacatggctatgggccttacattatgaagatgattgagattgtgtccaagaagaagtttcacaaggaagtggctcacaccggttaccaagttcgtcccatcaaggctgtttccgtgccggctggtcgaaccactcgtgcttcttctcgtgctggtccctccgctactgtcacctcgtcggactccaactcttctttgcggttcttcaagtccatctttaacatgtgcaaaaccatctcagttcatcaagccaaggagcccaaagcaaggaaaaaggacactcggcggatcaaaaacctccttcacaacgcccatttgctgttgacggagcgtggggctcctcaccgggagaccgcccaggcccccctttgccggttcggccgggggcgctaagtgaggttcttcgccctcatctgaggaacgtcagcgagagaggaaatgcacaagacacgggcgacgtaaacaggttcgggccgctgagaagcgtaacaccctactcctgtgttctggtggatctgtgcgtgaaggaatacagagagccggagagcgagagaga

SEQ ID NO: 48534 - DNA, 1269 bp, Oryza sativa
taattgaccctttcaattggtatcagagcctaatctactaattaggcttaaccgcttggagagatcatgtcgggccaaacgggggatggcaaagatggtgataagggatctacgtttccttatgactatccatccacatctacctcttatgtgagtacctatagcggcaaagcttcgtacttcaacggcacggactatgccgcttggaaacataagatgaagatgcatttgaagtttattaacccatctatttggagaatagtcgaaaagggctatgttttgcaaaaacctgaggatcccaccaaggaggatgacgagaacgagcacaagaacgctcaagccgctaatgcaatacttagcgccttgagtggaagtgagttcaaccgcgtggacggtattgagagtgccaaggtgatttgggacacgcttcgaatttgcatgaaggcacggatagtgttcgcgagtccaaggtggagatcctcaaagggcaatttgagaggtttgtgatgttggatggagagagcccaagcgacatgtatgaccgtttgagcaagatcgtcaatgagatcaagggacttggctccaaggacatgaccgatgaggttgtggtcaagaagatggttcgagcaatcactccaaggaactctaccttagtaactatcattcgtgagcgtctggacaacaagactctcacacctcatgatttgctcgggcgcatcctagcccatgacatgcttgtgcaagagtccaaggaggtcatccaatacatcaaccaaagctcaacgacaagcatcaagaaggaagatttggcattgaaggcaaaggaagaagaagaatagagccgcaagagcaagagcaaggaggagatcgatgatgaagaaatggctctcttcgtcaagaagttcggcaagttgatgaggtgaagctgcttcttcaagggaagttcttccaagcaccactccaacaagtcaagtggaagacattctgcagggtgtgctacgtgtgcaaagagcccgggcaattcattgcggattgccttacctcaaggatggttcccacatcaaggaagataagaagggcgaaaagaaggatgagaagaaggagaagcacaagcatagcaagcgggaacgttatggccaagctcaccttgggatgattttcggttccgactccgagtcaagctcaagtgatgaaggagttgccacgtttgccgtcaagccttcatcaccaccaagactcttcaactactcaagtgatgaggatgctccc

SEQ ID NO: 48535 - DNA, 1685 bp, Oryza sativa
cagcccggggtgcagttctacaccggcaacttcctcacggccgacgtgaaggggaagggcgggaaggcgtacgggcagtacggcgcgctgtgcctggagacgcaggggttccccgacgccgtgaaccaccccaacttcccgtcggtgatcgtgaggcccggacaggtgtacaagcacgagatggtgtacaagttctcgttctagtttaggtgactatacatggatcatatgtggtcattggtcgatcgcttcatctgctgtaagttgtgacattgtcggtgtcggtcggtgcaataatatgatatgcgttgatttgcaataagacgcatgggggaagaaaagacgagaatttttcactagccagttcagtctcatagagaagttgcggcaagagaaaagcccgggattcttccggcttgcaccataatgtggtgggttagttgcggacttataaaagtttttccatacgagagccacttctctcatacccaaagttttacggaagagggctagctacttaccattccaacgtaataggttatgtgtgctgacttcaacacaatgttagtatggtatcgtagataacagatatggtattattggtatcagatatgaaccgttataccagacacaatacttatagatatcagactttgatacttacatatcataatgacatcgatgttttagcatggtaacgtaggtaccagatttttttttgggagggtacaaatcaggacacacacgaacacacaccacaacacacgcatacacacgtgtgcgcgtccctaacacatactaggattgagattgaaggcactaggcctcagtgcacgggaaatatgcaaccactgaatgcgcacgcgcgtgtgtaccattatacctaaccgggaccaaccaaagtcagtcccgggaaaagagggggaaaaaacccgggtgagcacgagcgtcgaacttggggttcgaacgctcgtgggcaatgtgcccaccggcgtcgctaaccatccaaacaaatgctcgatctcacgtaggtaccagatttggaaccgtagataccagtgttaacaaccaaatttggtaacatctgtgtcaggaaagaagattggatcaaagcaaagtcagaggcggagatcgattcgagaacagagcaagaatcggctggagcccagatcggctacgattagtatcggttaagtccaagtcagactgggttaagtgatgcagccgattccgacaatacgacttgtattcgatatcgggtttgagttgacgtacttcaagatgattgccatacatggataaagtcctgggaaggcaattgtatctattaattatgatattttatataaattttttacagataaatatgggcaaaagtttgccgcaaagacttatggtatcttagagtttgttagagataatagtcgtgtccggtatggacatatcttgtaattctcgggtataaatagaccccgagccctatgtaatttttaacacacacgttcaatacaatttcggcgcatcgccaccctttttgctttagttttatttcgatgatttcttgctttcgggttgagttgcatcggtttcgatcttccacaagaggtaaaacttgttatgacggcctgtgttctcgggattagggcctccatctttatgataccctaatcttgtttatgtaattc

SEQ ID NO: 48536 - DNA, 702 bp, Oryza sativa
tattccctgatgtcatacctcaggtaaacctcaccattgttagcttgaataattgttagccgattcattacttgactaatctcttgtttttgttctacagacaatcgactcttcggctaattactcatagactttgggttgcaaaaagaaaactgctgtgaagaaaaaaccagcagcaacaattgtcaagcggctccaccagtaagatgtctttaattcttttacttaatcaatctcaaccggctctatatacacttgtctattctacagcctcttcctcctccttctcctcctgtacagcaaccgtcaagtgaccagactccatcggctgtggagagtcatcacatcgaggagtaagaacagccagctgctcctgctatcccaataagttattctttgtctcaataattagatcagctacattttacccagctcttactctttccgaaattgtctctgcaggttttagccgatcttttctcttttgacatcagagattatcttgataaggcagaagaagatacttctagcaaagctttagctcctctatctgacgatgtacagataacacttgaagatatctctcatcggctagctacaagcctcttctttagatagcttggtagttgactgcggatcaattaggacacggctgcatgaagttcaagctctgattcccgaagaattggccgatgtcctaac

SEQ ID NO: 48537 - DNA, 709 bp, Oryza sativa
aaataatcagtcgccaccaatataaacttatgtccttgactcgatggtcgacttatcataccgatcatatcaattccccaacctctgaatggccatggcttaataataggattcatagccgacgccggcgctcgctgaattgctccaaacttctgacaatcttgacaccctttataatatttgaaacaatcttccagcattgtcggccaaaaataccttgcacgccgaagtaaccacttcatcttatgagccgattgatgagtaccacaaattccttcatgaacttcgccgattgcaactttagcctgatcggcactcaaacacttaagtaacactccatcaatcgtccgatagtaaagctcatcatccaatagagtatacttcaacgccttatatctcaatttcctagaagctgattgagatggattatgtaaatattgatgcacatcatacctccaatcaccggctgttattgctgcaatttcagccttaacatctttgatcatcggcttataccccgatgccccctgggccaaatcattagcttcaatattttgttctcgagacacatgctttaaagtaaccagccgaaattcctgcatcagttcttggcacttctcattataaaccattaatgtatcactcttgcattcatatcccctgccaattgactgattaccagcaaagaatcccccatgatttcaatagc

SEQ ID NO: 48538 - DNA, 4067 bp, Oryza sativa
ccaaatgggcatgggggcaatggcctttttgttggagcaacgtggctgtgtagagaaatgcagcggaagcaccgagcaccgtagtgaggagaaaggtgcggaccacaactccacaaaggcaggcccaaacaaatggcacgcggccctggcccatcatcgacaatgcgacagacaaaaaaatacaagcaggcacgcagacccttcaagacttttaactcgccgttcatcatccggacctgcttgacaaggtaggagaacttgaatatcttaaactaacccaaattaatctgtaaaaatccctacatgcaatgcccgctattctcttcttttcgagattaacaaaggtcttaagagtaaggaaccacaagcaagtaataacacaaacaggtaaaccaatacacaaattttattgccagttcctccgactgactaaactgacatgagaaggtgttcaggacaattgccacggacatgaatgtacaaatgactggactaaagcaaccacggaccatttatctagacaaaggaaaaaaagccaaagaagttcaaatcggcaaaataaattgccttgtttatgtacacaaccaaactaacagaattcggcagccggagaagcaaattcagagcttatccatgtcggcgttcctgaagctgccacccaggagtgacaagaggccgccaccgtgcacccttccctcggaacggcacagcctccctttttgcccccttgacggtaggttcggacgacgatgagggcatcatagagcgaggcaccagcacctggggaggtccatcatcgcctggctcctcaccgtgccgtcgcagtccgacgcggtgctgatgcccgacgacgagtactcgttcgtcatgctgctcgtggcagcgacggtcactatgccgctgaaaaggcctggcgggatcatgcccgcgccgttgttcgccgcgtcgcgctcttgctgcttggccgccaaggtcccatgcgcggcgcacaggccgctcctgccgcgggcgaacttctcgcagcccgttccccaagtgcaccgcttgccgccgccgtgggctttgcagaagtccgtgctcccctgggcgctcttgctgcagttgtcgaccttgcacctcttgccaccaccgtgcttcacgcaacagtccgtgcggccacgggcactcttggtgcagccagccaccgaacagcgcttccctcctccgtgcgccacgcagtactcagtgccaccatggacgctctttgggcagacgccgccaccttcgaacatgcatcgcttcccgccaccgtgtgctttgcacagaggcgtgctcccctcagcacctttgctgcagccgtcaaagatacaccgcttgccaccgccatgccctttgcagtacaatgtgctgccttgagcccccttactgcagtccgggaactggcaccggcggccaccaccatgagaaatgcagagcccggccttaccctcagcgctccggatgcaaccttgcaccgtgcatctcttaccaccaccgtgcttgatgcaccgcccagacttaccccgtgcagctttaggacagccatcatgttcacaacgacgacctccaccgtgagcgatacaataatctgtcttcccttcagcactcttggtgcaaccaagctcctcgcaccgccgaccaccgccatgggccttgcaataggcagtgctgctctctgcacctttatggcacccaggcttatggcatctctgcccacctccatgggcaatacacagccctgatgcgcctctcgcacctttcgagcatcccttgaacctgcacttcttgggatgccggggatgattcctttgttctgatgtggttgttgccgtgacaacgtcggagctcacaccaaatgaagtatctgtcatggcagaaggctcagggctcagctgaaggtgatgttgaacgtgctgagtgttatcattgtcgctgtgcgtcaggtctagtgaatcctgggtttctgcttcgtgggtctcattgacagcagaagaaccggagcgtggagcaaagagtagggatggcatgtagccaccgatgctccttacagaaggagatgctgaggcttcatcaacaacagtaaaagaatgaactgttccatctggtgcttgcaaaggttgaattgtttgagaaacatccatttgaaggccaagcctcaatgtcccaggatcggtgatagtcaaaccctgtccagataacgaaggagcttctttaagcttgtctactccagtgggctgacactctgcagagtaaaaattcggcgttggacccaacccaaggactaacctgcaaccatcatctctagttgtgatgctatcaatgcactgtatattttgattaccatggccataattagccattgcagatcccaggcagtccatgtggggtgtgcttttgccaaggttcaccatgtagctctgagctgagggttccattaacacaaacgggttattcattggaggttgatttgggatatccacaaagctgttatccatcacagcttgacaatatgacaacggggtgagagcaaatgacaactgaatcactgaatagctgaagaacagggaactgatgatctttcaaacacagatcacagaatagacaaaatggaagaatatcagcaggagtgtagtactgaagcaaccaccactgacaaagcctgaggtgtctgcacggtccatgcctgtcttgttttggttgaatttatgatccaatgctacttgacctccacagcactaaacaacatctttgatagttgacatcaagcataggcaggagcctcgaaatgcttactggttgggaggtcctcaactgacaaaagcaaaacaaaatattaaccaaaattcagatgtcaaatatatgtttggcgtgaccttattaaaactattataataccatagacaggtcaccaagccagtaaagcaaaccacaattagtgttgtgcaaagattaaataatcagaagtgaatacattttattccatccattcaagtatacatggcgtgctttattcacacacatgttcaactatatagggtaacacagttttcgaagtgattttgcacatatttgcccatacaaactccttttagcagcacagcattgaacactccattggttcctaagcaactctcattaatcaagtagttgatggcaacttagtcatttgtgctggattcggtctacaagtgaaaaggaaaacacaccatatatactagaactgagagagtacaaggaaactgcaattatgaagtggtttcaagcaagcaaaaatagtagccgagatcaatgcaaaacaaactccaaacatgtttgattggtaaagctacatgttaaattattattaagattatccttttgggggcataaatcatttaataatacctttaggtaaagaagattgaagggtcaaagtgagtaactaacacgacaaaagtctttctccagaaaggaggcaaaaatgtggagtctatttaatttgagcaacagcatgcacaagcaactcccgtagcaagaatttgcacagtagaaatctcaaaatattgacagaacctatctgccctttattatactcgtaataccagccaaccaggtgctacctttgccgccttgagtgaaataaatggtttaaccaaggccaagcagtgtcaataactcaaaatgaggtgatcgataaaccaggaaatcaaccacattgcaatgcgcaatctacaaaggggaatagtatgaagtaatgaaccctatcagtttacctaatgagtacaataaccaagatcagcagtcataaatacatgttattctccatgaaaaggtaaccaaaagattggatagaaaacaagtaacaaatgtctctgttttttctttcttaaccaaaaacgactgtcatacatttttggtcttctgcatacgactgcaagactgtgcctcttattacatatctaaataccataacaattcaactttcctaaaatcatccacacattctataacattcccaacagtaaaaaatattggattacactgaacatatcattcctaatacaggtgca

SEQ ID NO: 48539 - DNA, 7551 bp, Oryza sativa
catatactgcaacaatctatctatgtacttaactagttagattgagagtaaatagtaaaagaaaagaagacagggaagagaaaacaggaagaaatggaagaggacaggatatagcgctaattatctaagaatacagggttaagacttaagagactcagagcctcagaccatcacaattgcagaacatcccaaaacaacaagaactaagtatcccaaaatcaggaaccttctactccatcctgaaccttcacagaaccccacaaaatcctgcaattctcctacgacaacaaactagaataccatggcacagaacagatctgattgtttcctgaaaaaaaaaaacttccaccaaaccgaacatggcacacatgaaattccccaatcgggacaccacgaggggcgacctaaaagggggactgggaccaacaaacccatccccgcaaaacccctgcagccatgacatgcgaagagaaagggaaggcaaggacgtaaacacataatcgcggtgagatggagcaggcttgagtcaccttagcgcgcgagagcggaggaggagagggaggaggggtctcgctacggagcggggcgaggagggcggggagtcgatcgctgcgggcggaggcggaggcggaggcgggggcggaggaggcggtgtgttttgctgcctttctggtggcttccctagtgcgcgagaaggggagaagtactggcctccgtgtggagtatgtatggaatgcgggtgtgcggagcgagggggaaaaatcggtaggagggctcgtcgcgtgtgcaggtggggcgggacaggacgggacgggacggcggggtggggtggatggatgacggcgggattacctggcgagcctggctggctggcaggctccgctcggcggctgcgcgagccagccacgcgaccgaccggcagcgacccagctgtttctttgcccttctttttcttaatgtttttatgtgttgccttgcgttctcttttttcctttttggttttggtttgttttgtatctggccggatatcatgtggtgacgaactaacgataggctttagcctgtgggttggattcatccactcgccatgataaggtgcgtcatcactcatcatttgcatatggattaggatgcgtttgagagttgtttttcgcgtacacgcttccaaactgttaaacggtgtttaaaaaaaattaatagaaaaattactttaaaaatcacattaatctattttcaagtttaaaataattaatacttaattaaatacatactaatagtttacctctttttttatcttcttaatattttttatttctctctttcttaaacaggaatgattacatgggatctcatcatggactaccttttacggaggttgaaatcatcccacatctttgcctcctcctcgtgagtccgtcactgtcctatccttatgccatgcgctcgcgtcccgtgccttgagcagaggcgcgggcatcagttggtaggaaagaatggcaacaatgctagtaggaggtagtggcatcaacatcggtattagcgaatgtgacactagaaggcaacgacataggcaatgaagttggccacagtagtagcaacaggaagccgaggagaaagggagaagacgaaaggaggtgctagcagcatgcggctcgttggtccaccaagtcgaggcaatatgtgtcccctcttgcaccttaatactagataatatatcgaatttgttactccatgggtactgtgggtaccaactggtacctcagaggtaccaaatctgatacttgttgatacctaggatagtactatgtccgataaccgtaggtattagctatgataccacaagtactactcgagaatgatgtgtcgcatgatgtacttaccacaacaccgacgatgagcatgacggcttcactgccacgtagcccgctaatcaaagctccagatccagccgcttcgttgccctccccctctatcaccatcgacaaagcttgggaggaggtgcttgtgctggccttcttgacaacctccctttccccctggttgtccccttccgccatgggagtcagatattgtggatgtcgccatgcctcaagcatgagacagaggagaaggccatggaccgtcgtagtccactgccctcgtcaccgacgtatacttgggtcagatccggcatcaaggaggcctagacctccagatccggcgtttgtcgatggcccagaatgcctccatacctaaccatagattggtggaggaaggagaagagggggagcacgggaggggaacgataggaagagagtggaggagaaaaaagaggccaaggaagatgagagggcaacgcaccgtggtggtgggcgttaagtatccgcacccggatggaacatcgttctatagattatctaaagtgaagggagaacttgcttgtgatttggatttgagaaaattccttgtatgcccctagaaagttacctaatcccttgtatgcctctgaaacttacttgatccctttcatacctttgaaattttgatttgatcccttacacgtctctaccgttaggtttacttcattccactcgttaatttggttgaaaatgtccataatacccttcaagttgtaggagctggaaattgagcgcatgtttggctgtcaacttgataaaagactgtaatattcatgagtgcacactgtgtgttttagagactaaataattagtacatacaatttttaacataaatttggaagaagaaatttaatgtgtttaccttatagcattcagcataaattaaacataaaattggtggaagaaatttaatagtggtttatgagacttaataattatgacatacaatttttaacatgaatttggaagaaatttaatgtgggggtttatcttttgttatagcactcaacagaaatttaacataaatttggaagaagaaattaatagatctttttggtgatacgagaaataccataaggagcctaccaaattatcaggagcatcaattgacgggaaggaaaaaaaacatctgaagcatccatacaccatcagggatacacaattaacaatttgattaattatggtgcatccatacaccatcagcattaagcaaccacagatccattgatttatacatcatgagcatgacggcgcgagagggtggtgggacgtcgagagctcgtgtatccaggtgccgaggacggaattcgagcactgacgggatgccgaaccgccgctacgacggatgcgaagccactgccgcgcgcgggatgcagagccgatattgagccaccatcgccgactggatgcaggagccgttgcatgacgggatgtggagcaacgacgatttggaattggaggtgataacctgtggcatttttgtctttcttaaaaaaaactgataatctaacacacgccttcactcgtatatcttacggaaatctaatggtaagggtatgtaaatgattaaatcaaaattttagaggcatacaggggattgagtaactcttcaggacacagaaagaattttctctttgaatctactgacactttgattggctataacaaaagatagagatacttaatttgttaattatgccagcatagtcggttttgtttttcaaaatatcaatcatttccttatcttcgacctcagtttagctcattggtgccatccaaacaaggaggcaaatgctaaacataaaagatggtgtgccgcgcggccggccggccggggaagggggggacgctagatttggcaacgatgaacatggttcaagtgggaagactcgcataaaagttcaattttagtcttgattgtagcataaacatgataaaggaaatcgaattatggatcgttggttgtcatgcacgatctaaaacattgtagcttggcctaatcgaaaactgtgtgtgttcaatggtagtaaaaggaatagaacagagcagagtaaggaagtgttttacattgatttcgttcataagtggatccaatggcaagcaacatccaaaaccaaaatcgaactgctcatatttttttatgacgtggccactataactttgcgaaaaaaaaagtttacttctttcatacccccttgtcctcttgcacccctataattttttttcatccgaaacttattttttagaactttccatccgaaactctcctgattaatccaacctaaggttccgttcatttctccaataagaattagataaagataaagattttcatctcatattttttaaactgctaaacggtgtgtttttgtgcgaaaactttatatataaaagttactctaaaatatcatattaatctatttttaagttaaaacttaatcaatcatacattaataccatatagttatacgtaaaaaaaaacttaatcttttatcttgagaacctaagtgcatgactcaaatgatctaaatacgacaaacaggctagagcagatctcagatctgcagcggcagtttggagcagtgaccccccatttcatttggccatttcctcccatcgctttcaccgaaaagcagggggccccacgtagagcgacgcatggccaagcgatccgggagagccgtttacgtgcacaagttgcgcccgttttgggccccggccacgttggaccattgcacgctcgcaacatccctcgtggagcccagaacttgtttggtagcacagtgcctacaaatcctggagccgtgggccacccactgttactcctcttgattgctaccacaagccgagccactgaagccagcactgttcatacgcagcctcggtcggctcggctcatcggcgcgattcgcttttcaccgtccgtcccgcgaaccgcacccgattggccgtgtcctccacttgttgacatccacaggccgcctcccattttttagtggcgttcacgcgcccgaaacgccttccctaggaaaaaaaaagtaatatctccgtcccaaaaaataaaatgattggacacggttatttaaaaaaaatagatagaagtaagtggtggaagattgtgattggatgaatagtgagggtaggtgagaaaagtagatggtggagggttgtaatgggaagagaatgttgatggagaaattgttatattttaagataaatcctaagggctaacagttgttatattttgggacggagggagtagcaggggacacactcgcttacataaaaaaacaaaagaaaaacactcttacccacgacacgacagcgcccacgctaaccgccatgtgggccccgcaacctttccctgccccacccgtcatccgccccaccagcggaatctcgcctgtacgctcggctctcggggcccacgccccccgcgcgtcccgccggccggccacgcgtcgcgcctccgattcgctcgtcccctctgccaggtgggccccgccgtcctccgcccgttttgggcctgggcccagtactagcgtaacctagagcctttgccaccgcatctgctgtgcgcgacgacgcgagggcggtggcgtctggtggcggcgcgcggcggccgcactgtcgcggtggtgacgccagcccacgcgagggccgcgtgtttctcttctctcgcttggcggtggggaccagcagagagacgcgacgctttttttactaagagcaagtttaatagtatagccaactattagctctaaattatctatagctaatgtaatagccaattcatacaatagttgcttattatactattaatatctggtcctacctgtcatacacacattacgttttagaatccgtgctacagctggctacaaatctgtagcccgctgctttttttctctctatttagctctttaaaatatgtttatagcatgtttatagctgacttataacttactattgtacatgctctaaaggctaaaggacgctgctgacgtctcctcctccgttggcttggctccgtgcgtgtactggcgatcgaccacgagaacgacgacgacgagtttggtgggggctcgtcacgccgagacaatcagattttcttcaccgcctggtgatgtaatcgccttttaattaacttgtgagcgtgcacgtttaaaatcctgaagggaccatgtggattgcgtcaccgctgacaacgaaaggatttactagtggtagaggagtacagacaggagaagcttagctttgatcgtttgtatttaaaaagagagagtagcaaatggcaccaaaacatcaccactagaagccagatttgtaaaaggaaatacacaaatagttttgtttgggcaagagaaccttcgggatccacacggtcgagcctcagcttcagctcctgcggcgtccagatcagaaatgagaaataaattaagccccgatcgagccaataatcgtttggccgataccaatattgtacagcaaattgggccaatagcattgggtcaaactggtttaactactgatcgaatcccatagattggtgcctgcctaccgtgggctatataatcctgtatgcaaataattggtgcaacctgctatctggtcgctgaagtcgtcactcgtcagttactagtcgtgtcacttcaaaaataaatcagttaggggtatttagatctagggtgtaaagtttcagcgcgtcacatcgggtatcatgtaggatgtcttatggggtgttcggatactaataaaaaaaactaattacagaatccgttagtaaaccgcgggacaaacattaaacctaattaatctatcattagcacatgttcactgtagcaccacattgttaaatcatagagcaattaggcttaaaagatttgtctcacaaattagtcataatctgtgcaattagttattttttaacttatagtatttaatacttcacgcatgtgttaaaacattcgatatgataggatataaaattttaaggtggaatctaaacagcgcctcactttaccgtttcaagcaatgacaaatggcaccatcgtttacatgtcacagattcaccattactgtaacgaggttgcatcaatccctcggtccttcactaagcttgaatcctttatttacatttctgaaaacaaatgaaaatctccgggccaatttgtctccaaaaacgagccagaatatatgaatatactccctctgtttcgttttatttgtcgctatcagtccaaaccgaaaacatcctttttattatttgacgctctagttcatctctacctgctatcctacgcgaaattccatccttacccctcgcgccctctccatcccgcaaggccacaacccagtctccagtagcgctggcgcgcagcatggcgacctcggtctcgcgtgctcggcaggcgtggcgatggcgaacatgaggagcagcagcaggacgtcgtcgtcgtcgccggcggcggcgttgctgcggtggggggcgctgacatctgcgccgcggtgcatggcgtgcggcgggacgaggcgggaggagtgccgcctgtgcacgcggtagtccgactcccggggtgacctccgggtgccgggcgtgcgccagcacgcggcgggcgccctgcggagctgcggcaggtcgggcaccggacgt

SEQ ID NO: 48540 - DNA, 26517 bp, Oryza sativa
  unsure (1)..(26517): unsure at all n locations
agaggatggtgtcagtcagtgctagtggacagaaggcggtcaccgccgatgattgctgctcaccggcggggtggaggcggcctcgcgaaaagacgggagggaggtgagagaaggtgtaggaagaggggaatgagaaaagggagtatgtgcatacgtgtgtgtgctcaccggcggggggaagcaggatgccggcgccgctacctgtgggaaggggaagccgcagcaagggaggtggggaagagcgccgccgtccccgccgtcggccctgccgtggcgctggggattgggatggggcgccgccgccgcaacgtgtggaagaggaacgaatcggggaagaggaagggcaaaagggtaaattcgcgtgaaccttaatttcgccgaagttgtcggaaacgacaaataaaaagaaacggagggagtataatgcagtatgccctgctggaacttttttcatacagggaccataaaattatgtagcaggaccacattgcaaaggaaggtagctacaatgggccatatatgggctaaagatgtatggttgaaatttgggccgagatagaccctcaacgtagtggacttaaaacggcccaattaccaattactcgtgttgctcctgaaagaattgagaggagtgcctctcgtacctacattctgctctgctgctaatattttttatttttgtgctctcttttagattacatgacactgacacgactgaatgggcccatatgccccagcagaaggtaggctaaaggtgattctgtgaaacatgaaacaaactcctactaaagcttacgcagataaatgtgaacagcacgagcactgaagtcacgcccattgctcaaccaccgtagcgacgaaggtgcttttcctgatttctttgtcattgcttatttgcatttgacattggccgcaaggttttttcatgcttaaaaagcttttaaaaacctttttttggcacaagggctcgagtcaaatgtataatttactttacaaggttaattagcctaacatgatcaccctcattttaacatggaatttgctattgaccgccgaaatgaccgggatagttatttctatagatgacatcttctcttctcttcgctgcttctgcttctgaagtcggtgtagcaccacaggtcggggtagaggtagcaggcagctgcatcgagtcatggatcaccagattgatgccgaaaccggtgccagtgatcttatcagcgcgtttttccgcctttccaggcgcaacctgctctgtcgtactccctgtctcttgtaataagccatttttagttattttcatttatctcggaataagtttattttcaaataatcattgtttcggagttcatgaaagtatggagtggttgtattgggagtagctaaattaaagagtaattgcataataatttgataaaataggggtattttaatctttttattttatatggatatgtgtgggatgtgtgaaaaataaatttattttgggacggagggagtataatgcagctgtgtttcctcttcaacgcctcttctagataaattaaggtcccgtttggtaacttgaaagcctgttaatctgttataaccatgggccaacttcaaagcctgttataactgagaggaatatatatttcaaagataacctaatccgaagattgctagatataccaaagctatggcatcacgcccttttcttgcagattcttgcaccagataagaagagaaaaaaaagaaggtacgccggccagaaagcatcaacggaggaaaatttggtggatgagacggagtgacaagtgagctgtgagcaatacatggaatctctcagggttttttaagtgacggctgagtgtggggttgtgggggtggagatgtgcttaccacgtgaacaaccctatatactttgacccaaggctggcaggcatctttctcgttactgtttttcattgtgggagtagaagcacaacttccttttcactgccaactctagattgcacccaagtggatttatcgcagatgcaagctgttgcaaaagcacaactgctttacttttttccccttctataatttgagcaaataatgcagctatccattttcagatatccttctacattagtgtatggctgtatttagttctttaggtgtaaaaactttgaagtatacggacgcacatttgaagtattaaacgtagaataataacaaaacaaattacagattccgtccgtaaactgcgagacaaatttattaaacctaattattccattatagcaaatgtttactgtagcatcatgttgtcaaatcatgacgtaattaggctcaaaagattcatctcgcaatttatgtgcaaactgtgtaattggtttttttccacatttaatgccccatgcatgtatccaaatatttgatgtgacgtttttggcaaaaaaaaaaactttggaatctaaacacggcatatgtctgataatgtctaaaacgtactaggtaccatgcatgtcctgtgttctaaaagtggaacatttggaaacagttaatatgtggcagtatatacaattgattctttttactctctctagggcatgtacaatggtgtttaataacggtctctcttcgttgtcatgcaagtaaatttggtgacgtggaagaaagagaggaaggaatgagaaacatcgttgctacgtatgacaacggctcagagtcgactcttagcatttattaacataaaatttgttgcatgaaagtgcagaaaaggaaagaagtataataaaaattatttagtatattaatggtttagaaatctcattgtctctactattgtaggaggatagtctctagtgatattaattagtatagagagatcatattagactctatatttgtacatgcctttataggctggcctgctaaattttattaaggttgtgttctaaagaaaggttggcctggactaatcattcatttatcgtaagcatgctttgcaaactattaaacaatgtgtttcatttaaaatctttctatataaaaatttcttttaaaaaaatcaaataaactatttttacgctgatggctcgtctcattttctatgtcaccaactaactatccccaacagacagcagctgtatcgaactcagcctaagacacgaagaatataaagtacaatgtgcagtccctatagtaagttgctaatagaacactgttgtcccctctttgttaggagtacatggtattttggcttatcccttaaaatgaaaagtgatacagtactattctatatattcatggaatatttgtaagcaacagaatcaccaaatgctaagcatttctatataacctttattagggggttatcacaccgaagctagaggattgtacgtagtggtctgtgaagtcgtgtgtgtgataactgatactacctccgtcccatataaattgtatttataggttgtttagtatatactaaggtttgagaagaaatactatgatgctccttattaaatgatgtataggtaagagaggaagggtagttgagggtaaaataaagagaaatttgaatgagaaatgattaatgagaccattagtactctattgtgataattattttaagataaatttaaattttcgaaatacaattattatgggacaaatgtagtacgaggtaagatgttttccactgggataacaggtgacttatcagttgctaattttaaaaaagattttactacaatactcctatcttttaaaaagttttgcatttcctaacataacgattaccagtactccctagagatgatagatttatggaatagagattctacaaagattaaatggacaaaatttaaaattcagacaaatactactacctctatactaaaatattactacaacataggccatgtttagttcctcctcttttttttttatgtatacggacgcacatgcacattttaagtattaagcgtagactaataagaaaacaaattgcagattccgcctataaactgtgacacgaatttattaagcctaattaatccatcattagcaaatgtttaatgtagcacaacattgtcaaatcatggcgtaattaggctcaaaagattcatatcgcaatttacatgcaaactgtgtaattggtttttttcggtccacatttaatgctcaatgcatgtgttcaaacatttgatgtgatggaatttttgaaagtttgaagggaactaaacacaaccatagaataaaattttgacaataaatccgcagattgcaatgttttgagtctggaaaaaatacttttctcactaactaatacagcagatatttcgggtgaagtgccgcatgtcagcttagggtgtgtttagttcatataaaattggaagttttgttgaaattagaacgatgtgacgaaaaaattgaaagtttgtgtgtgtagaaaaaatttgatgtgataaaaaagttaaaagtataaagaaaaagtttagaaataaactcggccctattgtcatcccatccctctttttctgcatccctctccatttctaggcgtactactacatttttctttgtggaaaagacatgaagcttttcgaatccacagccacagtgatgctatctcaaagctcaccggggggcgggccgcgggggccatagccacgggcttggtatagtacatttctgatccgaaactctgaactcgaggcggtgtttagttcttcaaacttccaacttttttatcacattaaaactttcctacacacataaactttcaactttttcatcacatcgttctaatttcaaccaaactttcaattttaacgtgaactaaacacagtctgagtgaaccacatcaacaagtacggaacacttagaccgagtttagatctaaactttttcttaaaactttcaactttttcatcacatcaaaactttcctacacacataggctgtgtttagatttaaactttggatccaaacttctaactttttccatcacatcaacctgtcatacacatacaacttttcagtcatatcgtaccaatttcaacccaaactttcaattttggaaggaactaaacacagccataaatttccaacttttccatcacatcgttttaatttcaaccaaatgttcaattttagcgtgaactagacccacccttactacagctctaatggcgctggagacatacgtcacgactgatcctaaaacaaaccatcacatcgacgtgccatttcgatggcacccagcaccgttgccaatttgtcattttcacgaggtcctcgacgacgcgttgaatcttccactgtctttgttagggctagtagtatcagatctttttatattatcaaaaaaatcaagtctttgtttcgttcttgtaccaaatctctcagcctaagaaatataaggttcactgaaagtgacataatgagcaaatgcaaagaaggtaaatttgttccgtagtatttccgtcagacttgcggctgccgacttttctctcttaacagaataaaaatccgcaaagagatacctatgggtaacacacaattgatcctcttttttcatagacaattcacagtctacagttgaattgtgcgtccccccccctctcttacatgcatatgtattatgagctggcagttgaaagtcaatgcatggttgtgatgataaattctagaaatctttttagattaaactacatggatgttagatgcttcctaaactttgaagttcgtaaactgtttcatagatagcccccgtggaaactctgtttcaaagtctcctttggagcacaaaaaaaaattgtacagcttttatagagtatattttttaacatactcttttatttagagtgttgacaaaaactttcaaattctctacgctcacacgagtctcgattaagaatgagtatttcttattacaaggaatgtaactagcttttctaacttctaaatgatattgggctatgttcagcaacactgctctgcagctataaccggttgtgctatacagtcagtgtatatattttctttaccatgcactatagcgctgttgtgcagctgcagtttagctacaccgaacaaacccgcgatttcgagaaaattatatataaaaaaatcattatcaaaccattttaaatacacttttaacttcataagattttgatcattcgactattcagccaagaaaaaacacatatcctaaaatacttctcgggagcgtaattaataaactctagggcctattcactttaatgccattttcaaccttaccaaattttagtaaaattactaaaaaaatagctacatttagtttgttgctaaattttagtaactatataagaaatcctattaaaattttagcaaattactaaaattttagtatttagcatcaaagtaaacaggcgtatagtcttctgagtacaacgcataagcattgaagcaaaagcaagtactactatcaccaccatccgatgggtgggtctcaactctgtcttaaccacaacgcccaaagaggcgtagaccgtggacgtagaccagcacggtccaccgttttgaccggaatccgagctggcacatcacgggccccaccgctcgtagaaaaaacagaaaaaaaaaacggacgggacgggatcctctctctcatcgttcgtcgtccatccatccatccatccatccatccatcccctgcgccccgccagagcagcgcacaggcatctcaaccccacccccagcgcgtgcgtgacgacccgccactggctccccgcctccgcccccccccccccagtgggcccgtccccctgacaaggtggggcccacgtggcgcagcaggtgcggcagggtacggatgccgcaccggatcccgttatcacgaggggactttttgactgcgggattagctggccttctgacgcgtgggcccggggacaggaaggcgagggtaaggtacgtggctagtacgtgaacctgccgtactgcaccgcgagtttttgggatgcccgtgccgctgtgcgtgtaccggtttttgggatacttctacaaacagggcacaaaaatgactggactggggggaagtaagtacaacccgtacgaggtgtgtgcgagcgcatgaccactgctgtgaactggagtggcaacgtactggagtactatcaccgtaggaacgaccatggtattggtattagatttttaatatttagccattcgtgagatggaacaaacagaaatactgaagtagtagagcatttgattgaaaatagagtttggcacatcgtggtaacgctgttttgctctcgttttaattatcagctcttgaaaacttgtgagctagaaagttttttttttaactcaggtagatctttatatgtcaattacttgtttaaaaaatatatacttcagttagtaaagtaacatagaaaatattatgcgttttcattgcttggggttgttagacagtggccccaccatatgaaaacatgttaaatatggcttgtttcaaggtgagctgcatttactcactccatcccctaagcataaaattaagagttaatgctctattaatagctaataattaagattgactcttaggtaccatggaaccatgaacctaatttgtatacctatgtaaaataaaaaagcttatatataatactactatacatatactaaaataaaaagatagtattatgcacacgaaacttttaaccctagcaaaattatggtaaatatcatttaattcacaataattttttaataaaaagcgctttaccagagaatcttttaaacttacacccatgatacattacaagtttggttttctaagagaacaatataaattgttggtgagaaatttgaaaaaacaacaacagaaacccctggattctttccatgaattacagcatagaagaaaaggcctaataattcatggaccgaaaaataataccagcgactcggcgagaagtcggtaaaaaagacaaacaaaacgtgaaatttgacaagcgagggacagtccgagttctgacgaaacggctgcattcctcgagaggccggagaataattgggacgggcgtacgaggaccgtgtccaccaaaaaaaacccctccgcatcacgcccaagccagcggcttccccatccctcctctcctccagtcctcctgctacacttcgatctcccactaaccccatcacctcgcccagcccgaaccattcccacccctccaaacagacgatctcccgctgacgcgtgggccccacctctcctcgcccccacctgtcagtaaaagttacgcgggcgacgcgcggtaactctcgccgccaccccccgaacaggtctcctttaccaatggaacaatttaggttggaacacacactgggtctcggccaaaattttaaaagtctcgagctgaataaaaacactggtaaaaaaaaaaggagagagagaggagagacaggtcgcttcctgcttccattggagaagaggagaggagaggagaggagaccgagccggcggcggcggcgacgaggagagggagctgatcgggcggtccccccctttgccgaggggacgccggcggcctccgggttgggtccacttggcagcggtgagcggcggcgggggatggcggaggcgcggctgctgcggcggcggcggctgtgcttggcggtggcggtcgtgtgggtggtggcggtggccgtgagccgggtcggcgccaacacggagggttagtgtgatttttcatcgaattcagctccgtttttcggcggattacgcccacccctatttttggacttgctttcggattcgatgaatctattggtcatcgggtgattccgtttgggtactagtacatgttacctgcttctcggtacatatgggcgtggatggattgactcatttaaggggatggagcatacgcccaccgaccttccttttgtagactcgatggattatctaggctatagctctttgttttgctgcctctcatggtgtgttgtgaatttgctcccagcagggagatttgtccgaggtaggaaacgtttcttgagtaagtttggtaggtgtgatttgtatgtgcacagaaatgggatagcttttttttttagataatggaataaatcctgacagaaatgggattgctaatatctgggatgagtttggtgtgctattttggccactctgaatgaagaaaatggaactggcttcctcattaggttcgagtatggaaagaatattgcttgtgagttgtgaatcttctcttgtgaaaagagattttttttttaaaaaaaatctgaattactgactagtatagctaattggtttcttacggtaggagtatgtgttatagattgctcttcaataggtaagggccatcgttagtatcaagtttaagcttttcccgaacaggaaaaagggtcatcatcttttgttatcacctaaccaatttcacctctttaaaatgcccctcaacatgcttttcctgatatatccttggtagtaaccatgttctaagaaaatttggtgattttggcgttgtgatgtttatgacactagattgcaaaaggtgccttagctattgtaagttctagttagtgattatgactaagataagtgttctttctagttgtttcttatgcaattatttcagtctttttaagcaactttatgtgctatccttttccacatttaggtcttgttaatcgcaagtacctctgtagcatagatactaactaatgttcaaacactaatcttgagaaagattgggagttatgcagatagtattgtaagaaatgaaagtactgtatcttataccttcttgtactcaatatatgcttgcatactttagcctgaaaaggcgattgaatttgccaaaattttgacgagaagctactgtcactattgtctacttccttaaatactatgttgctgatgttgagggtatgttcgatgtcaggtgatgccctatatagtctgcgccaaagtctgaaagatgctaacaatgtgctgcagagttgggatcccactctggtcaatccatgcacatggttccatgtaacttgtaaccctgacaacagcgtgatcagagtgtaagtttttgacagaattatcatttttaggcttgtcaaaagtaagaaatgtgatcattttgtgtgttgactgatctattttcctttcgcagtgatcttggaaatgcacaactgtcaggtgcattggttccccagcttgggcagttgaaaaatctgcaatatctgtaagtttacacttccagtctttggagaattatgtttttagttacaccatgcagtagcgtatctattcaagttgtcataatatactgcattgaagcttggttttcaaaattcttggaatatggttatcccttgtggtaaagatggttgtgttgcccccttctttcttgcatttttattgtgaaatttaattatgttgtgactaattacagggagctttacagcaacaacataagtgggacaatacctaatgaactgggaaacttaactaacttggtcagtttggatctttacctgaacaacttcactggttttattccggaaaccttggggcaactctacaagctgcgtttcctgtaagtgtactccactttttttttattatgaatagaattataaattgtgtatatcattgaaggccttcctgtttgaatgatcataacataattctttatttgcatgtcttcttgtaaggatagtcgtcttaacaacaacagtctttttggttcaattccaaaatccttgaccaatatcactactcttcaagttctgtaagttccctttctgctaattcatatttggtgtctacctgtagaaattattgcttacatggtaatagactttaagatggatacatattaacaaaatgtccaataatttatgcagggatctctcaaataacaatctctcaggagaggttccgtctactggctccttttcactctttacccctataaggtgctttttctagatagaatttaggttcttagtgcttactacatcttgtgaggctgacaaatggttatttcattgtcgcagttttgctaataataaagatctttgtggcccgggtactacaaaaccctgccctggagctccacctttttctccaccacctcctttcaatcccccaacacctactgtgtcacaaggtgattctctatagttttaattctgttacatttgtgatactgcttgggatatgcatatgcataaatgatgcagacaggggatttgacatattcgggtggaattaattctattccatcaggtgactccaaaactggagcaattgctggaggtgttgctgcagctgctgcattgctgtttgcggttccggcaattggatttgcatggtggcggcggcgtaaacctgaagaacacttctttgatgtccctggttggtattatagttgcatactgcagttcatgatacttatgttatccatttaaataatctatattctcctttaaattcagctgaggaggatccggaagtgcaccttggccaacttaagagattctcactccgggagcttcaagttgctactgataactttagcaataagaatattctgggaagaggtggctttggaaaggtgtacaaaggtagactggcagatggctcgttggtagcagtgaaaagattaaaagaagaacgtacccctggtggtgagctccagttccaaacagaagttgaaatgattagcatggcggtgcataggaacctgcttcggctccgtggattttgcatgacgcctacagaacggttacttgtctatccctacatggctaatgggagtgtcgcatcacgattgcgaggtgccttaatcttccttactttttcttagagtaaatccattaatagtttcttacacgtttgtttgcatgcttaaacataaatggcacagctattatggttattgaaatcacttaagcactctttttaatttcatctactcacagcatatacctagttgtttcagttgacatatcacattgttcatttaaggttatgactaagactgtaataatgaatggttgagtgcatgccttctgcagagtccggaataaatatattccttcatctaaaaatgcacgcccataaattaattatttcagtttttgagtcgtggtatatgattttgtagagcggcagccaaatgatccgccgcttgaatggcaaacaagaactcgggattgcgttgggatctgccaaaggatggtcctacttgcacgaccattgtgatcccaagatcattcatcgtgatgtcaaagctgcccatattctgttggatgaagattttgaggcagtcgtgggtgactttggactggccaaacttatggattacaaggacactcatgtaaccacagctgttcgtgggacgatcggacacattgctcctgagtacctctctactgggaagtcctctgagaagactgatgtttttggctatggaatcatgcttcttgagctcattacaggacaaagggcatttgatcttgctcgtcttgcaaacgatgatgatgtgatgttgctcgattgggtaagtaccaccacatctttatatattggggcaaccatggaagttttggttttgtttttccttgtgcatgctagttgtcctccaggacacatctttcttagctgtgtctcagttctagtccaggaattagaacaaatggttgaaattattggactgttggcagtgataaagcgagctggcagttcagtctccatgtgtcatcaattatggagatgcacgccatgacaaattggcagctagtttttcgccatttctgataccgagacatgatccatctgcacgcatgacttagcaaaattttgtactactacatttggaaactgacaggcaagtaactaaactggtttttgtcttttcaggtgaaagggctcctgaaagagaagaaggtggagatgctggtggacccggacctccagagcggcttcgtggagcatgaggtggagtcactcatccaggtggctctgctctgcacgcagggctccccgatggaccggcccaagatgtcggaggtggtgaggatgctggagggcgatggcctcgcggagcggtgggaggagtggcagaaggtggaggtggtccggcaggaggcggagctggccccccgccacaacgactggatcgtcgactcgacctacaatctccgggcaatggagctgtccggcccgaggtaaaagaaacgaaagacaaaatcacaaagcatccaacctttgctcgacggcttcctcgcccttgtttgtgtatatgacagacagatcgatagctggcaaatctggagggaaaaatggtttacttgtaaccctccctggtgcctcggtaattttcaagtaggctctgcacttggttgtcgttagaaatgcatggccgggcggaattgcaacacattgttgtggcggctctgcgtctgtaatggctgaacaactgatgcctctctctctgctgtattgtacgtacaactctctcttttgacggtgctaaacatcctaggcaatcttttttggtctcccgggtcacaccgtgtccgcctgtactttgttactcttcgttgaaaaactatactggtagcaaactcaactctttatctgaaaaaaacaaggtccatggcatatgcaacggctgatacggacgagctggtgtattgaggttgcaggctggatcaatgatcatgcagccgtgcaggttgcctgtgtgcgctctctcatggtgtcatgcatgcgagtgccagagtgccagaccatcaccagaaccgctacacataaacaaatccactgctgcctgacacggtgttcagccagcgtcccgttttttcggcattttctgcctcccgattagccatacaaaccgttagtgttctgcatcagagaacgccagaacggcctaaatattaggccataccaacaaaggaacaaaatgatcgacaaaagttcacgcccaggttaattacgtactctaccaaggacagccaaaagtgcaaaactataactagccaaaacaaaagtgcaaaagaaagggacgagagctagtgcagcaagcgtgctcgcgtagatgctggccggcagcctacctgcccacacgcgtgctagggcctaggagtacaaaatacaacgcggcattagaaaatcctctctctacctatccacccatcaacgtgtcggcgtcgcacgcacgggcgcacgggcgcgcgacgcgaactcggctggctagagggtgggcacgcggaagaacctgccgcggcacatgcagcggtacgcgacggggcacgactccgcggcctcggcgcaccggaggctcaccatcacgcgccggcacggggagcacggcccgcacgcgtgcgtgcagtccggcagccgcgatcccgtcgccgcctccgccgcgttgcccatctccgtcgtcgtctcttcctccggctgtgcgccctgctgcacctggaacgtcgccgtctggccgccggtgcctctgtcgtcgtaggcggtggtggtgctcccgttcgcagcagcagcagatggagccgtgccgccgttgtgtaggccaccggctgaaccttgcacacctgctgcattacgtatacataaaaacgtagtacgtacataatgaacgaaatgtgggcacaagttaaatgcaggtgattcaggccgtgaagggacatgccacatgatgcatccgccgtacgacgtgccatctttactagtagtgcacactacacaggagtagcactaaaagcttactacatgaacacgtgtattcctagtcagattagtacgtactccagtgggaagctctggtgaattacctggtatcgtcctgacgccatcagcaacgcacgagctcatcacgaccactgcaaacgctagcgccatggcactaaacctcctcattgccgccggtgaatccgtcactaaagcaccaacgcgaagttggagcagctagctgatcagcacaagcacaagatcgatcgacacgccaagcagagagagcagtcagcgacagtgagcacgcaagcaaggagaggctcagcgcgaggcgaacgtatatatggccggctgccgacccgcgagcgctcgccgcgtgcgtgcgagaacgagcgcgcgatcataaataaaccccactgcggcggcatgcacgcgctggctcacaggatcctcgacgttggtggatccaccacacgcagcccgtgcgcggctgcgcgcgcgcgaggcccaaagagcggacacgaagaagacgacgagggaaggaggtagcgatgcgtgtgacgggcagcaatggcgaagccccgctgcggcgcccggtgcattatttatgcagcggcgcagggagacgctgttgttataattgcggcacctcggagaggagcaccgcaccggcgagagatcagctactacgcactatacgtcagaagaggccgacgtgggggttcccgtggagatgcattactgtacctgccgctgctactgtttctgaagaactgaaattctgatcgcgagctcaaaaaagttttgctgcctcgtgctttcgacgatgtgcaaaactgcaagtctgtagctctagtcagactgccccgtcaccgttctcatcaatgcgcgcctgcaaatccgttgttgcagttaagagatgtactccaataaatgaagctccaaggtttttgcccatggatatcagaattggattgattgttcgtgctttgcttcttcagtcagaagtattagcttcttcagtttagaatatgggatatgaactgaaactgaaactttctttgcttctaaaagaacagagcctaggagtattagctttcatgacctgatctgacctctttgtgtgatcttgtcatatgttttgggcctttggctttggtacaatctataggtagactggagttttgtactccatccggactgcgttttggagaagcagaggtactatcgtcatcatcctttgcatgagatttgggtcatggatgcatggagggtgagtttttgaatgaagaggcaggcatttctggcattgcctcctcttcaataatggggttcactgaaaggccgaggggaggcttgaatgcctctgctatctggacaattgtgctgctgaatccttattatgctgctttttgcagacctgaaatctgcactttcatgtaaaggaggacggaagaacagtatacagttctctgaactttgttggcccaaaggtgcaaaatcaggaagatttcaccccctcggtgtgatagcatgtaacggttcacccaatgaaatatatgtaagtatgtttttccagcgaagaaagtttaatagaggaagaggacgaaatcatgcggttttcctaaactttcagttgatgaaggattcctgtgttctgttttcattgattataaaacttttgcgtaatatgtcaagccggatccgtggcgcaatggtagcgcgtctgactccagatcagaaggttgcgtgttcgattcacgtcggtttcaataccccgaaccaagccgggattatttttttcacctgtgtacatttatatttaggctacccataatttgttgatgcctttccatgatagcagtttgtttgatcttttttttccctgtacaaaccccaatccaaatttgaattatgttttgcccagcacaatttatttagtctatccacaatttgttgttatcttttcatgacaacaatttgtcgatcatgttttgccgctgtacaatttatttaatgtatccacagtctgttgttgattattttttgccctgtacaatatatttaggtatccacagtttttgttgatatccggattatgttttgccctatacaatttatttaggatatccacaaatgttgatgtcttttcatgataacaacttttcatgacaacaatttgtcaatcatgttttgccgctgtacagtgtatttagtgtatccacaatctggtgttaattattttttgtccctgtacaatatattcagggtgttgacgtctttttatgatagcagtttgttgatcattttattttgcccatgtacaaacccctatccaaatccggattatgttttgccctgtacaatttatttaggatatccacaaatgttgatgtcctttcatgatatatataacttttcatgcatgacaacaatttcttgattattttttgccgctgtaaaatttatttagtgtatccacaatatgttgtttattatttttttgctcctatacaatctacgtaaggatttgttgaagtcttttcgactcatcatcctcaatttgttgatgtgtatgatcgtggtcaaaacaacctttcttttgttgttgcttatagggtgtgtttagttcacgctaaaattagaagtttggttgaaattgaaacgatgtgacgaaaaagttagaagtttgtgtgtgcagaaaaattttgatgtgatgaaaaagttggaagtttgaagaaaaagtttgtaactaaacttggccatagtcatttttgtctctatccttgttcatgaaagatgacatagatctgatgtgatacgtccaatctcttcccatcaactcttcccattttggctgaattcaaacatattttacaaaattcagaacttgtcccaaatttggaaataatagtcattcatttttttccaaaaaaatagttgattttttttgtaaatttttttgatttctacaatttgggacagcttttaaaatggccaaagggtttaaaatcagccacaagtttttcaaatttaaattcggtaaggttctccaagggtaaaaatcgtctttaatgtcatgaatgaattttgccaactaactttaagcgtgaaccatgtgagttgttgaggggaaaaaaaggtaagttcgatttgctactcttaaccatcgtaaatatctgatttattcccctaactataataccagtggcggtgacctccttcccacaggttctccacctccaactcggtgtagcccatgccatagattgttgttagcttgatgtcgcaactctcctctctctgccgccatatcggcacaatagttctttactcagcaatacatcctctctctcgaaggtgacggaccaggtggacgatcccaacggcactattccttagcgagctcaatgataggggacctatgtgttcctctgccgcttgattgagagagaaatacataaagaaacaataaataagggaattccagcggaagaagaaatggcacttgtgtaatttactgactgaattgacacgtgtgtgtcacgtagaataaaaaaccactctcaactaagttgaggtaattccagtggcagagctaggcattttgtgaaccgctaccagacatattaaacagttaaaaaaacaaaaaaaattattatagaagtggactgttagtatgcctggtctcctgcattgatgcttaaacgctgcttaattcacataactaatttttccggcataaagtgcatgcacaaatagacgatatccaccgaacttgcatgcacgcaccagcaagaatcaagaacccatcttgctccactgaaatacattactagatgaggtgattaactgacactttgccaaaaaagcagcaaatcaacacacataaatcactcgaatctcaatggatcgcacgctgagcctaggcaactgcccacctagccgggcggtgaattcatcgctgggtaattcattcggtgtaagagcttagagggtgtaaaatatttggtattggagttgagagaggtaattcatccttttacgaaactagtgttgatgtttgctaagactactagactacgctagttttttctaaggaaaattaatggtaaaatacattgtgtttgactttttaaatcttggaggtgttactttaatcaataatttatggctaattttgctacaggacacttaaattttgtgtaatttgctaggatacatcgtaaaaatatttcatggctgaaagacatcaagtctagtaatttgctgaaggacagtttcaactcaattgaagtgagaaattcttcaaaaggacaagaatgccctagagagtcaaaaccttttgagctgaggctggagtgaagatgaaatacgatgtatgctagtgatgtacttgggatgatgacaaatttagagttgcataatttctaaattttcactctaacgtcatgtttaaagcatgtggtcttatatacattctcgtctttcttaagaatttatctctttaattgagccaaaaatggcctctagcaaaacaccagttttttaaggtgtctcttagacatgacacatttttcgatgtctatcagcaaattgcacgaattttaggtattctgtagcaaagtttgccataatttatactctctttatctcaaaacaagtctacgttcgtatatgaatctgaatatagcacatgtccagatttatatataaaagtgaacttatctcatatatgtagtattaaaataactttataaaatacaatacggttagatatttggtaaaatattagtacattcttaagtacaatattacatacgcctgagtatatactccctctgtccaattttaagtgtaaccatgagttttcgtgttcatctttaatcgtgtgtcttatttaaaaattttttataattagtattttttgttgttacgagaggataaaacatgaacagtactgtacttgtgacttatgtttttaaatgttttttaaaaatttttaaataagacagacgattaaaattggacgcgaaaaaacattgatgcactagaaaataggacggatggagtagtgccgtagagatttgccgttgcttctaatctctttcgcaacgtgttagtggtcgtacttaaggggggtgtgtgtggtttgcgagttgtataggtcttccatctaatcggagaaaaaagaaatgtgccttttttactatacaacgtccaatggtctgacactcttgactgtgtgacagtgtgtgcggcttccagctctcttggcaaatccttccaccattccacgcgattttctccgctcggcagtcggcacccgccatctcccgcgcggcagcgccccgcccgcccatgaacggtagtatatgctccgtgttctcctctccttccctcactctcactctcgatcgctagcccccgcgcgcgcgcgcgcgcgggagcaacggataccaattcgccaagctttttgctcttctttttgtttctcactgtgaccactgttaccgccagctcgacgccttcacaaatgggcggccaccgcgcggctggtgctcctcctcttagccgctgctgcggcggcggcggcggcggcggcggggcgcagggaggtggtgacctcgccgcacggcgccgtggcggcggacgacgggcggtgctcgaggatcgggcgcgacgcgctccgcgacggcggtaacgccgtggacgccgccgtcgccgcgtcgctctgcctcggcgtcgtcagcccggcgtccagcggggtcggcggcggcgccttcatgctcgtccggctcgccgacggcaccgccctcgcgtacgactcccgcgagaccgcccccctcgccgcctcccaggtcagcgcgattccgatcctcccaatcactcgcgtacggtagcgtacaatccggtgtagtcaaagccggcgacttcacttacgtttacgctattcaattacatatggttttctagataatgagttcaatcacatgattcccgactgattacgatgttctaaccactcaacacgatatttaaatggttctaaaccttcagcaatgctgactgaactgaagaattttatgatatcttattacttggatatatatttctctttatctgtcacaacttatcagtaaattaatcaactcgagagcagtcattttccaatccttgttaaaaagcacaagacttggccgaggtctccaggtcgtctgattgatctgtagaaaatgcatggagtaacaattagtcatgccaaatgttactgcttatgctaccactatccgtactagtccactaagccagtgggtagttggttgattcacatggtacttgttgcttcctgatttccttttcttttcctctcttttatgaaaaacgaatgcttctggacctgttctattctattctatcacaacaaattaaacagaaaacacagaaaagggcatgagttaattgacttagatgcacccccccccccctgatagctagcataattggggatttattagtcatgttgcttcagtggcggatgtgccatggagtgacgggaagaacaatgagcataacgagccatgtggctggaaacatatccttgtaggtgaagtctgtacatgccctagtggtgccatctactatgccggtccttgtcttggttcgcctctcatcctgttgaatgtgtctcacgctatcgtccactagccgtctgccccctacatttcgcaccattcatggctggtccagcccgaattctgggaaagccaaatggaatccgagttagggatagcgcctcatgcagcgatacaatcacgtcaatatcagttcgtgttgcttttgcgagggcatgtgcagcattgtagaagcgagaaatctgcctgccagtcgttgatcagtgagagaaaatacacaccaagctgttaactgatcaaacacatgccacgtattgccatgtatttttcagaaaacataattagaaaacgaaattgctaaatggcatttgacggaaaatcaaggggaatttcttacagattttgaaccacctgatttgcttgaagattcgtgcacccaaatccttctccagctccgatgaatccatccccagtatcagggaaactattttaacagctcgagtggatgtccacccgtttattgcatgtcatctaaatggttatgaaaaaaattaaaaaaatatgaataagatagatcaatatgtaatgtatcaatccacaaacatgcaagttaaaattcaacttctacagattgtaataaaaataacaaacaaaactcaaattacttcctgtatatttacagttaaatntgttggttttgttacaacttgtagaagttgaattttaacttgcatgtttgtggagtgatatattacatattgatctatcttgccaatatttttaaaaaattttcgtagccatttagttgacatgcaataaacgggtggacgtccactcgagctattagaatccatccccccagtatcagcgatgacccgcgacaagttagggttggatcctaggttgggatgggggtgggaaggggtatggggatgggaggcagcggcctgcggcttggcggttggtggtggacatgtgagggtggcgaggcaccaccggcggcggcaccgaagccgtggggatggaggaaggcgatgggccagctttggtgacggggcaaagcaaagtgaatgttaggagagtggtaggtggtggcagattcggtggcagggagtcacgagagacaggaaagatggcggatgaggacacacctcatcactactggcttgaggaggagatcgtttggggaggcctcaccgaagcttttgggcttccagctaggtggcgatggcaaggaagggggtggggtggagttctagtcatgtgcgatggtggtggattggaagagggagggttagggttggggagaaagacacgaatcttaaagtaattcaatggccgacaattcgaaagatttaggaaagtgttggtcgcatggtttaagttaatctaaatgggttttaatggtaagcagaagaaaaaatgttttatatactcgccaagccttgaactaagtgtgtcaatttgagtattgaagtactacttagaaaacaaagcagaaacgagagcaccaccctaacttttgttaggaaatataagagatatctaggagaacctaatcgttaaaataaaaaaaaatgttgctctaatttgatccaaagaagactggaaccgaagtggcagaaaattaggagggtatatccacaagcaatcaagtatccatagtaaaaagaattgtcctaattaattttcttttactggtattatcatgctccattctaaacaaacagagttaacgctagaaatgtcaattgtgcattcaggatatgtatggtggcaacgaaacgctgaaagcaaggggagctctatccatagcagttccaggggaaattgcaggtctgtatgaggcatggaagcgccatggcaagcttccttggaagaggttagtgatgccagcagcaaagcttgcccgtgcattcagagtgtcaccttatctgaggaagcagatggaggcaaccagagatggaattctccaaaataagggaataagtggagtgtacacctcaaatggagatatccttaatgttggagatgtatgccgcaacattaggcttgcaagaacactggtggctgtcgcggagaaagggccggatgtgttctacaaaggcgcagttggtgatcagctggcgaaggatattcaggaagttggagggatcataacaatggaagatctgaagaaataccaagttaagatacgtcggccacttttagagaatgtattgggactgacagtattaagcatgcctcctccttcagctggtggtgctgggctaatgcttgtaagttttctttgtactaaattttgttcactgttctttggtagcttaagtttgttgatttcaggtagcaaatttaattagtagaatcaactctatcggataatagaacctttaaaaaaatcttaatcttttctgcactagtattatcattttatcttgatacccttgctcaacaaacaggttctgaatatccttactcagtatggcctccctgctggtttttctggctcacttgggatccatcgtctaattgagtccttgaagcattactttgcaataaggatgaaccttggcgaccctgagtttgtaaatgttaacgaagtcgtctctgatatgatgtcccctaaatttgctgctgacctgaagaaaaccatctatgataacatgacatttgaccctaaacactatggtggcaggtaaagcttctcttttgtgcacaaatatgtcttccttttcaagtagaactgtcagcaaagtcctattaaattcctgcatatactagtatactactattactggtgaactaatttagtaatctgcattattacaggtggaacatccttcaggaccatggaacaagccacctgtccatcgtcgacagcgagaggaacgccgtttcgatgaccaccactgtcaacgcgtactttggatccctgatcctgtctccgagcacaggcattttgctcaacaacgagatggacgacttctccatgccggcgaacacgtcggccaactctccgccgcctgcccccgccaatttcgttaggcctctgaaacggcctctcttctcgatgactccgacgataatactcaaggtgaccaccacctcgcgcattggaaaataacacgaactctcaactctgaagaaagttcatttgaaatgtctgaaaagttcagtcttctgaagatggttttttttgttctgattggtttgtgctttatctgtcgtaggatggcaatctgaaggctgcggttggagctagtggtgggagcatgatccctgctggaaccatggaagtgctcctcaaccatttcgtcaagaacatggacccgttgtcctctgtcatggcgccaagagtgtatcaccaggtgatctgggcttaacgtctgccttttcttctcttcgtagaaattcttctttctgatgagctttggtttgattcttgccatggctgtttgccctctctggctggctgcagctgatcccgaacgtggtccagtacgagaactggacgacggtgaccggcgaccacttcgagctggacgccgcgacgagagccgacctgcggaggaaaggccacgtcttggagccgctcgccggagggaccatcagccagctcgtcgtggacgacgtcgagcgccacggcggtctgaccgccgtcagcgaccccaggaaaggcggcttcccggccggctattagaccggagtggctgagctatagctgcctagctttgatgcagcgatgattgcttgctgcgccattcatggacatatttgtacacgtcgttctgttctatgattctatcgaataaataatactccctcagcttataaaatgttttaactttgatcaaacttaaactgcttcaaatttaactactccatccgttttacaatgtaagtcattctattatttcctatattcatattgatgctaatgaatctagacatatatacctatctagattcattagtatcaatatgaatgtgaaaaatgctagaatgacttacattgtgaaacggaaaaaatagtttatagacaaatatagaaatatttataaacttggtcaaacttgaagcagtttgattttgattaaattcagaatattttataacttaaaacggatggagtaataactgcagtgaattttaaatttttgtttgaaattgttagcgatcatccgtgcaaaataagctactccagtactgttttgtggacacgtttgtcacgtgacacgtcacggtgcgtttgggatattgagatggcccagatatcccatgactactaaggcctggactggacgtggctaagtggttgctcctagtccgtggcctgtgggtttacggcccacttgaatcagaattggcctgcgccggatttggggtttggcacgtactgtttttttttcttttttttagacacactacaaacgcaacaaacgcagacactcaacttaaaaaaaataataataagcagtaaatccaagtattggtgttaagtctaagacttaaacctaggtgaactgatttccccataagaaacttaatcacttgagttatgttaaatttacaaacctcatgctcatagcaggaggaaggaaaaaaaatagcgaatcgtaggagataccacgcgtacatgcatgtgtgcggctgtcgtctgtgagactgtgacccgtgttgatcatggtcggcggcggcggcggcggcgtgccggcactggcaacgtcgagagccactgtgtcactggtcgccgatcgatggaaacgcatggctaggactcatgagaaaatcaagttatctcctgtgttatctaaaaaaaaaagagaaattcaagtttcaaatcctgcgtagaaggagcaaggaggagggcacggacgagacgagagtgagtgaccggagagcgccggcaggcgatcgatcggtgtggagcgttacttccgaagagtggcagctgctatcacaatccgtcgatggtggctcagttaggtacacaaggaagcactgatttgaacatttcatatacgcattgtttcgatccatgtcgactcacaccccactaattaatctattgctagtacaagctagtacttgacttcaacagctaccaaacatgccagttaatttacttgtgacgtatcg

SEQ ID NO: 48541 - DNA, 3044 bp, Oryza sativa
acgtgttgaagaaagcctgcaaggagaagatgagggccgaaacaaacgccggcgaggcagcggcggcggcgatgacaggaaagaagacggcggtgggcggtggatcgtccgaaaagaagacggcgcctgaggttagcaagggagaacgccggggattctctgggctgatgatgatgaagaagaaggtgcacccgaagtaagctagcagatcgaactagctagctatcttcaaaccaccactgattgcagatttgcagggcttggtcatcactcgtcagtggcacatagttgttgctaggttgtttttgctctaaattaagcctgtaaaactgttctcgtgtttccttgtttcgctcttaaggagtgcaagtgtataattatggcaatacatgaaggcatgaaccagcaaatttcttggttactttgcaaaatgttgtggaatgttttagtaattttctcggagaaggaaaatgggttttaaggggctgttcaaattgatgtcatttttaatcataccattttttttctgacatagttgctaaaaatatctctacgtttagtttgttgccaaactttagtaaatacatagaaaatcttttggtaaaattttgataatattactaacttaccaaaattttagcaatatttattttagtacaatttgaatagaccctaaaaaatcttcaacacggaagatcctgacttctaaagaaggacatatcattagttacagttcacaagctaacaaaaattgcagcgtacgtgccggccattcagcaagctgcacaaagcttacgacaagccaagggacggtaacagcagcttacctaagtacctcgtgttacttaaagacacaaaacaaatattctagtaccctaaactcctaatctccttttcacctgagttctggaggatttcacgagcatcaaactgcattctgtatccggccgctcttcgtgctgtggtatactgtcctgtctgtgtaagcggacaaatagcactttgggccataagttgggctagctgtgccacgctactttatgggattctttatattgggcctaagtctccttgctaaagaaactatccaatttgattccctcaactataggttgagtctaattcatatccctcacctgcaaaatcaggtataacaacacctccaactattaaaacaagtgcaaaatgattacctcgataatattgatggtagttttcattgacgtgacacattgacatagtcttcatcctacgtgtcaattttacaagaaaaaaaaccatgggaccacatgtcagtcactagggaaaaaaattgcggtgccacttgttagccattcctcctctcttctctctcgtcccatgtaaatggaggggtgatggcgaggagtcatgcagaagtaggcctctaaagcaacggcggaggacagcaggttaacctagtctcaggatgaggagaagaagagcacgatgtggaggagggaagaggagcagcatcgctacgctcagtaaggaggtggcccgcacaaggaggaacaacggtggccatcctcgtcattgttgccaacctgccatcatcgctgctggcctcttcgttctctttcctcgtcagcctgtaagagaggagggtgtgaaggtagaggagagaggggaagagaggaaagagatggggtagcgctcacttacctagccaccgatagccagcactggcaggaggagcgcaacgtgatgatgttcgcaaggaggagcacgtgctaacggcagctactgtcctcttgcctcgagcctgggtggccgcctctgtgctattttcttgatttcgttgaagatttggtacgaaacatgaatgcccgattcattgatttgttgaagttttggcgtggttgcagatggcggtcctatccgtgctagtgcacgtgaacatgacgattgtgggagaggagtgggtcaaggtatgtcagggtgcttacaagcactgcttttaggtggctccatagacacgtgcaccttgcactacaaaccgacccgcgtgcaggccagcaatgatgctcgagctcactgatattccatcagtgtgctcatgaaaatagataggagggtgtcctttgtgcgatgtcccaaccgaatcaattcaatggttagggtggtgacaagatctgggtgaacgaccgatctacaactctcatttaatctccaacattatctttgtggttttcgtcagccgctatgtcagcgaaattcgaccggtataaatgttatacggaggtactgtttttttatttgaggaagacaagaactatatatataacttgcagctatggggataaataacggttgtgtatatttttgtcaactatagattaagcttatctttatctttaggctggtaatctaagtaaatttcttgttttcaattaagctatgattttataatacaaattaatttaacatgaaatgtttttaataactagttatagtttctttaaagtaaaggacgaaatgattttcattatcaaaagcaattcatcttgaccaacttccctcctgatatgcatactcgggcatatactataggaggaagggaaaaaaaacagggccggattttttttactccttttttcatgatgcatttttctttatccacgatcatcaagtgcgcggtgtgcatgctaattagctactactactaattattgtttcagtacgtagtagtactagacagtttgcatttgtacatcattagtcgtttcttgatcatggccgccgtattgttgccgcagcgcaggcacagcctcctttgctggagaagacgacgacgaggcctccttattctttccccacagtacgaaatacagcccaatgattaccagagcagatcctatcacactgcatatatgtatatatgcacatgattaatgccaatcaatttatactagtaattagacatgatcgatcgatgtgatgagcgtaactaacgtacgtacattccaagatggagttgctcatggagaacgatgacgttgatagcagctgcgatgatctggatg

SEQ ID NO: 48542 - DNA, 1957 bp, Oryza sativa
catcagggcagtgcccgagtagagcgccgggtacttcttggcgatcctcgactgcaggatgaaccacagggaccagcaagctgaaccgcccagcagcgccaccgacccgatcgcccacctgtgcgcgccgccgccgctgccatgaccgacgactgccgccgttgcagaagaagaagatgatgacgatgatgatcgagcagcagcaggtcctagcttggtgagcgatggaccctggtagagagcgaggatcatcgctccgctgaatcctaacactgtgcctcccacttttgctatgccagctcctgtcttcaggtccactttctccagcctgcactagtactagcttagcttacatctttccgaggaagtgatttcatgcatgccacctaaatagttataatttttttaaaaaaattgtcatctatattgctaattttttttaaaaaaattaatatctattttgatgacatgcaaacaacgaaaggatgtctccttgaggaataaaaatccacatcccatctttcaaatatttcttcttctttagtactactcctaagtagttactccctccattccaaaatatcactctgtccaaatttatagtattaggatatgtctcatccggttctagattactatattctaaaacgagggagtagttaggttgttaattgcgtacccataaggcagtgctacaatgaaagtgaagatgggagtcatgttgatgaaggcgcaagcgaatgttgctgtggtgtactgcagccccaagaagaagagccattgggtaagggacgctctgcatgcaccattttattattattaattactatgtaattaatcaattcatttgttagagaaaagaatatatatcgatctttcaattcatcaagttaaaattgctagctactactagatatattatacatatatgaaaatgacttgcccgagcactgcactgaagaagagacacaccaagatttcagccgtaagctttggtcttgtcttcctgcatgcatatttggcacatacgtatcaaccaactagtaattaatacacatatatatggtactatacagctgctagctagcaatatatagtagtaccaatactaatcgattaacgcatatatacgaaattaaaacctatcaattaactgatatgcatcggactaaacgaataactgccatttatacaaaacacttatcctgagcacactcaagggaaccatagataggtaagtgaaatccaattcatgaaataatttaatccatggacggcaccattgtggtaaaggtcgtaattcaagtgaatcaaaaagaattaagtgtatatttacctctcccggaagtaggcgattggggcgaggaagagagtggcgatgagctgacggagcgtgatgaggacggtggagcgcatcccctcgttgaaggccatcttggtgagggtgttcatcaccgcgaacaccaccaccaccccaaccattgtcaacgttggcttccaactattacagctacccattaattcaggatctcttgaccataatcttctttttatctggctagagcttagctatacctatctgcaaatgtatatgtgtgcttgctaatgttgctttcgccttgctatatggcatcaagcatgctgctggtggcaacaatttatatgcatgcctggcctccaagtgacaatttgacaatattccgttccttgctttactacatatatcaacatatatcgcgcggtacgtacgtatttctgcattgctttaattatgtgcactcaattagaaggatgccaataagatattatagtattaattagccttactttcttacaccactcaagttgaacaacttatcatcttcatgcccaaaaatatttttttaagaaaaagatagaggaagaatttgttcatcagctttatatatgcattttctctttaaaaaaaaaagaaaag

SEQ ID NO: 48543 - DNA, 15185 bp, Oryza sativa
  unsure (1)..(15185): unsure at all n locations
acatttttattctgaaagaaaatgagatagatgctttaatttctttggtgcgtcatccgttgttggtcagcaaggtgactaggagggaagggggaaaaaggttaaagctgacttatagtatatgccccaacaaggaaaagaatgatcattaaaaaaacaaacattaagatggaacaaatatatatagcaattaaactatataaatcagataccatgcatagctgggcctctcctctcagctagagcatccgatgctccattgaatactagtagaacattcaatgcacgtacgcatgaaggaattgatccgatgtgtcatttttgccggatggaacacatgggctggccgggcgaccaatttatgttactaacaattaagtttttctaaggatggcacgtcattgtataaggagatactaacacaattatgttactttagtcttcttcagggcatcttaattaattactctaaatattattttcttccgctggaattcttccgtttgcaagcgaaagcaaccgtgtcacacgctgtcacttcgtaccggccatactcatactcatatagtcatattataagcatcacatatgcagtaatgctctttttttataatggaataacattttgatatttgtttaatgagttactacccattattataaagtttacgcataaataaatccaacgcacactgacgtgatattagtgaagtagtgcattaatatgctgatttttatgcccccccccctacgtcatataatatatgctaaccgaccaggcatcatatcagaaacagtaaaaattcaacctttgtgtacgtgcgctgaatatattatttcctctgcttttgcttgctccttttattttccaggaacaatactgtatgatgcttcattaattaagcgtaataatattcattttattttatgatacaaggaaaatataattgattttatttatatgaaatgaaactttgcacgatcgatccgtcaaaagatataggaaagggagaaaacattgcacgatggccgtgtttagattcaaaattgttttttcaaacttccaatttttccgtcacatcaaatgcttggagcattaaatatggacgaaaaaaaccaattgcacagtttacatgtaaatcgcgagacgaatcttttgagcctaattatgccatgattttgataatatgatgctacagtaaatatttgttaatgacagattaattaggcttaataaattgtctcgcattttacaggcggaatctataatttattttgttattagtctacgtttaatacttcaaatgtgtgtccgtatactttacaataaatttagcacacaaactaaacatagcctatgtaagatttcgatcgaagtggaaggtactgagatatgctggtagccgacactgacaattaatggtttgcaaagcaaaggcattcgatccttgacgttctatgtctctcttgatcgagttaattcgataaatttcaaatcttttttttcccttttgtatgcgggccttgtaatcatcgtatgaatatttttcaattgtttggaatcaaacgatggatggatggagagtatatgtacttctagctagccctttattttagttttccccttaatttcgcaaaaaaaaaaaaggcagagaagaggaagaagaacaagtatatattccatttgtctaaatatttaacgttacgaggaacatataataaaacttccagaactttgacatcaataattctcaaatattcaagttctttttaaaaagtgatatatgtatatttggcttaatattttaaacatattatattttataaagttaataataaaaagtaatagttggagcaattgaatcttattttaaattatatatatttataatcaaatcatatcttatactaaacgtcaaatgttagttaaatactgcatgcaattaatccgtgcgtatatgcataagttagctcatatatatatatatatatatatatatatatatatatatatagtgaaagagcatgtagtctagtggttgtagtgatctgagtaacaccctgtttcataagttcaaatctttggctaagttccatgtttaataggttaaattcctactccctccatttcataatataagagagataattggtgaatgtgatcacatcctagtgtaagggagtaatttaaaatggctgcataatatatccggttggatataaaggccgaaaaaaaaaacccttccaaaaaaatagttatatataggaggatactgtatcactggagtatgcacgtacgtatgcagtgcactgtttgactgacgtactataaggtaggaggactaacgaatattgatcttcatcgaccattcttcttatcagtattcgttcgttcgttcatttatttgtcatcgatgatatgatccatccatcattccatcttcaaccgattcaattctcatcttccctttcacaaaagaaaccgaccgacagacagagaataactagtccacgtctctgcatagtgtatactcctgctcccgtggatctgatcttcttcctcaatcgtcaattcgtcagcatactgctcgcttactatatatgacgaatcattctgcccggggtttgataaaataaatctacatcctattattaattcaagatctacagattattaaattttagcatattttgttttaacaaaaagtagcacattgtgtgtacattaaaggaaattatatcattttctagatatttttttaatttctacataaatttattatagcttttgatcccacggtgtcctttttccttcctaaatagtaggaagttggtggtggggttgtaagatcaaaaaaaaaccgagcttaccatagggaggtgaaaagtgataacattagcagaagtcaaataaccaaacttcgatagataaaaaactcaccccaaccttaaaaaccaaaagatcaaactttgacactctaaccggatctgtacgggtggctaatcgggcttagaactggtttgactgaagtacaattactagttcgatcgtcagattaaaaagaaccttacatcacttgtgtaaaatcttgttttctctaaaaccagccattagatcgagctctaatcttgacaggaaactaagagacaaatctatcgaagggtcatgcaaaagtaataaacggtttaagagaaaacatctcaaaagctagacgtctcagaaatttcatcaaatatgaataaaacataaattttaagcaaattcgagtcaagcaaataccaatgaaaccttttagatctgatctataatataatagaaatgtttcgggtggattaacttgaacaaaaccataacaaaactaagaatcacaaattaatgcaaaaacgaaaaaaataaagattacaaaaccagaaaagatcgttgacgccttgttgattgaatatgatatttctttttcaagtagtattcataagacggtcattgcacctctcacgaatttctcacataaccctaacacaaagagtagtaaactctttaatctgtcaagggggcttaccctcaatgcatagcctcccttattcacatctaattacaaaatcaaactaaactccaactctcttgaacttggactccaatccaaattcaacttatccatacgcacacaattccccttgtcacctccatgtgcattattctctagccttggtatccacatgatctccttgatcttctagaactcaacttctaccaagtctagtcttgatccatcatcggcaatactctcgtgacctcaagcaacagctacacgttaacaaacaaagaaaccatatttgagcacaagatcttccccaatttgactcacatatatctcacgtatagaaaccatctaaaagtcataaacatttagcaatcaacatattcgatagaatcaacccaaaactgattcatcaggagtttgccggtctaagtgctccctcccatggcagtcagatcgctggccccatggtggtgagaccactcttgccatgaaacttcgccaaattcaacatcacttcacaaacatcagctcaatcacttttttatcactcttaataattctttatcaccagaatcaaatcaacaccttaatttaataagggtggtgataaattcaccactcaccaccaccgctactctcttttaaaaagagttagaatagattactaattctctgcagttgtgatagttcaatccagttgaccactataagatgtttttgattaattggggagtttcttttcagagatcccaactagtatacaaacaatatgagaagggctacaatgttttccaaaaataaaaaaaacacaaatcgcaacgcacaagggtcaattactcttttagacggtgcccatatagaaagcccaccgggcttgctttcaaccgtcatgtgggctaatgttggatttaagtatcaggctttaatgtttgatgttaatcacatgggcaaatcggtgatgcaagtgtagctcaactggttatgtttttcttgtggtggaatcaacccacctgagttttagtcctatacttaacatcgatgctcatatttacatctaattattctttcgatggtaggtggctgtcggtgacacgggaccaggagtaccatgactagaggcttgaggcagacataatcgcccacgtggcctggcaccctcgggggacgtcgggcccgagggtgacgtgttcgccctcctcttagtctccccaagggggtcgggccactcccgcctcggccccgagggccgaagcgccccgacccctcgtggtttctcctccgcgtgtatgggttaggtgagcacagcggggctcacctaaccgcatttattgcggtttggttgaacctgtcatgccgcatgtaacgcagtgcagtgcgctcgtttatccggtctgtgacaggtcacagaccggtcagatcgcggtcaggtcgcgacaggcggtctgacgcacgcctcgccccatcccgtcaggacgagggcttctaggcgctcgttcccagacggagctagcgtgttacctcttagagatggcacgttagtcccggttagatatatgccaggcttcattctaaccattacagacaagatgttgtgtgaagaagggcaaacatgcatattgctaagctgacgcgtggtggacaagaatgaccgatttgtgaccagtctgacactgatcatgtcgtcagcagacagccacgtttcccacgtcgcacctgcctccggcggaagtggaggtaggtatgtgccgtcccatcagaagatcattcggacagcaatgatacaaatctccgtccatttatgaagagagggcaagtccagtttggaaagggagagagggtgcatgtggtatccccttaagatataaaaggaggaccttgcccactaagagagagggacgggactctggtagattgagaacggagagcaacggagactctggttcatactttgtagctccttcatacacagatccaccaaaaacacaggagtagggtcttacgcatttcagcggcccgaacctgtatacatcgcctgtgcctcgtgtgctctttcgactctcgcgaacattgtacacacagagagcttaggatttcaccctgagcccccggtcgaaccggcaaaggggggcctgcgcggtctcccggtgaggagccccgcgctccgtcagtggcatacctattgacaacgaagtgcccgtgtggtgatcgacaccttcattaatctcaagatatgttggtctaatattttaggggtgttaatagggatagggtgtgcgtgagttttttcgaggtgttcatatggatatataatgtgtatatgtgttcctatagggtgagtgtgtgcgcattgtgagtacttgtatttgtactgtgtttaaaaagaatcatattttagaggtgttcgtaggaataggatgtggtgaatcttttagaggtattcttagccatatggtgtacttgtgtgcccgtggtgatgggcacctttgtcgatctaaagatatattgattcagtctgttggtaaaatgggaactgtaatacccatttacctggtaaaagcattattatcaaataaatagtatgctcagaatgtccttaaaaataaaaaaggaaaccctagggtggcgtagctaggggcccactccggagggccccaggcccacctaaaatttcatacatggggttcactccggctgaggaggaatattgagtgtatggcccaaaactctgagtatcaaagcagcttggggcctagcttgggtcccaagcataccctaaagtatataccttaagaatgtaacctaaggtctgcccggggcccgatcccattccgggccctaggctcaccctagtcctcgcaggttctacggttcccggcaagaggagtgtaaaacatgcaagacctatatgccttaaagaggataaactatggtctgcctcgggccggccaagtcctgggcctcaggctcaccttaatccttacaagtcacgcattactcaaggaagaggggtgacggggcttgccaagcataaaggcgtaaaccaaggtgtgcttcgggccccgagctcaacttggaccttgtatagcttgcgttcctctgcttagagggttgtccaaaggtacaagacgcacaatcttaagatattcttccatcaacaacgccttcgagaagctcctcacggaataattaaccttctttaagtgcgacagggcgcgatctcagaaacttccaggaagttggccgtgctccacagccaactataaggtagcacgccccgccataaatgaaacaggtttatggggggattcccgaccagtctgagttgaaaggacgtagacaagacgccagagctaagtcactttggacggtggcgcctgggacacgcgtcgcacatgccccatgccacttcatttagccaaatagacagataagtactgtggccttgtttcgggcaagtcgggcctcgtcgagcccaccacgcaccacgtggtgagcacactggcgaaagctcaactatttcagacgaagcccgggagcccggggtaatatgaactgtaagacttgaacggtttcttggggctgcgttatgacaccggctggcaatgacaagacggttgatgagacaagactaagagtagatttgtaataatgtgagcccctctttggactataaaaggaaggggactagatacagatgaagggttggattcttctaggccaaatctattgctttgtagccgaagaaggcctccttcgtacttagttgatctagagaaaaagaacgaacaccaacacagaagtaaggtattacatcttcgaatggcctgaacctatataacctcctgcctcctcctcgcggggtggtcagaccccatgaatccaccgcgatcgcagataccatgaaccgtacgccgactaaccccctggccaaatcttcactcagggagagaggtctccactccccgctgtctgagggaccacaccctccgacacattcttttgaaggtgttcatgtagatatttagtgtgcgtgcgttcatatgagatgaatgcgtatgcatgttgtgggcaattattatttgtcctgtgcttaaaaaaaatcatatggcagattgtgttgctagttccgttgaaaacgagagacaaaatcatgctaccaatttgatttgtgatcttccgatctgcttcgcgaatggcaaactactagtactccacttcagtacaaccaatcgacggttcggccataaatgccactgacttcagctgtccaccatccagcctcccaaggttctggatcacatcgtgccaccgtgccggctcggctcacgcgtggatggggaagacggcgaccgaaggggacaaggaggcggggcggggcggcggcggcggcggcggcgcccgccgccccgtggtgctggtgacgggctgctcggagggcgggatcgggcacgcgatggcgcgggcgttcgcggcggccgggtgcgccgtcgtggccacggcgcggtcgcgcgcctccatgcgcgggctggagggggacccgcggtacctgctgctggagctcgacgtgcgctccgacgagagcgcgcgcgctgccgtggccgacgccgtccgggagctcggccgcgtcgacgtgctcgtcaacaacgccggggtccacctcgtcgcgccgctcgccgaggtgcccatggaagagttccagcaggtgttcgacaccaatgtctatggtaggggtggaaatttttgctcccttttttttcttctttgttttaattgctgtctctcgtgcttgctggtatttggtgattgcgatgttctcgaagaagacgggattttagatcctgcgatcaggtggtccattaagtatgattagtaggcaattaaaatgtttgttcttgtatctatcgattggttgagtagtacaacggcagaaaagttgcaaatttaggattactttgtcaagacattttatcctgttagtgccagtactaatttaggaaaagtatgtaaaatcttctgtagtcacttgcagcactggattacttataagtttgcaactaggaaccctatgttagcaaggagatgcgttaatatttagtagatcacactgagctggttctagttgtgcaccacaatgaaaatccaaccaaaagaatagcttggtggcatgatatgtttagtaacatggggtttcattggcgaaattgcagtaccaatagttgaaagatgtattatacacttgcacactctaacactagtcagatcagtgctcccagggcacgcttcctgtcagttgcacaaattgacagtcaaagtgcagtgacgatgctgcgatgatgttgattgggaagcaactggaatgtggaattgactcattctctcattggatctgacaaattattttgtcccattaagtgtatgattcacaatagctcttaaaccaatgtaaaggtatttgaaaggagcatagcctgttaacctacaattaggctttccacgctgtttcatacgctgataaatagtcttcaaccggacgtaaatatatgtaattccaatgtaaaaatgtatgctggttgaactgctgagttattgtttcataatgctagaatgatgatggaggcgcaggggggaatagttatcaattaggctttccacattgtttcataatgcttgaatggttcatggcttcatgcttgtgcaacagcttgtttgagattacttacattgggcctgcacttatgaaaatgtctaaatgactgtcttttcatctacaggagcaatgaggctgattcatgctgttattccccaaatgatagaaagggaacaaggtacaatagtgaatgttggaagtataacagctttggctcctggaccatgggctggtgtatattcagcatcaaaagccgctcttcatgcattgagcgatacgctaaggtctgtacattcaaggagcactctatactatgctggtattattatgccacattgtttttctctccgtattactgctggtttatcactactctgagaacttgctaaattgtttgatcgtgcaacaaaatgcttttcaacagaagctataataagaaataaaaatgaataacgatacaatagtgtgagactattcgaaattcccatttgtttgttttccatgtcatcttcttgtatattcagttcttttcgacttgcaccgcatgatctgtggcttttgacgctgaaattatttttcacttttgacactgtcagttgacacgacagtttttatcactgcagactggagctaaaaagtttcggaattaatgttatgattgttgcacctggagggacaaagtcgaatctgggaagtaactctacatccaagtatgttcaaatacgtgactggaagtactacaaaaaattcgaggaatccctcagagccaggactgatgcttcccagggtcctggttctactccagcagaagacctcgcaaaaagggttgttgctttggttcttaagaagaatcctccagcctggtttgcttacggccagttcagtgctattctaagcttgttgtactatgcaccactatggtttagagattacttctataagattgtcatgaaatgctagaacttctgatgtcagtaagttcaaaggacaaagaggttgccactcagataacccgcaatacatacttgcatacagttttacagggaccattcattcaagcgaaaaggcccctcccagtgtatgccatcttttttcacctgtaataatagcggtgctagtttgttcatgtagtgccaaaggatggcaatctgaaatatgtggcctgaagaaactggtttccttgcaacctccactgttgacatggcctgcatcttcctgtctcaggaaatcaaatttcgacgcgcaaacgggtcgaacacttgtgatctgattgtttgaagtttgcattctactatgtctggcagcatctgctgtagttggggggcgtcaagtgcacacggtgaaactgaccagttgcgcatcattgttcagatcagagccaagctctgcaaatatctgacgatactgcaacagttcatttggagagtgataatgcttctcagttttaagtgggaaatgaattgttttggcaaaatattaccatgaaattcttattcttacattccaattggccttaaccttaacggccatttccggcaaatgtatttttttacaacagttttgcggtaatttcacgtaaagaaatcgagtccaacatgaaagaagaacgcaactgaactggaatacttgtcaaatcgctcaggattttactgcggggcggtctcacaccagcgacccgtccccacaaattacaagcagcgtcgtgggcaggatatagtccacgtggcgttcacctgcgcggaaaaatccgatggcgcgcgctcccattgggccggggacatatccaccctaactccccggggatttccccatcctgtggccgcggcgctccgcggcgccacgattaaatatcaactcgcccgccgtgaccgtctgctcgctcccgatcacaccgtccgccaccggaagagagagcccccctacgacgacgacgaccatggcgctcgccttcacctccgncacnncttcgcggccgtgctcaagacggccttcctcgggcgaagcgcgcgctcgccaatgccgtcggcgtcgcgggcgccaagcccgcgccgcgccgcgcgctcgtcgtgtcggccaagaagtcgtggatcccggccttcaagagcgacgccgagttcatcaacccgccgtggtcgatggctcgtaagttcttcttctcttttttcctcttcctcttcttcctcctcctcgcgccgcgcattgtgtttggctggctgacaacccgagcgcgtctcgtgtatggaacgggcaggctccccggtgacttcggcttcgacccgctggggctgggcaaggacccggcgttcctcaagtggtacagggaggcggagctgatccacgggcggtgggcgatggcggcggtgctggggatcttcgtcgggcaggcgtggagcggcgtgccgtggttcgaggccggcgcgcagccggaggccatcgcgcccttctccttcggctccctcctcgggacgcagctgctgctcatgggctgggtagagtccaagcggtgggtcgacttcttcaacccggactcgcaggcggtggagtgggccacgccgtggtcgcgcaccgccgagaacttctccaacgccaccggcgagcagggctaccccggcggcaagttcttcgacccgctcggcctcggcggcgagaccagggacggcgtctacatcccggacaccgacaagctcgaccggctcaagctcgccgagatcaagcacgcccgcctcgccatgctcgccatgctcatcttctacttcgaggccggccagggcaagacgccgctcggcgccctcggcctatgagcaatcaaccccgctctcgctcgccatggatctgacacacagagttgggtttcgcttgcatgcgcgcttcgtgtttgatcgctagctgttgcatcgatcgggcgcgtgcatgggctcggatcgaacgattggaggtcggaggagcagtagcaaaatgtatcttgttgtgttcgtggccgcttttgggttgggtggtgtgcgtgaaccaaatgggggaattaatcaaggagttatttttttttatttttcttcccagtgtatgtaccatatgtaatatatataattaaggctgcaggatgagcaaggatatttcattgatctcatggtgttcgtgccattcctttgtcatgtgcactctgtttggccgcttgcctgcatggcgaaattgcatcagctaaaggccgcattgctacgaaatatctcatccgctcttcgaggttcgaaatgaccatagtattttgtttcttccattgcgccgaaggaagaaacgtgctatagtagctctggcaaagataagtaggagcatatggtaagaactgaagaatactctctctgcaaactgaagaactccagagtacctgccactctttcttcaatggctgcatttgccttgaagcagatacaacatcgatactgcatttggtcgtaacatgagctgatttcaagtacaggagcagatcacattcccaatctcaaccattgcaatacctgccggtaccaaactccactctgcaaattagtgcaaactagatacctctgctctgcttggagctgtcatttttttcaatccaaaatggaagagaacgaaattaactaattaaacaggcataaataattaacaaaactccacgcctatctatatcagattatccggcactaatccgagctcgacccccagtgacagatgggactgtccgggaagtcgctcatgtccaccacttgcgcgacaccgaggagaccctccagcatgtcgtcgtcgtcgacatgcacggtctccggagcgacgctcccatccccgccggctccggccgccacgtccttcccctgctcgccgccgccgccgtcggtgtcggtcccctgcaggcagctgtagtagagcttcatcagctcgtcgatggagctgcggtccgcctccgggacgacgtcgatgtccgccggcagagagagctgcatctcctcgccgccgccgccgccgccgccgccgacctcgcgcttgcgcttgtcggcgtgcgactcgcgcggcgtcggcccctcgttgggttcgtcgtcgtcgtcgtcgagcggcgtgatgtggagggagcgcagcgcgtggcggctgagcgcctcctcctgggtgatgacgcgggaccaggtatcggcgtccctggcgctcatcttgtgctgaagccgcttggactgccacacgagcttgcgaatctggtcgaaccgcgggctcaggtgcttgatgacggcgctagctctgagcagggagatcttccacgccttcttgaggtcgtgcggcttccggtacggcggcgggccctggctggcctgcgcctcgccctgcaggccccaccacgcctcgccgccggtcggccaccacggcggcggcaggccgcggtcgagcgggaagctccgctgcggtggctcgcagtgctggatcagcgccgacagcagcgaccccagcgtgctgtcctggatgtcaaggagcccgtgcaggaacgacgccgccgccgcggggctccgcgggctcccccggccgcctcggcccgacagcgccgtcggccccgcccggtcgaatgcgacgtcgtccttccaccacccgcggaggctgtcggaggagccggacaccggcacgccggactcgtccacgatgccgtacacgaacccgcgcgcgttgcaggcctccatcatcttgagcatgtggcggagcacgccgtcctgcgcccggagcatccccttccgccggtaccgcgcctcgggcggctcctcctccgccgcctcctcctcccccctgacgacccggtggtcctgcgccgcaagggcgccttcgtggcccgaccggccctcgagcttcatgagcagcatctggtccttccacatccgcttcttcaggtcggcgatctcgatggactcggacccggactcggagtcactaaagaactcctcctgctccggcgccgcctcggcagcagcagcggcgtcagcagccttggctttgcctttgtcgtccatggcggcggttggccgtggcagcggctcgagagcaggaggtttctgtttctgtggataggcgaggctttccatgaggagagcttgctgtgtgaagcggaactcgtggaaaaggtggcacggaagggtggcgggaaaggttgcggcgtgcttacttatgtacgtgcagacgttccgggcggatcgaaggatgtggaagaagctaggcttggtaggtggatttgctgtggcacgcagcgccttggagcccgaagggacttgtagggagtagggacgggagcactgaccagcgaggcactcactgagtgcggagtagggtggtggtggaccggtggtgtacggtagcacccgtccgcaccgcacatgcttgtaggagaagaatacacacgcggctaagactaagaagcctaattttttatgcttttgtgctttcttgtgccacagcgcggacgcgataatttttctgctctctaggagaaggttgagggtaatgacgagccctgcacttatctttcaattattgttcttgtagtatttgtttatgatgttactgggcctgttcagcaggccggctacaacggctgcagctgcagctacacatattgagtgtggcactgttcacattagctatgggctgcggcgcagcagcagccccggctaccaaacaggcccactagtgatctttttcatgcaattatcactcttgctgttgtttcgaaaagaactatattcattcggttagggctaacgccgggggctactgtcaataatatggtccaggggtatcatgtttggagggaagaggccaccccgaaacccacatggcacttccccgagggggatcgggcccgatgtggagtgacggctgccccctcttcgcctgagggtattaaaacttgagggaggaggctgctcctagcacccacgtggcactcccccgaagagggtcgggcccggggtagggcggcggctgccccctccatgatt

SEQ ID NO: 48544 - DNA, 1232 bp, Oryza sativa
cagttcctcaactttcacccgctgtccccgaccaaactaacaaaagaggggcctcacggttccctgctcgaggagttcaccctccgacacatacgtacatatatcaatatggcgtaaaattcttttattttagatagaaagtaactttatatatatatagtttatatgtgtgtataaaaaatatttgcatataaattatatatatacctatatacaattttatatatgtgtaaatttatacgcatatgcatacttttgatgtatataaaagtttatatatacgtgtactacatatacatataccagcggttttatcgaatacgggatgctactgcagacataaaagggccggatcgcggaagggagttcgcgtgtttctgagttctgacgtagcacgatcgcacaggaccacgatgcggggggaggtgtgggcggctcgtggactcgagcgttttacctggatgcatgtacgccatttgtgacggcgccacactgccatgctgtatcatcctgtgctgctgacgtccgcaccgcgtacgcaattactcgctccgtccaaaaaagaagcgatccctgatccggatccccaatgtaagtttagtactaatgtgaaaagacgaaaatgcccttctgacaagatccaggagtagtatgccagaagcatctgatgcagagtaaaaaatgccaaacgcttcacgtgcacaaagcaaatactaaaaaaaaaaaatctctccagttgagaaaatactagtactagtagagcatgaacatcgcaagaaccatgatttgcctccaccactgcaagaatcaagaacgtatcaccgtcgcctccaccaccgccgacgccgcgtctcccagtcgcctccgccgacgacgacgacgtgtctcctggacgcctccgccgccaccgacgccgcgtctcctcgacgcctccgccgccgccgccgccgacgccgcgtctcctcgtcgcctccgccgccgacgacgacgcgtcttcccgtcgcctccgccgccgccaacgaagccgcgtctccccgttgccttcgccgagcgggaggtaggtgcagagggggtcgaaagcttggtgaggtctcgcatcttaccgccgccgcattgatgcagtcaatttgggaacgggagagaaacgcgagagaaagagagggacgcgagactggtagcgacgggcaggcgataagatttttgcggtgtgaatgtgaacgagaaaagaagtc

SEQ ID NO: 48545 - DNA, 1441 bp, Oryza sativa
caacatcaaactccagactccagagcacccatggttcacatatatactgtatactccagtacaagtatacacaacgacaggcctgtcggacactgatgtgtaaacagccgtgaggtctcgatgccgcatgtacatttcatatagagattatgccgacacaaaaacgatacatggaaatcaataagccagtcatggtgacattgaaggtgtgaatggagtgatgctgacatgttaccaactggagtgagcaccggatcgtccgaccgatccaacgctggtttcatcttattaccctcttaaaatcgtataattattttagcatcctcccctcaatgtaaaaaaaaggatcaatcactgcaatgcacgacagcacgagcagtcgagcagtagaccacatacgcgtaaggtacataattacacgggaatccaaagagaatctacgatttatttacagcacggtgaccctcggctcgtcggcgtcggcggcggcggcgtccttggccttgttgcagttgtcgacgacggcgtagaggcggtagggcgatgcgtcggtggcgagccactgctcgacggtgaagagctgctgcgcgcagccgaggtggggacccgtgacggtggcctcgaggtagttgcagtaccagccgtggtgcgggccggtgccgtcggaggtgaggttcatccggcacggcgcctggcgcatgcaggggccgcggccgctgaagatgtcgaggttgccgcgctcgtagtagtcgtggccgtcgcccatgaggccgccccaccgctccaggtcgcggatccgcaccccggagccgtcggcgcccagcagcgtcacgccgatcaccgagtccgtcccgcccttccagatcgtccccgtccgcacgtatatcgtgtacacgcacttgttctccgggtccgacgacgcctccgccaccgtgatcccctcagccgccgccgccgcgtcgtcgtccgtggccgccaacgcctgtacaacatgcatgacatacggcgccctatgacgatgagaaggggggtttcgcgtacctctatgttgttagggagcggacgggacttaccgcgacgacggcgaaggagacgatgagaaggcaggagagcttcgccatggccgagcttgctcgctccaacctcccaagtctcgaaggccctttcccgccgcggtcaatgggaaagtggtggtggagatcgggaggaggattttgcgaacgaggtaggagtagtaccataaggccataaggggaaccgggtggggcccacctgacagtgacactagctaggaggagcatcaggtggcatatccttttggatacatacagagaaaaaaaattttttatcccacccaacggggcaaggaaatcaaattttccggggttaagtgttacaagcccttgaggccaaatttactggacccttttttttttttttt

SEQ ID NO: 48546 - DNA, 2543 bp, Oryza sativa
ttcaatgctctatacttcttccgtctcataaaaaaactaatctagtattagatatgatatattctagtactatgaatatacatgtacatttgtacagatttataatattagaatgtatcatattcaattatatatttgtttttaatagaacggagggatcatataattatcatttggcgagggcgaagccggtctactactacatgttaatttggggtagttggcgaagacagtgacactaagcaggtgtcagacgagaaatagttggccaaatagtagtacataagctgataagcagtcaagaattcaagaagaaaagtttcttctatctaaaataaaagaattttgctgatttatttattgctatatccaatttatggaattgatacaccgtttaattgatatcatttagcaaaatgaaacatagcatatgcatccatctttcggctcgagaatttcacgggacggagatatggtatatagtggcaggacaaggcctcccaagcgtgttcaattgttgatatttttcagaacgacatcaccgtgtgtgtcatgcgttgtgctactggctccacctatgttccttttgcatctttgtttaggcctcgtttagttaaaaaaaaaagcctttccttcatcgcatcgaatgttcggacacatacatgaagtactaaatgtgaaaaaatatatatattacacagtttgcgtgtaaattgcgagacgaatcttttaagtctaattacgccataatttgataatatggtgctacaataaacatttgctaatgacagattaattaggcttaataaattcgtctcgcagtttcctggccgaatctgtaatttattttaatttattttattattagagtacttttaatactttaaatatgtatccgtatattcgatgtgataactaaacctaaaatttttttccaaataaacgaggtcttagtctgccgattggcaaatgaagttagctactccacactacatgattgagtaaatacgaaatgtggaacagtcaggcattcaagctcaaccggcttggatatacagtaacagcaacatattcttaagtttgttttaacagtattgacttttcccttgatcccatctgcttatgaaaagagcatttattcatgccacaaatggtacaatgccacgttgtcatcttctcctgtaagagcatccccagcagctcatccatatttaatcctctaaatacccatatggatagtcatcaaaaaaagattcctcattcatatccattcccactccaacaaatcatccatattacgtcattcatatcccaccctcctatattttaataatatcttccaactaaccttacttttacttttgtatttttaagggacatattttgaactactaaattttaacagtgttatttatcacgataatatttcgaaatgagtatattttaacggatacatttttaatggatagttttttaaattgatatatttgaattgagtgaagcattttttttggatatattcgtagcaacatccaaaaaaaaatgaacacaacaaaaataaacatctgtatatttccctttctctactcaggctgcacagtagtgaacatactactagaatttttttaaaaaataatacgattttaatagaaaatcgcaaaaatataggtcggttcgacgaaatcgtaaatttagcaccctgtcgaacaaccgtgtctcgatagaggtacttatcgaactatggcagttcgacatgtccctgtggaactgccatagttcgatagggtagttggtccaagggaaaaaataaaaaaaggacagtaacagtgcctggcaggacatatcgaacaagcaaacttcgatagggtggcatgtcgaacttggtctcagctacagtgtgctacagtgtttttcctctttttaaaaattattttatcatctgtcgaactgccggcaccctgtcgaactgcggttgttcgataggtccctgtcgaaccacggatattcgatagagtgccaaacttgcgatttcgtctaaccgacctatatttttgagattttcctttaaaatcgtattatttccaaaaaaaatcccatactctactactctttctgcaaaggcagcaggcgaggggcagcaccgggcgtgcggtggaggggcagcggcggccgggcggacgggcgaggggtggcgcgggcgtgtggccgggagggcgaagggcagcgggcgtgcggcggagggcggcggcggccgggcgggcggagggcggcggtgggtgtgtggccgagggtcggcgcgcggccaggccgacgggcgaggggcggcggcggacgaccggacgagggcgcagatgggcggggaggaggcagacggggggaggagaagctcgagggcgctgctgcgggtgtccgacggcgggagcgccgcagtggatcaggcgacggcaggaggacaacctgggcgcgggtggctgacggcgggagctcgtgctatggcgaaacctccagatctggtacgcctattcctccccaccttcactgct

SEQ ID NO: 48547 - DNA, 2900 bp, Oryza sativa
acccaccactttcatgccccgcgccacagggaagggagagggagaacgggaagaaagcatccgaccgaagagccgcatcgactgccaccgaagagctcaacagggacggtagcctcccgctccgtgccgccgccagggagcttgtcgaccctccctccagtttgcaccgccaatctccatcttcatcgctcgatccgcccatggcccaccaatggcggcgagatgcagggattggtaggcaaaatcagagaagagaagggagagccgcagccctcgacggagctcgcctcgacagcggcgcttcatcccttgtcagcatgagccaccgacggatccaccggattggagaccgaggggggggggggcgtggggcgaagctcgcggcggcgtaggcctgagccgctgtggggacctcgccagcctcaatccgtgctcgccgctgaggccctcctcgatccacgccgccagaagctcgaggtgggaaatgccgccgtcgctaagctcgatatccagccgtttccttgtcctgtcgttcgagcttgacgggaaaggcgacgacgggaccggagaagagagaggctggtgcggcgagaggagaggagcgacgaagagggagaggaagacatgagggaggagagggaggcgacggagagcgagaggagcttgaggtcgaggccgcgccaccgaggtcgatccggagccggcgggggaggcgacggagagggagaggacctcccgagattagcagctcggtgccaccaccgttccgccgccacgccaccgtcgtccacggcttccgcccctcgcggacctcgcacgtcgcccgctgccgtgccaccgactccgctgaactcgccgacctcacccgtccctcgctcccactccgctgaccccgccgctgcttcgggggaggagagaggggtggatctggcgagcaccgacgccttccttcgcctgctgactcagtctgctagtggggaatggattagaggagagagagagagggggggagttaagaagtaaaaaagatagtactagtgcacccatctattatctatctatctatcttctatcttctatctatctatctattatatactaaaagtccattaaacatcctacaaacgctctcaagccgctatatggcgctcctacaattgctcctaggccgccacgtggcacaatctaatctcaccgtcgattttcatttaaattgatggacccgttattttataccgttagattagatctatgctgttaattttcatttaaattggtggatccattattttttaaccaataaaccagatctatatataatacctttatgctatatgtaatgtttgcctgaaggaagaaaacatcacgataaagatgaaaacttcctcatgtttaacatacaggcgctactaccgtatgtatgagttcatacgtacgatacaaatacttccatacgtgcaaacgtacatgatctttcctaatcttgctggaaaaaaaatacacatgaacttaaaaaagatagaagaaacacacatccataaaaattaacggtctttaaaatatgatttttgataaaatatattaattcataaatataaatatatttagttaaataaagctctataataaatatccaatcaatgttctttaaaccatcttctaaatctatctattatatattaaaagtatattaaactttctacaaatgcttttgcactgctacgtgactctcaaataaattagagaaatcctaaaaatctattatatactaaaaatctatgaaacttactgcaaacgctcctacatattttcacgtggcgctctaatttagagtaatcctagaaatttagagtaaaaaaggaaaatcatccaaccttcaattttcacttaaattagtggacccatcattttaaacattagattagagctcttaaaattcctattgctaatctctataaaaaaaataacgtgcttatgtcgtacgatcatctccctaccggaaaaaaaacaaaatttaaatacctacaccatatatgatgaaaaaaagataaagccaaaaaataaaagaaaacataaacacgtacattgtagaatcggaaagaaatactaaaaaggaaaaatcatcgatgcctgcacagatttattgtgaacagcctttaatatacgattttaagattttcatccccaatctaatattatagtcccagtgtagatagaaattcctttatggtctaattctgagcggtagtaaataccaggacttagtaatatttgattgatcacaatttggtatattccatttattataaaggttgctaaggaattcattataggaatgcttccattggaaatggtttgcttttgcacatcgaaacaaaaaattaaacgtgtggatacgtataattcggaagaatagatgagtgattcatactcagcatccctttcttttatcgaaggttctagcaattgatatcgggattttaataggtgagtgattcatattcagcatccctttcctttatcgaaggttctagcaattgatatagggatttttatttagatctaagagacattcttatcacataaatagtatattaaaatctaccatctattttacagtaaatatatttatttttttattataggataatctaaattcccttacagtatatatatagtgatgtatgattccttatagtattttttttaataacaataagatgcccgtgtatttgtgcggaattcctttccgatttatattcaggaaatggtcttcaatttatattctatcgttatagtgtttgaaaaacaaactacaatacatacccgcgcggcgcgggctacctttctagttataaataacttgcactgtagagcatgtatgggtcttgtctagttgg

SEQ ID NO: 48548 - DNA, 2915 bp, Oryza sativa
tgccaatattggcttattgctgcatcaacgctcaaatctcgcactgctcgccatacaccgacgaccagctcggaccacctcaagaaaaatgacaggtgcaacagcatcacaattcaagaacaccctcaggcgcatgctcagcgctcctcctcgccgccggggcggctcttggcgcagacgctccgctcggcgtagagctggtaaggcggcgcgtcggtggcgagccactgctcgacgtcgaacgccgccttggcgcacccggcgtgggggcccgtggcggtgacctccacggacttgcagtaccacccgtggtgcgcgccggcgccgtcggaggtcaggttcatccggcacggcggggacggcaggcacggcgcgcgcccgctgaacacgtcgacgttgccgcgctcgtagtagtcgtgcccggcgcccatgagcccgccccaccgctccaggtccccgacggcgaagccgctgccgtccgccgccgcgagctccacgccgatcgccgcgtccgtgccggccttccagatccacccggtctccacgtacagcgtgtacacgcactcgttcttgtcgttgtccccgccggcgaccagctggccacggcgcggcagcgccgccacgccgtccggtgatttcgatccggcggcctgcgtacgtgcgcgtatgcaaaaacctggccagatcaactcacaggtcacagcagcgagacgaccagaaaagaaaatgcacgtaccaagaccaccatggaaacgagcgaggcgaaggcgaagcacaagaacttgtcagcagccattgtcaaaggcttgaagaactccctctatttggaatttttggattggatgcgcgctgctgtgagctaagctgaagaggttgatatataggcagtgccagatctaacagtgacttgttagattttcttatagagagaacagttcgtgcaggtgtatgccactctatattgaatgcatcttccaacattttttatgcttggattaggtgacaacaagttgaacgagacaattagcgatgtgagatgcgaaagattattccagaacagatcacaagcaggcctgtgacaatcatgtgacgcacaaggagagagtatgggaagtaaagtcaaacaaacgagtacatgatgagcatttttagacggatttaggacttgacgagtggtctaaaaacctgataaatcaggtacgtttattcaagaaaaacataaaacatttttttgccacctactacattattagtgcgcacattaccagcagccctggcttattatcacaactcaacactttgacagaacaagcacataactagaggacgtgctcagtgctcagctcagctctcctcctcggcggcggcggtggccgtgctgatcttgccgcagacgctccgctcggcgtaaagctggtacggcggcgcgtcggtggcgagccactgctggacgtcgaacgccgccctgttgcacctggcgtggggaccggcgacggtgacctcgacggacttgcagaaccacccgtggtgctcgccggcgccgttggagacgagcttcatgcggcagacgggggctcccaggcatggcccgcggccgctgaagatgtcgacgttgctccgctcgaagtagtcgtggccggccgccatgaggccgccccacgcctgcaggttcctgatgaggatgccgttgccggccgccgtgtagagctccacgccgatcgccgcgtcggtgccggccttccagatcgagcccgtctccacgtagagcgtgtacacgcactggttcgaccccgtcgagcccgggagcagcagcgcgcccgtgtcttcttccgacgttgctccggcggcctgcgcattcaaggttatatatggtgaagctgatcacgagatggactcataagcgagactcagaaaatgtagaacacgtaccaaagccgccatggaaatgagtgccgcaaagcagaggagcttatgcgccattgttgaaggcttgaagaagcagactgtctcgacctttatctgcactttttgagatgttatgtgcaccgacgatgatctacttcagctggctaatgaggcttcttatagacggagacaaaacggataggggaattggaaatgctaccgtaagattaaactagcatggtggcccgcgcagattgcgcggctagcatcattatattttctctcatataatagcatatatgttttctcattatattattcaaatatattaaaatgaaaacataattttaaattttgcaataactttacaaaactactaatgtgtaatattcatattatattttatatacgtgttagttattaattatttttaatatcaaattttagttatttgtaaattatatatattcctatatgtactctagacttgtcttttaattttttttaattccgaattttctgtaaattgtatttctatatagactctatgctcttcctctaatattatttatttttatttctaaattttcatattatattttatatacgtgttagttataattatttttaatgtcaaattttagttatttgtaaattatatatactcctatatgtactctagacttgtcttttaatacttcttttttttaattctgaattttctgtaaattgtatttctatatagactgtttgctcttctttcaatattatttatttttatttttgaattggtattattactaattgcatttatatgtggactctaaacttatctttcaatattctttaattttaatttcgaatttcagttacttctaaattggatttctatatttggattcctatattgaccttaaactcttcttcccatgttattcttaatttcgaatttcgaattttagttatttgtaaattggatttttatacatactctaaactctacttttaat

SEQ ID NO: 48549 - DNA, 1232 bp, Oryza sativa
cagcaatgaaaaaacacaagggtagtattgctatctaccctctatcctctctttcaaggatttttggagctgaccaagcaagttagccaaacactttcagaccacctacagctcctagtggagctagctcccactggagttggagtttggagttaggagtgagagctgtagctctaccaaacagggccttagtttgactcagtaaatactacggaaatggattaaaggggtttcaacaaaattgcatttcaggtcttttgaagttatcttgtttgatccaatccaaatccaaggtcaagttcattgaattgtcatgtaaaaaagtcaaaagcatttgcatgaaagtgcaaagatagttcctctattttaaaatatagcgatatctaaataagacacgatcttatactgcgaatttggataatatgttcgtgcttgtaaaaattatattgtgtctaatccaatactaaattgttgtattttggaaaggtgaaagtagatgatacttctgctgatttgcattgacaataccttgttctccgtcaaagctatggtagtacagtgtgatgtatggtgcgtcacctccaccaacatgctccttcactgtccatgtaacattgctgaaacccctgtgacacccttcagaaaaatgagataaaattagcttactgttcgtagagatgaaccatgcaccatggatttcttgcacctcgggaaatttctcaagaataccgtgaagtgtgtttttgccatcatttggatacagatgataagcttttccatcgagcacgaaccgcgccttggcaattctgttggctacccgtccgacgagcgctccaaagtaagtagaagaattctgaacagcagaattcagaaggcaaactgaagtgaggtaatttagcatttaccctttaaggtacttgaatacagtgaactcagagctgtcattttctttgatgggttacccagcttgcaattttttttttgaacggaaagcttgcaaatgaactactatgtaaaaaagattagttagaaacttttttgcccttctgaaagtaggtagactttgtcaaaaactcaattggtctgcataagattttgctcgtgcttgtgctgctctgttcatgtgattggattgtgatttgggatagtattatatgtagagagaagtgaaggttcagaaagaagaacagaacaaagaaaaaaaaagtatttatatggctattgccaaagtg

SEQ ID NO: 48550 - DNA, 1536 bp, Oryza sativa
  unsure (1)..(1536): unsure at all n locations
caaatagctttgagccactaaatggcttaaagctgtttactgcacccctaacccttatagtataattcccttgtactcccttgcattattctgcagttgcgggtgtgtcttgttaagtacggtggttgtactcagtcttgctcaatttttcccaaccccagaaaagagttccttgaaaataaaggctttggtgtctagctcgtgcctgccgtcaagcgcctgtggtcgtcgccctattcttccgctgtttcccgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacagaagtccaagaggatctgacctatgttgagaaaccaatccgtatcttggaaacaaatgagagaagaaccaggaatcgagttatctgtttttgtaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaatcataaatatataaattgttgtttaaatggaatttttagaatttattttaaaagcctagaagagaagatctagttttaattaataaattccaatataaaatggggccaaataaaattttattaaatactttgcttaattctataattcctagatttttctgggatttatttgacctaaggaagtatttttaataaatggaattgcatttaagaaataatttaaattgaaaaaggttttaaaagtcttcttttggctttgggccgaaagtcggcccaaaaccgctctctctctcctcggcccaagtcggcccagtccgcagccgcgcgcgccctcgctgtcgctgacaggtgggtcccgcttgtcaggttcgtcttccccgagccgccgtcgcccggccgaaaccctagcgcgccaccgccgccgttcctttccaaattcggccgctcctttccttctccggccgaatcaaaagaggggaaatgatcctcgggatctcctctaccttttcttctttggaagcttcggctagatcggttcggaaatcgatggattcgagttcgattcggatcggcctctttccttcaagccgcgagctttccttcgccgttgccgccgccgtgggccttcgccgccgcctccgagcccctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48551 - DNA, 1459 bp, Oryza sativa
atactctaatcttatttatgtaattcgtcgagttatcatatatcttacataatctctagcaatatcaccatctaacctattatcggctaacatctgttagcagagggcaactgattaggttagattttgacgtgatctagattatataagatatccaccattctatgaaacttctagcggcttgattgtctagatgtcgttcttcttttcatacttaatgatgtatcagttgagtttgatatattaagtcgtgcttagaatatcgatctctagcctaccttctagttgccgattagaatagtatcggagtttcagccgatcgtatctaatttaactatatttgttctatatgcttcattaatatgttaaatctgccctttatatcaagatattgctatatctaagcatgttaggcctctgttcgatatattatacctgctttaatatcctgatatagggaagtatcggagtattagccgatacatgctagatctatttgatcggctatgctataaagatatatagtcttgttattgatatatgtttcaatctaagtgatttatactgtctcggcatggcgaccgatctatcccaatcacttgatttaaatatatatcgatataaggagtatatatcgttaatatctacagccgatcgagtagatttagttctttcttacttattcacgactgccgatcgatacacagatgacatcggctcaaagataaatgatatgtcatcggcatctggccgatcggctatcatttatagatttaaccgcgatttctttgcttttatttcttgttgattacatgatcaaatcaactggcatgctaacacacccgaaggcgagctttgacctgcactggagttaagcagatctcccaggccacgtgttttctgtcaacaaccaggcatgatatttcataagtactataccatgctaacatcataataacgtcagctattttgtttggaacaatataccgttttgtagtatttctattatagaagtcgtggacttacgtcctgtgttcggatgaatcaataatgaggttgattatgcacttattttcctttctttcgaccttttgcatggttttattttaccatgttgtttagaaaaaagaacgttattgagctataatttactagcatcctggaaggcttcaattattaactattcaactgcacatttgctattcatctatgcactaaaatttgcccaaatttcagacaatcgttgattttttgtggattaagatgcaatggcatgcctatcgtcttccaccttttagaccgggggaggtgggagaagaggaatgggaagtaaaagatggatttaccagcaacagtgatggcgagcctcaatggtggtgacctttgaactccagcagagaaccgacgtactaaggtttcaaagttcgaagcaatgcgggggtgggggtgggggggggta

SEQ ID NO: 48552 - DNA, 3904 bp, Oryza sativa
cgaaacttcctagcagctttctcaaccaagccaagacagccactcggaacttccaggtcgttgtgagtcgctctcacaagcacctcatagcaggaaaaaatgaaaataacatgaagcctaacacaacgatcaacacaacatgtgtacaaagtggaaacatatcacaaaaacataaggtaaatcaatacacatgtggacatgccatagggaacaagagaatgagagacaatgagaaaggggaagaggaatgtggtggcggcggcacgagaaagaagagagaaaggtagatttggagagatttggcacgaatcttaaagccatcctatccgtccaaaaatcaattgacattttccaaaatttcagctgcttgtagcaagtccttcaaaccgtttattaagaacacgtccaaaggatggttctgagttctgacttgtgggagatagttttgcatgatgcggcggcggcaggcatcctacggcgcacgtgggtgacaactgacaagttcaaaatcttatcattggcccgtttcagtttctttttttcctttctttttgaagagctgtgcacagtttcaagagtggccacgcacgtactagcacacttgccaacttccccaatgacaaattgtcatcccactcgctcgcgggcggaccaccggattccggccgatcgagcatgcacaacctgcgaccaatgcaagcggaccgtgtacctggctccgtttcgctgcgacttgaggacacaaacggatgaaaggatcagatcaatcaaaaagatcacacgttagcacgcgcgcagcgcaggtgtctgtccgtaaccaggctggtccggtcccgcctcgaacaaactcgtccgagatcgcggccggtatccgcctatatctacatctatatcaggagaccatcgagaatgagttgcatgcatccctctcctctcgtcctgtgagttgcccaagacgaatcgctttgctcacaatggctggagctcggttgtctctcgcgttcctgtgctttgtggtggtggtggtggcctccgcgctcgccggcggcgccggtgcgaggaagacggtcggcgagtacgtgctcaggaagggggacttctccgtgaagatcaccaactggggagcaaccatgatgtcggtcgtcctccctgattccaaaggtaccgtcatgtcccctctgttgagctttttttctttatggcgtttgtgtacttgcgtgtgttggtctgaatttgcagtgcttgtgtttctgcagggaatttggctgatgttgtgcttggcctagacaccattgctgagtacgtggtaagaacaccaaaccccttccaaaatttaatgttttgggcaggaaatggcaatatcattcagcttcttcttttgccttcttctcatagtccattgaaacccaaacttgttctcgacagttaaggcctcagctattaatgaatggatgaatgaatcttatattctttaaatttccttttttttcccctgtacactatacacaagataaaagtacttgtctgatcaagaaattgcttgccctgcactcatttggaacttattccagatacagtgatgagaaaggtgtaaaaaggatgtataactgacaaaagatggtggaattttgaaaagagtaattttcacaaaactacaaatattttgattaaactatcgtaaaactatagatttaaggcgttataccacaaaactacagatttagcaccatatttatcacaaaactatagatttaaggttaagtatcacaaaactacatatttaatattgaagttgtcacgaaactacagcttttagagtttaaatccctagcaccattattatgctggagctataaatattattgttctgtgactaaattagttctaaaactgtagttttataataatttagttacttaacatgtagttttataatagttcattttaaatatgttgttttgtgataaatttggtgttgaatgtgtagttttgtgatacaccgagttaaatatatagttttgtgatagtttgatcatagtatatgtagttttgtgaaatttactctttagaaaattttaaatcacaaatgaaatacgattggaacaaaccctgacaaacatactccgtatcaaacagtatgcaataaattatgattctttgtctgcaagtgaccaagttactactagaagataaacaatgctcatcagcacaggcaaaacaacaaataccatatgacgtaatttcctctgaaaacaatcgtttgaccggggggatcgccttggcagtactcttcccttgtcatctgtcaacatgcaaagctgatgtaaatcccttttattattgtcattttccatatgtttcacactgtcacttagtccaactatgacgtggtcagagtatcatcccttcaatagaatcgagtctaagcaaaaaataaatagctaatcttcagaggttcagccagccagcaaaaatttcagaatgcttatctaaaaaccttgagcttgccagaaaacgatggtccgcatctccaaatcactgttccgttctacccttatccattttcttctcatcatctggaatatcattcaaacacacaagcagcttttgtttaccataccgaagaacggtctgaatcaatagacattaacatttgcgttatcactgtcgaaaatatggcaaaataattcaagttgtttttatctgtaatgatcttcttgctcatgccaaccagaacgacactaattacttcgggccggttaccggacgggtcgggcagaggatagccagggggcggttcgttctcgacgggaaggtgtatcacacgtacatcaacgacggcaggaacgcgattcacggtatgcattggtgcatggacgcatgccttcagacctcagatcagcctggccaacagattattaaattcactgaactcacattcaggtggacacagagggttcagcaaagtcatatggacggtgaaggagtacgtcggcggcggcgactcgccgtacatcaccttgtactaccgcagcttcgacggagagcaaggtgtgcaacgaaattccagatgaaagatcgagtttctcttttatgaaatttggagtcgtaaattaatttgtgaatggctatcgatcaggtttccccggggacctggacgcgtacgtgacgtaccagctgtcgagcccgtacgtgctggcgctgcgcatgaacgcgacggcgctgaacaaggcgacgccggtgaacttcctgcagcacacgtactggaacctcggcgggcagggccgcggcgacgtgctggggcacacgctgcagctgtcggcgtcgcggtacaccccgctggacgaggagctcctcccgtcgtcgggcgtcgtcgcgcccgtcgccggcacgccctacgacttccggcaccccaccccgatcggcgcgcgcatccggcaggtgatgggcgggcgcatcgccgggtacgacatcaactacgtgatcgacggcgagggcatgcggaaggtggccgcggcgcgggacggcgcgtcgggccgcgcgctggagctgtgggcgaaccagccggccatgcagctgtacaccggcaactggctgaacaacatcaagggcaagggcggcaaggtgtaccagcagtacggcgggttctgcctggagacgcaggggtacgtggacgccgtgaaccacccggagttcccctccatgacggtcaggcccggccaggtgtacaggcacgacatggccttcaagttttccttctagctctctagctgatcagtcaggatgatcgtgtggttgtagtataccatttttcaagattgtgcgaataattattggcgtgttgttgaaataaatgaagaaagggtcggttctcagcaatgggttcaatgaacaattatgtttg

SEQ ID NO: 48553 - DNA, 7632 bp, Oryza sativa
cacatacgcaggaggcagatgagaggcacgacgaacacgagaccggaatacggcggccaaaacaagcaaacatggtttaacttctctaaaggaaacggctggtgttcagcacactagacacgatattctcaggcacagagcgggtagaggagctggacggcgcacgcaccgcaggagcaggtaggcttctcgacccgaccggccgcgagtcgatctcggtcagttgttcggaggacggggtgcggtcttgggctcgccgtcgccgctttgggagggacgctcacggtcacggcctgattggtagtagaaggagtagtagcattgcccaccacagggctctgaaccacctgccctattaaaccctggtacagtgcaacatcagataggtagcagtcagaagctgtgctgctatgatatgttacgagagaatttttgtgccgacagtgctccctggaatctgcaagtaacggatgtgtaggagtgattacagcttattacctgggtgaaaatcctgaaagcctcttcaggggagttgtttctcagtatctcaaaagcctccctctgcagtggatgggggggtcaaactgtggtaagtgcacttcagaagataccaagcaatcaatactgctgctgaaaacgcggtaaagaaaaaactactaggagaacaaggcctaaagctcaatgtggaaagtatcctcgtatatgattcacttcttttcagttaatttggtccagcttattttcaatcttaagtggagtatcttttggtatctcttcaaggatggcaaaatccctctattattgatcacaaagtaccaacttggaaatcccacaccatatttagattgtgataaaatttggggcccatgtaactttgagttgtttgtggcatctgcttactgtatcctttattcagatttgctatgttgccatatatgttgtgtaaaattgaagtacctattgattggaactatataatggttaagaacactactattatacatattagtttccctttcgagcataggaatcacacaataatattataggattctcatatgaacagttcaattccagcgtcagtatggaaaaatcatccgttccaaagtgaaagaacattacttcaactaatctaacttgagtagaaaaaaaatatacgctatgtgctatcgcactagaaactgaacgagcacaaaaacgcaaaatgattgtgcctcattttttttttaaaaaaaaagggttcaaacaaagaaaaggcgcgaaaacttgtttgaaaaaaggcgcgaaatcgacatggtggaacaaacacaaaccatatgtagatgctaaatctgaacctagaagcacggcacaaaaactacaaattacaggtagtacatactaaaacagagcatagatatacccttgcacggtccatctcctcgctggagagagtaggcgcctccacaaccacatcgtcggcgaggttaatcaagtcatcaaaggagtcctgcctctggattgaatccattcttcttcaggagatcagagggacaacctgattgaagttttggagaagatgaacactgagcacacggtgagggacactgaggtggaggcccctccttttgtaggaggatgcaagacggtgcaaggagatgatgcatcctgggaagtgtgacacttgtcgtgtgagttggccgaaatttctactggtgttcatagccgtttgtaattttcttgcatccagggcgtcgtcacgcattagaggatagttgaatgccagagcacatgatacttagccacttgggtgaggtgtaaatgctaactgctagctagcctgctttggaagcttgttttgagttttgactgtttctgatgaacggatgggtgaagattgccagcaacaaacgggacatttgaacagcgcttttccaaccaagccattgtacaacaatcgttttgcaacatatacttatacagaagaaattctccaagaaaatctgttcgagaaaaaagaaaccggaaagagttaaaagcacaaatgttagccctgccccccagcgcatgcagcacgcccaccctgatcaggtgtcctgcacgtctcagccatcacacatatttggtacacacacgaacgtacgcatgcatgaatgtcacctcggatcctctcgtgcaaatctcccatgcacacgtccatgcatcgatcccacccttcacgccatgtagggggctagggtctttagaccttgaagccgaggaagtgcggcgtgccggtgaacttgagccaggtcccgccgtcgacgaacggcccggcggtgaactgctcggcctccttctggccgatgacgcggaaccccttccagttgacgcgcttgctggtgccggcgccggggccgcggttgttgaactcggcgtagtagagcgtgttgagcgcgaattcgccgttccatggcatgtagccctccggcttgatgaagtcggcgatggtgctctccatgatgacgaggcgggagtactccttccatgggcggccgaggtaggaggggatcttgaacctgtccgggaagagcttctggtcgggcacgaggcggcagttctggatgacgaggccggacttcatgttggggtcggtgcggccgtgcgccgtcaccgagttctgctggttgtccatggggcggcgggtgatgatgaggcagttctggaagacggcggcggagttgccgaagatgaagtcgatggtgccggagatgacgcagttgcggaagaactggcgccgggcgtgcacgtacagggtgtcctggaacgcgtcgaaccggcagttgtagaaggccccgaggtcgccgttgatgcgcagcgccaccgcctggtgccgctccgcgccggcggtgttgtggaaccccatgttcttgcagatgaacccggccgcctcgacggagaaggtggcggtcttcatggtggtgatgccgtcggcgaagctcttgcggccggtgacgcggctgcgcttgggcccgtcgccgtacatgaagatgttcaccttgtccttggggaccatgacgatctcgtcgtacaggccggccttcacgtagatgacgtaccggccctggtggcccttgggcatgctgttcacggcctcctggatggtcttgaactggccgctgccgtcctgggccaccaccgcgttgggctgcggccggttgcggtcgccggaggcgagcagcttcctgtcgggcgccttcatccacgacgggaagccgcccaccgtttcctgctccgcgatgaggctccggtgaatgggattctcacccttgaacatgtcgaggtcgggcttcttgaagatggcgccgagggtgttggtgatggcgagcgcgttgctgctgagctcgctggcgttgcgcagcacactgtgcatgtcggccttgagcttctcgtcggcgaacccgtcggcgcaggtgtccatgaatgtcatgacgccggtgagccagtgctcgaggtcgtcggagcggctgaacagcaccttgacgtcgccgccggccatctcgaccatgcccctgaggtcgtccacggagtcctccaggagggccttgcagtcctcgcgcgcgctctccgtcatgctgtcgctcgtctggcttcgccgatcgccttcgacttctccaccgcgacttgatcgactcgagcgccgacttggcgacggtagagaacacctccttggggttctcgtgccactggtggccgtggtgagcgtcttctcgcacgactccttgtacagcgtgggcgcgcacagggactcgacggacttgccggaggtggcgaggttggcctcccccgggacggtgaagttgtccccggccttgttgccggagcgggtgacggtggcgaccaccccgacgacgaccgcgacgacgaggatcgcgcccacgcccccgaggagaaacttctgcgccatcttggcccgcaaggttggagtggaaccgcagggacgctcaatttatagggtggtcgactcgagaatggccgtgcatgcagtttggctacgcacgtacgggcgtggatggtttgaccgttgttgtggtctatcgtgttctgtggttatcatttgacgtacagaagagcagtgtctatttctggtctttggcctggtcaatgcattgttatctttgttttgcaattgaccattgtcaggctcttttctaacaaggaaatcttaaagacctaattcagggactaagatcttgcatcctgttgggtcgcgtggcgtcctagaaattaggcaaagccctctccaaaaactgccacgtgtccaaggagatacagtgtactatatcccgtgaatgctctacgagggaagaaaatcaagtatattagctggcccctgaattctctaaaaaagtaaagaggttaccttagagaagatgaagaggtaacttttgtatactcaagaaaggtgaccatttagtatcccatccaaacatagggcagtaaaaaaggagaaggtcactactcctaaacatgcacgtcaattaatccccagctaacgatatctccatcgctcggttagattcaccatcagcaccatcgctatctatttctcgcccaaatccatcagccatcgtcatccacttccaccaccggtgctatcgcttgcccaaatccgccgtcgccaccaatgccatcgttgtcatctaccaccactgctgctctaatccaccgccaactccaccagcagctcgcgccttcctccatcgtgtcgccgcaccagtgctggtgcccaccgtagttgtcctcaagtcctgaattttcagatgggcaaagcaagataggttcatttttcctcaattctctcagatccaaactcttctctcctcttccgttctcttctcacgtaatagtgaaaatcgttccccttctaatcctctattttgttaagctacttaatcatttggatggatttctttaaaaagtatgtgagttgtcaaatgtgaatattcatagtaaataagtgcggtctctttagataatcattttgagcatatagcatatatgattcataatttaaaattcacaacttcctatagcttttttagtaaatcaacatacaagaattatttattggtaaacaggaaggtgggaagacaatggaaaatagtataaaggaaacatcaaaacaataaggccaatttaaggaagttaaatgccattaataaataatatgtaaaattattacttataaatatacaatgcatttactccctccgtttcaaaatatagggcgcaactactttttaaaggtgtttcataatataaagcgtgcatgtatgcatgacaattaatagcaaattctctcacctagattattaatttttaaatcaagatgcttaattctattgggtgcatgtatagtattagttgggattattcaaacaaagaggtgataataattatttcttggtctttgggtctaaggtggttgtgccttatattttggaatggagggagtactaatcaccaataattatgttatgctgggtgcgttgtgtatttatatatgatacactacaatcaactaggatataatatgcatcatttataccagggcaatgcaacgatggaaatcaactaaataggaatataaattgacgtcccaagatcttggtacaacacccttgtgaaaatccaatgttcttgtgaaggagtggtctctgggcgggtgtcaagtgtgtatatattggtcaaaacgacccttcatagggagttaaattgcattggtttcaatagttcggtgagtcgtcctattcagttttgcggttgagggtcatgtattagattcgggtcacttttaagggagtcaatgtggacttattccctttttaaaagattttgcccaggattgtctagtcatggaattacaggtgcaggccacatcatatgggctgtactatctatgaaggccaggtatcacctcacgtcctcatcctcggccgcgggcccacagcctctcgaagccttgaacttgccttgctcaattggagatcagagagagatggcggcggcgagccggcgaccggtggccgcagatctgacagggtcccaatcatcggcgagggcgcgaggcctcggtgccgctcctcctcaactgccccgtatttggaggtgaagcttatccttcttgatttcatgttttagcttcatctagtgtagttcgtctctgatccgtggacggatcgacgcaaagcgttgttgccaattctcgtcagtttgtagtggcgaggaaatcaaacatgggaaaaaaaccgggattcttgtgaacatctaaaattgccagagccgccattagtgccaaaacacatccggcataatcctgatcggttacaggaagaagaaaacagttgtacccaagcacatcatctgaccacccgcacagcaccatgacgattactggcctcgcccacttctgtacacccggaacctaggccctgaactgatacgatcagccgtggtgtagctgcagctgcagcagccgcgagtaggcgccgtcgggccgcgacacgagctcgccgtggctgccctgctcgacgacgcgcccgtcctgcaccacggcgatcgagtcgacgccgcggatggtcgacagccggtgcgccaccagcaccgcggtccggcccttcatgatccgctcgagcgcctcctgcagcacgcactcggactccgcgtccagcgcgctcgtcgcctcgtcgaggaggagcacggcggggtccttgagcacggcgcgcgcgatggcgatccgctgcttctgcccgcccgagagctgcaccccgcgctcgccgacgggggtcttgtagccctccgggagcgcgctgacgaagccgtgcatgttggccaccttggcggcctcgatcacctcctcctccgtcgcgccgtccttgccgtaggcgatgttctcaaagatgctggtggcgaacagcacgggctcctgctgcaccaggccgatcttgagacgcagcgacctcacgttcagccgccggatgtccttgccgtcgatcatgaccttcccggcgagagggtcgtagaaacgctcgatgagagcgatgacggtgctcttccctgacccgctcgctccaacgagcgcctgactctgcccagctcggatcctgaggctgaaatccttgaagaccatgacgtcagggcgcgacgggtaggcgaagtcgacgtgccggaagtcgatgtcgccacggacggactcgacgggctcggtttccggttcatccgggtcaatgcgcgtcctgtagttgaggatggcaaagacggaccggatggactcgccgccacgcacgatctccggagcgaggctgacggtctcggcgacggtgttcgccgtgatgacgagcacgacgaagaccttgatgaccttggagaaggtggacacgtggtgtcggacgaggtgcgcgccgtaccagaggatgagcgcctcggaggcgtacagcgacagctgcgacaggccgaagagcgcgccggagatctggctccggcggaggctgtgcatctgcgggacgcgcagctcggtgcagaagagggacaggaccttgtcctgcgcgttgaacgcagccacggtgcggatgttgctgacgccctcccggcgatcatgctcgtcttggcgtg

SEQ ID NO: 48554 - DNA, 4230 bp, Oryza sativa
caagtgacagagagaatggggttcgttcatgcaccacgcaatcctttacgaatcgccagagggacatcattgcacgcaaggaatcatgaggggctctgcaatgcagctggaacacgatcaaaaaatatatggcttggcatggcattctggggcgacactgtcctcgcggaacgtacgccacgccatgcgaccacggcaacacgacactgcctgcctgccctgcaactgcaagatcgccatgtgcggcactgcggattgcgaagccccagattcccgtgcacaaggcggccgtgcaatgcagacagtgtcgcgaacaacgggaccaccagggggacgagcggcaagaaaccaaaaacaaccctaccactgggggcagctaatgagcagcaggaaagaaagacgacagattggggcagttggccatgctattgctttgcttcctcccagtctcagaaacacgaaagccattaggcatcagaggaacggaggaagcaagcatctgttgcgataaatagcgcacgtcctggagctttacttgccgttgttaacgccgagttctatgattagcacggccgctttgcctttgcagagaggaggccaaggagcatcttggcagggttgcacatgccgcgcacagtaatttatggcagctgcggcggcagaagcagtggcagtggcatgggccacggatcctaccatagcaatgctgatggatttaatctggcatcctatctccggagggagtaattgagcagcaaacggttgtctgcgccgaaaacggcgtcgcaacggtgcagtgagctcagtgagttcgtcgtgcaaagtactattcggtttaatgtgaaagggtaattctcctattccaccaaagattcctagcacgttgtctaatccaggttagaacgtaaaaggcacataatagaatgacacctccatgttaacgaaaatattgtgagttgagagttgttttacctgggcaaagttggcaaggacaaggagagggaaggtgacaagaatgaggacggccacccgccattcgatgatgaagcccacaacgaaggacacgagaagtgaggtcatgttctgcaggatgactgatatccgttccgctatggccgacttcacatcggctgcgtctgtggaaaggcgtgccgccacgaggcttgaattgttctcctcttgatcaaaccaccccacatcattcctcaagatagctgaaaatagtctctgatcaaacaatgcaactggtgaaatttgaacagtttaagagcaacctatcgattcataccagcaagcatcatcctccgcaccctggtggtcagattttcgcccatgatgctgaagaagtaatgttgaacgaggtacgcgacaaccgcatataacccagttccaatgtagataaacacatactccctagtcttcctctccattgcattcgggtcccggaaatagaacacttcaatcatgttgctcatcacaatagcaaatgtagggccgatgaagccagataggatggacccgatggctcccagtatggtatagggccactcgggtgcatttagcttaaggagtttgaaaaaataacccttaggtgctgggtacttccggtcattgtcggcattggaaaccatttcaatacggccatctgcaccagtgctgtatgagtagctcaagttcctcaagctccccgacctaaggctcaatgaccgagtggacagcgaattgctcaagcgggatgaccgggacttgcgggtggatgggccacggaagtcacggtttctggccatctcctggaatctaatgagagcagcataagctcctgagcttcctttcgcaaggagctcgtcatgggtaccggtctcaacaacctgcccttgctggatcacagcaatcatgtcaacgcaccgtatagttgacagcctatgcgcgaccacgacagttgtcctaccgaccatcaggcggtcaagggcttcttgaacaatattctccgaaccagcatcaagtgcactagtcgcctcatctaagagaaggatcttcgggttctttagcattgcacgagcaatggcaatacgttgcttctgaccgccagagagttgaagtcctctctccccgacctgtgttataaatatagtggattaatcattggatggagcaaatttgtatatgcaaagttgcaagatcaatatagtaatgcaatagttagccaaaccagaagaaaattgtactgctaaccaaaatatcggtctttaagtagtacaaatatcattggcataccaacagacaaagaacccacctgagtgttatagccattaggaagaagagcaatgaagctatgggcattggcagatgtagccgcagcctcaacctcagccattgtggcatcaggcttgccgtaaagaatattttcaagaatggtggtagcaaagagtgcaggttcttgattcaccaaaccaatctgatctctcagccacttcaattgtagtgtcttgatgtccacattgtccagcaaaacttgacctgcaaaaaatagcaatcagcaattaaccaaatggttgggataacaatcaacatcaggtgtgccgtgtggatttcatctgcttaccctgattaggatcgtaaaatctttcaatcagagccacaactgtactctttccagacccactacctccaacaacagctgcagttttaccggcaggaaagaagagggaaaagtcacggaatatcatgacatccggacgggacggataactaaaggccacttccttaaactctatgttgccatggacttcatccaggcaccttccatctgctgggtcctgaacaattgtcggcctctgccttatcacctccaacagcttgtatccggcaatctttcctttactgaaagcgcctagattcgagaacgattgtcccaaactcctgaaatcatcagatccacatacacatatcaatcatatatttttatcggaaacattaaaggtacagaattgtacagaaaatgaaagttcagtactcacaggccgccgacaattgcagagaaaatcgcggtgaatgcctttccaccatcggtctggccattccggatgaacactcctgcgtaccagaacaccagcgcccaggacatgcaggcgataccgtaagtgcagccaatgccaagacccttggccatccctgctttgtaccccagcttcaatgtgttctgaatcgcctccgagtacgagttgagggccttggactcccccacataggaatacactgtcctgacttgggcaatcgcctgttcaacagtcacacttgatcatcaaaattactcgcatatttgcacaataaaggagaaagatatcattttatcctacatttatggttgacattgaaaaaagtacatgggtaacgagacctatctatcaagaaacctctatttttcctgttcttgaggaggtaccatgttaatcactcatcaagaaaagggcaaaacgacatcaaacaagaaatcatcttatccaaaaggttgattggatctaataagaagctaaaaggaatacaaaatggcatcattttgatagcatgtgctacactttgaccggcacgggctacggggctagaccgctagagcccactgctcctcttccccacgccttgtgaggcatcttggtttccctgaatgaaaatgggtatccagaaacagtaggatgagagtgatgctacctgctcggctatgattccggcgttggcgtaggagtcccggctcttggacgtgaggccggtgagcgtgtaggcgtacagcccgccggcgaaggcgatgcccgggatgacggcgatgctgagcagcgcgagccgccaggcggagacgaacccgacgacgagacccgccaggaacgtcgataggtagtggatgaagttgccgacctgcaccgacgaaccgtcccaatcaggtcattggccacgcccgggaggtggccggagcccaagagagcgacgagtttaagaagctggtcaccttctcgccgatggcgtcctggacaaggagggtgtccgtggagacgctgaagacgacgtcgccggtgcgcgcgtcggtgtcgaagaaccccacgtcctgccgcagcacggcctccaggtatcgccgccgcagcgcgcccacctggcgctccccggtgtacatccagcaagcgatctctgcacacaaggacacacgcggtgagtgaggccggccacattaacgacatcaccggc

SEQ ID NO: 48555 - DNA, 1300 bp, Oryza sativa
cgcgaagcatatcttctaggatctgatttagacgctcggtctgtccatctgtctgcgggtgatacgcggtgctgaaatttaatcgggtatccatctcttcttggagcttcttccaaaagtgagaggtgaattggcttcccctatcggatacaattttcttaggaacgccatggagactcacgatcctagcgaagtagagctcggctagtttgttccctccataggtggtcttcacaggaataaaccgagctaccttggttaatcgatccacaactacccatatagaatcatatccaccttgggtttttggaagtccggtgatgaaatccatcccaatttcatcccatttccattcaggtacttggagaggttggagaagtccggctggtcgttggtgctctgccttgacacgctggcaaacatcacaaagggccacgaactctgcaatttcccgcttcatactaacccaccagtatttctccttcaagtctaagtacatcttcgtgctgccagggtggatggaataaggactttcgtgagcttcctgaagtatcaactgtttaagttctctgttatctggaacgcatacccgatttccgttccatagggttccgtgttcatcctctgtgaaaccagcggctttaccctgtttcatattcttgaggagcccatgcatgtctggatcattcttctgagcctcgcggatttgatcgagcaaggtgggcttggcttccagcgcagccaaaaatccgcgactaactatgcttaggttcagggcttccatctgttgattaagttcgggtggaatgccacggacgttaagagtgttgcaatggcctttttgacttagagcgtcggcgaccacgttggccttaccaggatgatagtgaattcccacatcataatccttgatgagttctaaccatctcctttgccgaagattcagatccgactgggtgaagatgtatttcaaactcttatgatcagtatatatttcatagcgattcccaatgagataatgccgccagatttttagagcatgaaccaccgcggctaactccaaatcatgggtagggtagttgccttcatgaggccgtagctggcgtaaggcataggccaccacatgaccttcctgcatgagcacgcaccccaatccttggcgcgaagcgtcacaatacaccatgaagtccttgcgagtatccggcaagattaacactggcgaggaaaccagcttttcttgaacgccttctcgcattgcgggctccacacaaatttctcttctttcttcaacaactgtgtc

SEQ ID NO: 48556 - DNA, 5704 bp, Oryza sativa
cctgcagccccggtcactgtttcggggtccacagcaactcctttagcagatatcacgtgccctaagaatttgacttcggacaaccagaactcacacttgctaagtttggcatacaattgatgttcccgcaactttcccaataccagacggagatggtgctgatggtcttcctctgattgtgagtataccagaatgtcatcaatgaataccaccacaaacttatccaagtattccatgaacactttgttcattaagttcatgaagaaggcaggagcattggttaaaccgaacgacatcaccgtgaattcatgcagtccgtatcgcgtggtgaatgcggtcttcggaatatcttcttcacggatgcgcaactggtgatatccggaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatgtaccccttttctttcaactcttccaactgtttcttaacttcggccagttcatttgctgccatacggtagggtcgcttgtacagaggagtggttcctggagcaagatctatccagaactcaatctctcgcttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgaggagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacatggttcacacgaccctgaatgacatccttaccaccgttgttggggcggggaggcgcttggccttgctgacgccttggcttcgggcatttatccgcaaagtgcccgggctcgaagcagttgaagcacagacgctgcggacctgaagcgtccctgcggccttgaccaggctgcacagttggcgtaggaggacggggcgctcgagtcccttgttgattctgttgctgctgcggctgtgggacgcgcaccacgaattgaggtcggggcgcggagcgaggttgctgctgctgtggttgctgctgcgaggaggatccccctggatagggattggtgtagcggaccctttggttagcaccctgttggttgcggaaattctccaagtggcacttgtgcgactccagttccttgtgcttggcttccaagcggatgctcttgtccaccagacgttggaagtccggatagtccccggagactagacgcacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagggccacgactccggcgggcacatgggttctccggaaagcggcggtaaaacgggcccaagtaataggctgcccctctggctgcgtagcctggaaatggtcccaccatagagatgcgggtccctgcagttggtgggcggcgaagatgactttctcctcatcgctgcactgcacagtgtctaactttttccccacggcatgcaaccaatccaacgcatccacggggttgttggagctagagaaggtaggtgggcggatgcggagaaactcggcgagtttagagtgttgtgggggtggtggtggagcattatgttgtggcggattttggatgtggtggaggagagcagtcatcatgttggcctgctgggcgaggatttgggtgagaatggcgttggtgtctggtggtggtggtagaggcggaggaggaggtggaggtggactgccctggttgttgtggttgctgccttcggggtgactgccttcaccgtagcagcacttctcctggtcgtcaccatctgaaaaccccacacagaaccagcaaacagagagagctgacaattaaaactagccacccacgactaccataatttttgaatttattactgctattaaattggttcattaaagttcaagttgcttaggcaaataaaataaagacaggctccgacacagttataccacacaccggcataaccatgccccacacgactccaacaagaagacaaacgagaaagaacacacgcgcaagcctactaactgctcgtctaccgctgcgacgggccaggacagaaggtgagcagcagcgcatcctccgtgctaccaacgccggaggcttccccctcctgaggagccatgggcgcgggctcggcacgaggggtctccacgaagcaggtccatgccaaggactggcgaacaagctcgggcctggaggtgctcttgcgggcggtgatcttctggctgcggcagacgcggcggcgcttggggcgacagacctctccctgggcgatcttgagctgatgcagctgcgcctctgctgcgtctaggtccttcttcagctgcagattctcctaacgcagctccaggatcttcatgttgttctcgaccatcccacggcgcaccatctgatggaagtcgatacgagccgcgtcgtacgcctccaccatgcgcgccaggtgcatgatggtagcgtcatcctccgagctagcatcccggaaggtggcgtagtcgcgggctcctccgcggcgagggtggtagcggtagggcgagtgctgcaactcgtccgggtagcgctggtgaagagtgccgatggcgaggagagcggcgttctggcaagcggcggagaaagaatctccacccgtggtgactgccaacgaagtcctctcgggtgagccagtgaggatcactgcagtaacctcccaagcagcgtggggctctgcatcgtcaccctcctgctccgggagctgcctgccctggtagtccactccatgcgcataccccaggacaacgcacatgccccgcagctccaaaacaaagccagtcaggtccagaccacgacggttgatgctgccggccatctacaaacaaaaacaaaaagaaatgcaacattttaaaggtcagattttggcgataaatgaagcagcaggacagagagagactagaggattttcacaaataacaaaggattttttttttcgaaaatattgctaaggcttgggatctaaggctagtcctatggtcaagggggctctgataccaacttgtcacgaccggaaataacccaacgggcgttccttacgtgcgtgcattattccttgtcccaggaggcaaggttcaccaaaagttgatacaattcagagtttaacaagcggaagcgtaattaatttattacatgggcggcgaagacccagcacacaagaagacaaacgaaaaacagcggaagactagggcgacaaccacaggcacttgacggcaggcacgagctagacaccaaagccttcatcttccaggaactcctcttctgggtttgggaaaaattgagcaagactgagtacaaccaccgtactcaacaagacacacccacaagtgcagaataaatgtaagggagtacaagggagccataatatagggggttagggtttgcagtaaacagcattaaaagacacttagttgctcaaagctattttgtaaacacggtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccccagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaatccaattccacaataaccagaccattccaaagtatccaggtgatatgaatatatcccaaagtctatagttgaaaaaccacctaatgttacctaattaaattgcgaagcatctacctaaaattaaactagtggtgccatgagtagagtgtccactagttgaggttttgtttattctagggtgaacaaggtaataataacaataacaataataataaggtcataacaaaggtaaataggcatggctagataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccacataacagcagaaacaaagcacaaaaataggttcttggcttcataagaaaaaattagagacttgaacggtccaattccgagttcaaatggccaagttatggccatttgaagtttatatgctctttaaatggatatttgcgaatttcttcatttaaattttaattaaaaatcggatttattgcgtcagccgggagagagggcgcgcggaccgggtccacgggagtggggcccacgcggcagcctcacggtccacggtggaccgggtgcacgcggcttacgccggccggcgccgtgggtcccacgcgtcagccgcacccgagggcgcgggcggctgacggccgggcccacctggcagccgcggggcgcgcccgaaggcggcctcgcggcacggccgacgggagggggcgcgcccgcgccctatggtccgggcggcggccataggcacgg

SEQ ID NO: 48557 - DNA, 2840 bp, Oryza sativa
tcgtatgcctccaccatgcgcgccaagtgcacgatggtagcgtcatcctccgagctagcgtcccggaaggtggcgtggtcgcgggctcctccgcgacgagggtggtagcagtagggcgagtgctgcaactcgtccgggtagcgctggtgaagagtgccgatggcgaggagagcggcgctctggcaggcggcggggaaggagtctccacccgcggtgactgtcagcgaagtccgctcgggagagccagcgaggatcactgcagtgacctcccaagcagcgtggggctccgcatcgtcaccctcctgctccggaagcggcctggcctggtagtccactccatgtggataccccaggaccacgcacatgccccgcagctccaagacgaaaccagtcatgtccaaaccacgacgggtgacgctgccggccatctacaaacaaaaacaaaaagaaaagcaacattttaaaggtcagattttggcgataaatgaagcagcaagacagagagagactagagggttttcacaaataagaaggggtttttatttcgaaaatattgctaaggcttgggatctacggctcgtcctagggtcaagggggctttgataccaacttgtcacgaccggaaataacccaacgggcattccttacgtgcgtgcattaatccttgtcccaggaggcaaggtacaccaaaagttgatacaattcagagtttaacaagcggaagcgtaaatagataattattacatgggcagcgaaggcccagcacacacacaaagaccaacgagaaacagcggaagactagggcgacgaccacaggcacttgacggcaggcacgagctagacaccgaagccttcatcttccaggaactcctcttctggggttgggaaaaattgagcaagactgagtacaaccaccgtactcaacaagacacacccacaagtgcagaattaatgcaaggtagtacatagaggttatactgtgagggttagggttgcaggaatcagcatttaaagacatttagttgctcagggctattttgcatacacgattctagaactaaacaatattatttatcaaggccgtgaacccacacgaacctgccttaacccaaggcctacgatgagtcagaccgaactggcaacccgaccctgggtcccagctcgtcccaagccaacccaggccaacaattccacatttagttgttaagcaggttttaagattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaaaagaggggaggtgtgaatccaattccacagaaatccaacaattccagtgtgtccaggtgatgagaatattcccaaagtctagagttgtaaaatcacctaatgttacctaattaaacagcgaagcatctacctaaaatcatactagtggtaccatgagtagagtgtccactagttggggttttgtttaatctagggtgaacaaggtaataataacaataacaataataataaggtcataacaaaggtaaataggcatggctagataaaacagtgatagcgcgggaatttaaataaagcgataatgcaataatttaaagcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggattttactctaataaactccatataaccagtaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaatggatttattgcgtcagccgaggagaggggcgcgcggaccgggtccacgggggtggggcccacgcggcagccccacggtccacggtggaccgggcgcacccgggctcacaccggccggcgccgtgggtcccacgcgtcagccgcacctaagggcgcgggcggctgacagccgggccccacgcggcagccgctcggtgcgcccgaaggcgaccacgccggtgcggccggcgggaggcggcgcgcccgcgcccctatggtcgccggcggcggccataggcacggcggagcggcggccgggagaggggtgtcgcgtcccaaatcgactctaaaatacatcctcaaaattatgccgagaataattaaaatccatgtgaaagcctccaacaattaaatatgcaaatttaaagtcaa

SEQ ID NO: 48558 - DNA, 5532 bp, Oryza sativa
gaggtggatgatagtgacattgcagcgacaacgaagtaggcaggagatgaaggaggagcatgggtgggccgtccgcggaggaccgtggttatgggcgtcgttccacgcagagtctgcaacgttgacggtgcagcgtctgcgaagctcggaggtgggccaggcatggcaagatagcgtcaggaggagctctcgccggcgtgggaaggaggagctcaccggtggcgacaaatgaggcgtacggacaacacgtcaggcgacatgtggcttcggagggacgagtggcacggaatgaaacaactcgcgtcctcggtggcatattcagaaagtgtcatgaattaagtggcaaacctagatggtgcgaatccaatgacatattctaaaaattctccacatttcaaatagagggggagaagggatttccttggagagcgagtagattgccacgctggcaagcaacatgtgctattaaaaaagacgtgaatattagggaatgacctaatatcaaataattaggagtgaggttttgaacccaggtcgtctagcgcaccacctcgtggagctagccggaagacccctgtgtgtttcttgcctcatgtgttatttaaaccataaatgcaacagtgctgtggggagttttcaacacttgagctagatgggagcagccaatgttggatttttcaacacttgatttcgattgaaaaagacaagtgaactaggacctactccatgattcaaaagttataaaagagggatatgtattttcatcactcgagatgacattccctcgttatttgtatgccatctaaatagttattaaaaattttgaaaaaaaataataacatagattaatataaaatatatcactccacgaacatacaagaccagattcaacttctacatgctgcaacaaaaagaacaaattaaatggacaatagttgtcgtacattcgcaactatatttgttattttcgttacaacttgtagaagttgaattcaaacttgtatatttgtggagtgatatatttcatatcaatctatgctgccaatttttttcaaaatattttatgactatttagatggcatggacgaaacgaggggatatctcctcgagcgatgaaatcacttttcccagcagatggacaaaagtgcaattacacatggcgctaatgcgcgaccagtcggggcgcgcgcggcacctcagctggtactaatactacctgtactactacttgcagtactaatactaccattactgttactactaggactactactagtagtagtatgtattactactactaatctacatacgtatatatatatatatatatatatatatatatatatatgtatataaactttacatacgtgtatataaactttgcatactcgtatataaattttatatacatgtataaaaattagtatatgtacgtataaaaatccagaaaatacatgtatataaagttttataggcgtacccggagtgtaaaaaaccagaaagaaaaaaaaaaaccggaacagaaaaataaaacagaacagaaaaccacaaaaaaagggaaaagaaaaaaaacgcattagcaatttcgattacacaatcgtgaaacatcaatctcaatctcgatcagtcacttaggtttgttcgttgagatttgctactgtccagcgcttggtaccccaagataccagtaccaccaggtactagatcaaatctagccatccaatgtttaggggtaggattgggaatgagtaaaaatctcttccaatattgaatcaattaatcttgttcctgagttcttcgtcaaaatggaaaaattctcattcttgaacaccgccgcatgcttgtgtccattgtttcctccctcatatgcgtgtctttgcagttcttccttgcggccggcgccgccgcctggtccgacgactcgccgccgctgccgtggtgcttgatccgacaactccacgaccaattcgctgcctcggctgccaacacccccgccgttgccgtggcacctggtccgacctctccacggccacctcgccatcgcggccggcaacgccccaaccgccaccgcagccgcctgccatggccgtcgacgccaagactggatctcgcagagtcgcaggccacacatgccacacaccgccgcggatcccgcagccctgccgtcgacgctgggatcggatctcacagcacgtcgtcgccgacgctagccctgtgatgctcgccaccgcccgaccaccgtcgaagctagggctggatctcgcaggctgcacgccacctcaaacccttgaaccccacaggccgcagctcgccgccaccgccatcaacgccggccccagacctcgccgtccgttgatgccaccgtcgatgctgaccccgcggcgcacctcgctgcctaccgccgctatcgacatcgggtctggaacccgtagtctggtgccaccgtcaacaccccaccgcgcaccccggcgtctcgcccttacatacgaaaagtctatactatccttccacctctcttcaagaaatggtaccactataagggctaaaatggtaccgcacggtaccgagcaatctcaaccgtttgatctgtcccagctaacggttaggatttggtaccgcctccctctgctgaacggtagcaaatctcttgttcgtttcgtcctcgcacctcgctcctcttcagttgctcctgcggcgcgaaccgcttccagtaccagtgtcgcgcccagacggtgggcatggactcgagcaggaagacggcgatgaaggcggtcatgacggcgacccaagcggcgtagtaggcgaaggtgccatacctgaaccggcagagcatggcgaggaacgactgcgtctgcacgaaggtgaggccgaggccgatggacacgttcatcgcctgccccgccgaccggatgtccaccgggaatatctcgccggggatcacccaccccagcgggccccacgaccacgcccgccgttgcgatgacgacgtacgccgacggcgaggaagaactggaacccggccgtgagcgagccacgccaccgcgtcggggccatctcggcgatgaagagaagagccgcctgccatttcgtccaaaaccaaacgacatgatcaaaaccgtcgtgcaacgcgcggtgcaccgcaccagcgctcgtgtggtacctagtcgccgcgcgcgcaacgtggtagtggacagtgacgccgtggcgcggcctctggcgaggctggcatgcggctatgctgcaacaggtcaccgcaccaggcaaccaccaccggtggatcagttgcaccgaatagacctactttaattcagtcaacaattcccactgcaacatacacggagtattatctacttaagcagaatatgtcaatatacagcggaaccaaattacctccatcatatcaatgctctcgaattcacccacaagtcaggacgacaatactgaggataatatttgttcagcaggatagcaagttgtcaacttgccacaagaattttgttacattctgatcaggcttaattggctatttaagcatgaattcccggcatatgaaagttatcgcgcagtcagatcagcgtagcaacctgagacctcgtgcaatccataaatggaaattcttttgaagagcgctgcctgaaaacaaacagcctttgttgcgtacgcttgcttggtgcataagtgatggtgatgaacaaggcaattgggactcggagggcaatctccttcttgcgtagaggagagcgctggagaacatcccccttctctttagctcaagctgaaaatttgatgcaccctcgattgcttcttcagattcaatttccatgcctaaagaaggcagagcagcatccagaaaattaaaagtggttggccgtctccaagcttgcattgcatcaccgagagcttgttgtcttcccatgccattcatcagatatgacaggcgacgttgcgcataaatgacaggggaaaccatagtgctagatttaatcaactgcatgcataaaaaaggagcaaagtcaacaatagctgtgaggtttaaaagcttttccttttcaatggattgatgttgtttacagacagggacagtcaagaaattgctgttttcacaagcacttttctcaagaaaatcagtagaccaaatggaactgttcgcactgtgtcatacactaattctatttgatcatgcaactcgctgacatctctcacaaacccatatagcacaagagacagagatcttaagcaaaatcaacctaagaacaagtaaatatacaacgaaagctaagcttcatctccttactggtccaaaacattatcattagttcattaacaatatacatgttagcaagtattgagtacatttcaaggagggaaaaacaaggctaaagcactcaagtcaatccacttgttggtggcataggaaatatggtgtgaacgaaacaggagggtgttccaaaatcaagagaaaaccatgtcgcaactactcatcaaaatacaagacgaaatcaaaatatggagcatgtgtggagcaaaaaacatcgcgagaatatccgcttaggtttcatttagtgtgtgtttcttttatgttttcttccctagtttcccttgtttctttctccttcaccttctttggtgatattgtaaatacttttctattctccttaatataactccagcttagcctagcttcggtttcaaaaaaaaaagtattgagtttataattacatattgtaaaaaacaagcatacctttgaggggtcaagacagaagttggttagagggaagttgcgctgtgggttctccataagcagttcaatttccctgttcaaaaaaagcaagtgtgcataaaaaaaactgagaaaggaacagaacctgtggaaacataatagtataagctaaactattcttaccgcttgaggtttctgcttgttgcttgcctaagcttcataatagatggttttgaactctttggcacttggggagctggtttcctaaaataatcagaggaaggcatatagaaattatatgtttgtatagttattctttgaaaagaactaatcaaaattgttaacttaaaggcacagtagtatacccagcacattcatcatctacgaacacctcaatggggttgacaagattttgcagaattgcagccctcgatcctaccttctgacaaatctgttcagtgaaatagtatcatcagttcattaaccgttactgaaccgataaaccttgagacatgtcaccaaagggaccttttgagttacaggttgtgaaacaaacatacattccaccgctcgtggggatgcagacggacatcagagagaatggataagatcttcaaaccagaatgaataaaacactctgcaacagagcaaagaaaaaagatccacttgcttttgagcatcttctatgcaaagctgagatactttaggaataccaatgcttaaaaatcagtaataaaggtccaaccatccacttggcctgatccattatcatgggatgagcacaacggaatcttcaatgaaagcctcaagta

SEQ ID NO: 48559 - DNA, 2987 bp, Oryza sativa
gatgatcgctaaataattcagcaggataaagtttcatttatgtatctaacaactcataatattgaccggtgactagtttcacatcgtcacatgctgcaaatatatagatgtcacactgagaatcaggaaattatgcaaaatcattttgttgaacaaaggaatatttatgcaactttaacaactgacaatttttgcttttaatacactggaactaaggagatgaaaagctgatcagcgtcaagttattgtcaacttcaggtgcactaggatcaaacagacacatcatatatatattaataatacatcaaaatgcaatatgcacgtcaccagtaagaatatttctgaggtaaaacataaaatatgcaatgagcccatgaggactaaaagactaacatgcttgtaacttgctcccttcagtctttctcgaactcctcctccctttggtacttcttccccaatcgatccacctccacctccccctcctgatccccctcctcccttctttcctttctttttccgcttgtcctgctttcttttgtgcttaacctcctgacgatccaatgtgttttcaaagatgggcttggaggtttctcatgctcaaataatcctgagttaaatgcatccctgaataagatcctgacaatactaagagccgattccatagaatctatgacaagtttctcatgcttgaatggttttggctctaggccctgtttcatgaggtcaacattttccattatgtgagcagaaattttcttgtactttttcacatacatggggttggagggatgtttccccaatttgcttaaacccggattctcagaaaggaaagaatctttgatgtagtcatgcaccgggcgtaatcttgctgcctcagatataatcacagcaaatattgcaacatcttctgatatatttatgttttcaccaccagcatgcctccagaagttgtcaaatgcttttctaacaggccatagaccagtgggagtattctcaacacccccgaaaacaagcttgttatagttcaaaccagttttgagtctgatgcactttgggtccagagtgaagttctcatgttggtcatggttaagctcaaaaacacaatcccttgctttccatcctctaaggtacagatttcttccctgtatcaagaatcttatagaccgacccatgtacacgaattccacttccattgagcctccagctcttgtagtgaatacctcatggcactgtccacaaatatctgagatatccaccttaattccatcttcatatgaccaattaattacctcttcaatgccactaagatagcttgctaacgcttccttgtcagttccatcaaggcaaattgtggtcacatgctttgaggtgagccccctattcctgatctgctaaacaaaattacaggtgtgtacattcatatatggaagttaaatgagtaaactagcaacttttcaacaggcagtgctgcttaatggtcagttgtagttcattagggtatatccaaactcccaatcctgtgaaagattccaggcatattaaacttccaagttcagagtaacaatgtggctgatatatagccttgcaagttaactgtaacaatctggctgataaccttgcaagattataagcaacagcagcaaaactatggactgctgaaccatattctgttctcacatttttggatccaatatacagtctaatactctgtcaatagtgttttctatcattctctgacaatactgccgtaccaaatatccatattgaccagggcacagttattggaaatcatatccaagtaaaccaatcaccataattttgtatggcatttccctctcttaatataaaaccagcaagatctaggtttcaaaaaaaaaaaacaatcaccataatacaattaataggaacgactgaaacgaattcaataggttgtcctacctaggaaatttatgcactaattagcaagacaaaatcagttcggcaggtggatcataagttgcacatgctcagggaatcttactagcgctgcacataaatcggaaacaaaaatctctaataatgcacaatcaacatattatcgctaactctgtatcatgaatccgctgtggataaagtaaaattctgccgcggaatgacgtaagttctgtttccaaaatcgcatctaagccaattggtattcgataccgcgtcatctccgctccacggctgaacacaaacaacaacgaacggttaaagggggagacgattacctcgctcgcgtgaggaggcggaggcgagggccgtgagcgccccatcgtcaacgaatctgccgggcgatagcggcgtcggcggcgagaggttgctcccgtcagcgccgagggaaccctagggtttgagatcccgcacgcaatcgttgctggggcggggcagggcggcgaaatggtgcgcgacggcgatcacggagcaggcgaaatggcgaagagggggctcggaagaatgccgctgcgcttgtcgatgcaatatgcttgagaatgggggagttgggtctctgggcttcgttttcgggcatcgcgagattagtgggccgtccgtactcaaatgtgacataataactttagggaaaaagtacaccggaggtccctcaacttgttgaatcgtccttgaaccacaaaaccagatacaatgctccctcaacttataaaaccagaataaactagatccctgaacggttttgactccggttttgtctgatatggcagatgactcagcgtgggacccacgtgggtcccacatgccagccacttcttcccctcccctcaccatctctcttcctctctcctcccctctccacggcggctgcaaaaaacagatgggcgttgcgggcgcgggcaccggccggcgagggagtagctgccaccgacggcggcggctttacgccggccgacctccagctgttgcatctgctcatcaccagtccgcggcgagacgacgacgccgcccgacgcact

SEQ ID NO: 48560 - DNA, 1678 bp, Oryza sativa
tccccgcgtcgtcgcccgctccgcccaccggtcacctaatttgccggccggccggccgctccccgcgccgtcgcccgctcctccagctggccactccgcgcccgcatcgtgccctctccggcgatctgcttggaggggaggggagagaggctgagaggggatagagagaagtggggaagaaaactaggtttcgctgacatgggggcccacatgggtcccacaccgactcagcagccacgtaggataaaaccgggatcaaaaccgccgaaggacctattgtaactggttttatatagttgagggaccccgcatatctggttttatggttggaggacgattttgtatcccgataataagttgagggaccttcggtgtactttttcctaactttagtggggaacgaatctatatacacaagtttccaagtttcctatgcacaccaactaacaatgttatagaaatgttttaaacaaattaaacacatattttttatttattatattttagtattacacctatgtgtaaaatcctatctttaaattcattatattttagcggtaacaaaaagataaaattatctagattttactcttaaaaccggtcagattttcacttttttttgttacagctaaaatataatgcatttgaatatgaaacttcgcatatatgtgtaatactattaggagcacgtgtctaattttttctagaattttctgtgacatttgtttgttggtgtgtacgaaaaacttatgtgcatatgatatgttcctaagttagtgagcctcgcctatcgaattggtattaatgtcacgaggtgagcttagttcaactagttagtttattacttgtggtagaaccaagctactcgagtttaagtcttagacttgacatggatgctcacatttgtaggtaattattattttagtagtaagcagtgtatatatcgatattgatatgcccatggcgacttcattaatcctaaaatatgccaatccaagctttttggaggtgcttatagcggtaaggtgcgcacgcgttgtaacgccccgattttcacgtggcgttaaaaaactaatttaataaaaatcctatatgcgaaaaatttcgttctttaaatccctccttagtctcaattccctaatgtcaaaatcgtctgcccaaaatctctgtccgagaataatctcacatttcgaaccttcgtattcaaatctcctttctaaacctctatcgagaaatttccccttcgaataattccagttcagttcctctccgaagatttgagtccacactcaaatcatctccggttactccttgcgaagggctcatgattgcaaatctcaagtttggcaaattcgaatccctaacctaacttctcaagtcttcgtttcgaaaatagctttgaaatttgaatccttatattcgaattgaatccgcaaatttcatctaatgctcaaataaaaactaagtccaatgattcacctccatatcctaaacttttcccttagtccttgaaatcaattctcgattgtttcatcctctctctctctctctatctatctctatatctatctttatctctatttccatctatctacctatctccctttgaatcctttctcaaaatattcctcccaactccaggatgcaaaatccagtcaaactccctccttgaattcca

SEQ ID NO: 48561 - DNA, 890 bp, Oryza sativa
aggaggaggaggaggggggcagtgaggaggagtcccgcgcggttgttgtcagggagccctcctccacggcgcgcagcggccgggcgaggagaggcggccctcctctgtatcgtacttatctacttattatctacgtgtaccgtgtttatcccatctgttttcccctttatttcttaccgctgaactaatttcccaatctcaaaaggcaggcaaaattacttgaaacagtggcggcggcaacccactgatgagctccggccctccgtggatggtggacgagcgcgcttggctggatggtggtggagcgagctggagaggacggcggccagccaccgcgagcttgtgtggaaaggaggctcgttttgcttcttcttcatccaacccccgttcttgtctttctctttgttgcttgattgtcttcccctggaatcgacatcaaaaaggaatttttctcacagttttcccgtgaccacttactgtgatcaataggaaaggaaaatggcgccttcaacacgcggaagcggcgagccttctcggcggcgtccttgtacgtgcgcccgtgctccggcatgcttcggccgccgttgtcgtcggagctcggaggcggcgggagtgaggaagaagagggagagccgagaggggagagggaatgacatgtggggcccacgtgggacccaccattttttaagctgacatgtgggcccgtggtttttattatttttcgagatataattgccacgtaagcgccacgtcaatgccatgtcagatcgagacggagtcaaattagccacgtaggcgccacatcagctaaaaccgccatcaaaaccaccgagtgacctaatctgcaccggttttaatagttgagggaccgttgtatctggttttggtgt

SEQ ID NO: 48562 - DNA, 738 bp, Oryza sativa
tagacctctcctccaatcctgattaggccgccttatgaccttgttttgtccgttcctaatcacaaaacgctcatgtgcttgttgcttccgtctcacatctcccaaattctctctctctctcttacccccgggcttctctttgtttttttttttgcgcgaaactgggtctgatttttgtttctacccgcctaaaaattctctttggcttgtgcgtatacgcggcacacgcagacgcagggcagtagtgggtcgcttggcattgtgcgcccaacccagtagtagtagcagccgaggagactagacatggccgcggcgtcgcgtgcttaaataataagccggaggcggagccaagcacccgtatcctggcgcgccgggacgtgacgcgatcacgcgacgcgacgaccgggtggaatgcaagtgggggacccggcatacggcgccgcggtggtgtgtgcaagcgttggattcggcaaagccacaaaccggcgcgcggctggctgggctgggttggtcgtccacctgaagggggagttcgcgcggggtcgtggtccctgtctcaccgtgcgcggggtcgcgggctctcgcgcccgcgggaaacgcagaattctcctgtattttcggggttttcccccgcctttcggcgacgcaagccgccgcttcgtgtggcgcctaaactactggccggcgacggggagtgcaaacaccggtgcacgcttccatccgggcagaaaaaaaaaa

SEQ ID NO: 48563 - DNA, 59339 bp, Oryza sativa
  unsure (1)..(59339): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgaagatcagcaatttctcccctggtttgcttgccgtccaaaaaaaagatgtcccctagctttgatcagtgcgcatgcatcgactctactacgtgtaaactctacagaggcacgcctcatgagactttccttgatcagctatagcttcatcggtctgaacccactcatgatgaactctctgaaactctccccgttccactaacaccacccactaacatcatcataaaatgttttgctccgctcgtacacgcaaagagacgaacacgtcgccgcgcccgagctcacggtgcgcctcacctactgcaaacctctgcaaatgcctataaatacaccgacgaggcagcgatcactctccattcacagcaacagcacatctcgcagcttaatttcagcttactgatcagtgatcactgagctagctgagacaagtttttgagtatggcagcgaaggcatctgcagtgttcgtcctgctggtggtggtgctcgcggtggccgcggcgatgcggggagcggaggcggcgacgtgcacgccgacgcagctgacgccgtgcgcgccggcgatcgtggggaactcgccgccgacggcggcgtgctgcgggaagctgaaggcgcacccggcgagctgcttctgccagtacaagaaggacccgaacatgaagaagtacgtcaactcgcccaacggcaagaaggtcttcgccacctgcaaggttcccctgcccaaatgctaagcacctcgtatggtcacacacgcactggtcatcaatacagtagcacaccaatggcatatgcatggttttcaggctgccattatgccatatgggtgtcagtttaagtatactaataaaatgagtcactagacagtgttctgtttaaagtttcagaataaaatccaggctcagtacgtgctcggtgtgttatgagcttctgctctgcaagctttatgtgtcatgtatatgttacagaaataaatgtgagacggctttctgcttaaggtccaattgcacttttgtacttttgaagttcagtcatacaagatcaacagttacacaatacagatttgtcatgttgtttttagacgatgttaactcaagaaactttgtggtggaatcttcagatcgtctgcagagctttgtaacatctcaaccactctagtcatcgaaggccgattgttaggcagtagttgtatgcaccatagaccgatgattatcatcttccttacgagtacagaggtgtcaagtcttatctcattagctgtgacacaatatccctccaaatgttcataaatccattgaggaaaatatttgctgctgacatctgcacttgcactgatattctttcttgctccaaccatctcaaggatcatcatcccataactatagacatcagacttgctgcttgcatctccaaattgctttgaaaatacctctggggcaatgtaacctattgtccctcttgcaccatcaatagagatgatactctctttttgtttgcacaattttgccaatccaaaatcagatatcttaggacaaaaatcttggtctagtagaatattgtggggtttaatgtcaaaatgaacaatacgagtattgcaccctcgatgcaaatattcaagtccccgagcaatcccaattgcaatatcaaacaatttctcccaactaagtgaatcttcagtttcagagtttggtctgaaagcaaatctctccagtgatccattaggcatgaactcataaatcagagccctttttgatccctgaatgttggaattaatgaatgggccttagcccactcgaagattaattctttggaaaatcacaaaagcccacctcatgggatggcatgcatatggagtttagtaccaccttgcttattctaggagagggggacctccttaaaagggaggatgccctcctagtcacttgaagcatgtgtggtggagagaagaggggaaacacgcgcgcgctcgctcgcctcgccgggccgggccgggccggcggcgcgcgtgcacgacgtacgcgtcgaatggtccgaaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcatgcaatatacgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtctttccgtcatctcggtacgtgttcaatatgttgcgcatatttgatctgttcatgttatactgtgtagtttacatgtgtagatctaatgatgcgtccatgctagttttcatctgtaatgtcatgatttatttatggaatagattaaatcattatatgtctataatctcaacaatccaaaaaccttattgtaggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggagaaatacaaagctcagcagaccaccaacttcaagaagcagaagaagaacaacaacaatcctaatcaggatgagaggacttgctttgtgtgtggccaagttggtcatctggctaggaagtgtccacagcacaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaatttctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgttactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaatcgcacactgactgacttggtgaatgccatgttggacaccgcgggactgcctaaggcatggtggggggaggcattgttgaccttaaatcatgtgttaaacagagttcctaacagaaataagaacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatggtaccttctttgagagcttttgcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagcgaaatggattccattatcgctaacgggacttgggaggtgacagagcggccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagtagcctcacatggtcttctcgttcatcaaatgaacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaagcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagttaattagaggtgagaatgggattacactcttgcagtcccattatgtggagaagatcttgaatcgctttggctacattgatagtaagccttctccaacaccttatgatcctagcttgttgcttcacaagaacaagagaattgctaggagtcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtaaatagttctaaggataatatgaaatcgtctagacatgtgaaaagacgattgaagtctgtcaggaaattaagaaactccggagttataatgttggattacattcaaacagcgagaaatctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgagggatagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctctatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggggaaacacacgcgcgcgctcgctcgcctcgccgggccgggccgggccgggccggcggcgcgcgtgcacgacgtacgcgtcgaatggtccgaaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggctacgcgcagtagagatcgtgcgggcgccctgatcaagcgacccttctctatataaccgacctgccgcttcatgcaatatacgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtatagtatacatgtgtagatctaatgatgcgttcatgctagttttcatctgtaatgtcatgatttatttatggaatagattaaatcattatatgtctataatctcaacaatacaatatcccaacaaggtgacaacgttaacatgagaagttctgctgatgcttgctacctcattcatgaattcttggccatcatccttgcaagacttcagtaacttcactgcaattggcttgccatttggcatcttgcccatgtaaacagtaccaaagccaccttggccgagcttgtgactaaaagatttggtcattgttttcacttctgagtaagaatatctctttgggtgttgagcttcatgcttttgcaagaaggactcgatgtttggtgcttctttggattttcccatcgaggacaatagaccatgccagaacttcttaacacacaaggtgcacatgagaagcaggaacaataaaattacacctgaaacgactgatacacctacagtaacattttaagacaatgtcatattaccaaggataaagaaatttcaattactctattcctttttcaattgaaaatgcgtggttctggtatatactctctatttttgtgcaaaaccttcatcaaattttttcataaccatttaggtgacatgcaaataacaagggatattccctcgagggattaaaatagtttctccatttattcatagggaaaagaatgtactgtatgttagtggcaatcctactcatgagagtttttttgcttacaattttgtactcgcaatatgtgcaattagttgactaattacactcgtaatgggttcctgtcattaatattttccgttgctagattcagatttccggaaaaatatataggaggcagagttttcatatatttacctattgcaatagcctttttcttcgatatctttgatcctgcaaaatcatgaaacaattttatcaacgaaacaatcagcaagcgacaacattagctaattatttgacaaaaaaaatgtttttgcaggtcataaaaaaatagaatgcatgcatgctcctttaggaaaaaaaagacacaatatcacactaaaagtgcatcatgataccggtcctatttttcatcttcttccttcttttaagacatcttcatcttatggggtgagaaaacaaggaatacaagaaaatggtctacttggtttgccattcaacacgagcttaattatttaaacgttttggtcaaaaaataactaattcagttcatactacctaatcccctagttgtcaattttgataatgcttataggttaacagtcggcatcaacaagagaaaattctataaatttaagtgaagagattaattcaagtaagtctgaattttgtagacttgcagaacgtaagcgaatacttgtcatttgagccatgtcaaatgcacgcaaatcaaaggttgatcaaggccccgtcaaaactagaacatcaccaaaaaattggcacattaatcaaagaaagaaacgaaaatcgccactcactatcctaaacttgtctaagatgaggtcaccagattaaactataggacccaaacatagcagaaacagacatcttgagtcaaacatagttgtcctaatcgaaacaaattaactaaaaaaacaaccttatcaccaaccttgacttgccctcaagtttgttagaagatacaaacggtacctgatgaagaacatgatccgatagcctgaccatcaggacagtaacatgtatactgatcaggaaaactgccattaaacccacaatgccctccagaagccttacaatcactacaccaacctaccccaactttccatctcgccgtgaaaccccctctaatcacatccacaaggctagaatttccggcagccaatgagcctgccatggttgaattgaatggaacaacgaaacttgagctgcatgatcccagaatatctgattccaacgagtcatccttgttcttgtgcagcctatagtaggagcttcccccagaaacgcatgacagaagatcatagataaaaggcagagatgaagacttggcactgcagttgacatagaccgtcaggaactgatcaaggtctgtgtacatgaacctgctctcgtcgatggtggtgttgtgatagcgatccgggcatgtctcctgaggttgagtttgatcgatgaccgcaagaaacttgttgccatagtcgatatctgtaacctggaacacggtggaattcatgtggatcatcagcttgttgtctgggttgcagatgagacggtacccagggtaagagcagtagtttggacggtcgacgccattcgccgagaaggggtaatcgacgtcgagcttgagtgatccgcactggtaagaagctgtggtacaatttgtgtaccggaagaaggcatcggattcttgtacagaaagtggcactgaagagatcagcagtagggtgatgaggagtggcagcgcacacaggggatgcatctgctccaaggcgtggtgatgatgaactgaagagcaacaggaaaggggagaggaggaggaggagctgcttgatgaacaaagataagaggggacaaagaacagctacagtaggtcaagaagggttggctgagtaaacgtggggaacagaaaatcgtgggaggaaattgacctgatgggttgagttaaactaccattgaccatggacctgcgtaaaacttaaacttttcgtaaaaaaattcttagccacaaagaaatgccttaggtaggtagcttgagcacagagcaggacgagcgtcaccgatttcgaccgcgttagtatagtagtattatctactaactgaattttgacctcgtcaagattagcgactttgaacagtatcaacaagactgcacgtcaacgttggttgccgcgctacttctactgctgcccacagttcgtcagagcacccgcaatggtaaagtagggtgctctctataaaacatgtacatctcagcaatagactagattaatagtaaaccacctcaatagtatgtctacataggtatctatagctctctcatgcattgcttcgtttttctctatagactatctctaagctagtagatagctttgctctctctcttcatttaatatcttccaagtagaaaaatatgctgacatggatctcttgtagatagcttatagataaccattgtgggtgccctcagtgtgtttttcttattctgtattttaattaatttcttgtgtttccaaaattaattaatatcagtttaaaaataaaatttgtgtattaatttcgtggggaagacgagttaccgcaggtcgagctgctggcgcggccatcggagcacaggcatcccaggaactcgttcttcgtgccgtagctgcagcgtcccccggatacctcgcactcgtggcacatccccgccgtcgggtcccagctcagctggaacccgcgcttcagcacggcgccgtatccatcgtcgcccaatttgccgtagtacttctcgttcatgagccaatccttgagcacgggcaccatcaccacctccttgcacagccccaaccactccgtctcgcctgccacgtccggctgcgtggcgacgaaagacggcgccgtgtctcgccgccccgggaagtcgaaggtgctgcagttgatcgggcggatgtacggcggcggccgcagcacgacgttggccgtggagttgcagtcgaagaagaaggtgatgctgtcgttgccggggctcgggaacgtgagcacctccgggagggtgacgttgtgcttcaccctcgggcagtcgccgccgtcgagcgcgtcggagtcggccaccgtgacggtgtggttgccgtggttgatctccaggacggtgtagttgtaattcccgagtcgcaggatggcgcggtcgtggtcgcagatgatgcccagccacgggtagccgcagtagcgggtgttcccgtcgacgacgacgacctgatccgtcgtgttggagaggtagaaagggtacttgatctccacctgctcgccgcaaaagatcggcctcgcgcatatggcgtcgtcgtacgttccgccggccgctgtcgcgccctcaccgccggaagcgatgaaccagaagaggaggagaaggtgggaagcatggctaccgagcagagcaagcccgtatcttctcattgtttgctcgaaacgcgtcgataattgtcatactttgccgtgcttagtgcctcggtgctttaatgcttactaatgacgcagaaagttcaaccgaatgttcaagtcaaaggtgtgtactatcgtctccccgcgaaattttttgcttcagaattatcttgaaacagtaacaaacaagacaacatgcgcgagttgataaggtaaatttttttttcgcgaacgcgcataaagattacacgttaatatattaaaaaagaaaagttttttttacacaacgtattcaaccagaccggcttataccagaaaaagggataaaacaaagaaaaaaaaactaaggaagaaaaaatggaaagacaaacacaactccaatcagcgggagtggacaaagccacactacatacactcccaacaaatcgcaaacgaagcaacgccaactaatgaccacagacggccctccaagatgatgaactataaaactactaggacagtaagaccgaagaaagcgtagagtcgaaaaccatatggttccgttaattccacagttgtcaagagaccatgaggactagaaagtcgaagccggcttggagactggagagacggagatactcaggtaagcatgtcctagaagatgctcaggtctgccacgggagagagagggcaacccagctaggagacgacaacacacatagccagacctgtcgaacaaacacgcagtcgaggagggcgtgggataaggtaaagttgctcttcggctgtccatttgcgaacacttgctcagctttgtatagctcggaactggttttacgaactgtttttcgctagtactactaactttacaaatttagcatctcgaaacgttgaaacttgcgattcttgaatccggaagtcagaaaacttgtgcttgaattttgaaaccatatgttatgctaaaaagcccaatatccttcacagcccaagcgcctgcgttgaatttaggcctggaacaaataaggctgcttcctaagatacatacgtttcggcctggcccaaaacatacgagcctggccagctggcctataatagctagcaggccgtcaagggaaacggcccggtcgtttctaagaatacagatgtattaccgaccggagtatatgctaccatgtctgactgtacatatggcgccatatttttcatcaaaaatagtcagtatgtatttacattataagttttaaaattacatatgtaattttattgtacttacaatgtatataccaaaattacacatgtaagtttcaaaattacatatgtaagttttaaaattacatatgtaattgtagtgtaaatatgatgtaattatggtgtaacttactacacgtatctcatccatcggttaaatcagcatgtccctcatcaaacaacacacacggagtcaattgacgaggcaaaagctgtggaagagccgtaaaacgtgcgcggatacaacacatgagcacgaatctacatgccatcctaaggcaaaaaatcgactgcgattggacagaaaatctgtcgccacgattatagcaaatccgctacgaatctacgacggatgcaatgttcacatatacagtatactgttcattgtatggtcagcaggaattgatgtcgcgatgcagaagcagacaagaatcaaagaagtagctagcactaataaaaaaagaatggactagaaacatgttttttctcctggtctgcttcacaagtcaagagacaatcttttcttcttctggcccgtgttgtgatttgtgagggggcttatgtttggcacaaaacgtattttttgggctttttctgtcatcctacctataagaatatctcagagttcaccggacatggaaaagaagaagattcttaattcgttttatcgtttagtttctcttgttcacattgcgcgtacggtagaccatggttcgacttccgccggtaaccgcacggttaccacggtaacctccttaaattcaaataaatttaaaaataatttgaatttttgataaattttacgcggtttcatacggttttttacggttaccgtgcggtaaccgtgcttacggccggggcgcggtaacctcggcccggccggcggtttgggaaacctgcggtagactggacctggattgacctactgcaagtctgcaatcctaggacatctgttcctcttggactggtatttatgatcataggctaagaaaattcagaaagaaggtagcgaacaaaacatctactctctccgtcccatataaaatcaaaccctagcatcccaatacaaaattagtagagagtgaaatgaccaaaatactctttattatttaaaaaaatagtaattgtgacaggtagataaagggtattgaagaaataaaacttttcattttatatactgagagtagttaggatgttagaagttgattttttatgggataaaatttaaatgataataaatgcttaaagtattttttaataataaaacaacttacaacataataaatgataattacgtaattttttaaataagataaatgattaaatgtgtgttaaaaaatcagcagcttcatccgtagaaaacgaaggtgtagaaaacactttccgatatggatatgtctcttttgggatatgttgagtttttatgggacggaggtattatgtcatagtggagtagtatgaaattgcaggatcaatccgttctggaagcagttggtacggcagctaataagttcatgggagcagaccaaataaagagcatctgccattcaaaagacgactgcttaattaagtgctcatcactttcttatacctgggttgtttgtttgtaaagagcattatatttcacatttgacgcggaccggatgtgcggatgcttcctttccatcgcgttaggagcaatcgaaaatcacaaaaaagacaatgagaaagaatctgaaacgagaagcagcatgtttatttgccacgaaaacgacagtagcactgcttccgttcaaaaaaagaaagaaagaaagaaagaaagaaaacgacagtagcagcagcatgcgtccatgcagcctggccgagtccccacccgaccggacgcagacgcacgactcccacgaggtcgtcgttccggtggcgtgccaccagcaaccggatcgaggaagcaggcagcgaaccccaactgcccctaccccaaccaatcccaacacgccacgtacccccaatacctacgcacaccaaccccctcaggtcaaactcgtgctcgtgctgtcgtgcagctcaagaagtccgttttagtataggaccaagctagtagttcgccaacacgatgtcacaaaaaaatttaagcagccggtgtaagctcgcaccgtgcgcagtcgtcgccatgccgccactactcttccacctcctcgtactctccgtcgtcgtcgtcgtcgttagcggtggcgcggccactgccggcggcggaacgtacgacgacgccatatgcgcgaggccgatcttttgcggcgagcaggtggagatcaagtaccctttctacctctccaacaccacggatcaggtcgtcgtcgtcgacgggaacacccgctactgcggctacccgtggctgggcatcatctgcgaccacgaccgcgccatcctgcgactcgggaattacaactacaccgtcctggagatcaaccacggcaaccacaccgtcacggtggccgactccgacgcgctcgacggcggcgactgcccgagggtgaagcacaacgtcaccctcccggaggtgctcacgttcccgagccccggcaacgacagcatcaccttcttcttcgactgcaactccacggccaacgtcgtgctgcggccgccgccgtacatccgcccgatcaactgcagcaccttcgacttcccggggcggcgagacacggcgccgtctttcgtcgccacgcagccggacgtggcaggcgagacggagtggttggggctgtgcaaggaggtggtgatggtgcccgtgctcaaggattggctcatgaacgagaagtactacggcaaattgggcgacgatggatacggcgccgtgctgaagcgcgggttccagctgagctgggacccgacggcggggatgtgccacgagtgcgaggtatccgggggacgctgcagctacggcacgaagaacgagttcctgggatgcctgtgctccgatggccacgtcagcaaaacagactgcggtgagttagtaccctcttgcatacatcaacatatttaattactagtattacctagtattactttcattccgaaataaactaacgtaatacataacatcacatatcgtaattctaagaatttagataagtatttgtttatcaaattcgtaacaatataatatgtcatatctcgtactagattgatttattttgaattgaatgaagtgtgtctatgatatattacgaaagtttgacaagttatttaaaaagtagatagaattaaataggaagaagttatgattggttaagaagtaaagctagttagaaaaagtgaatgatgaatgatgagggttagtaattggttgcgaaaagaatgtaaattataaatgctaggagttataagcgtgatctctctccaacttttaattgcttgttgtcgaaacaaaacatttttttgcgggtaactttgacagtgttgcatgaatgcattgtggcatcccaaaagccaattgctgttcgtataggtgtggtaggcatccccgcacatctttcttgatagaaaatgaaacctggttttgttgatgcgttctgccatgttggtgacggcactgcttgtgccaaccggtatgacggcagcaaagtatctagaaactcctattttcaccccagaattctcgtttatttggcagaggttatttggtactaggaactgtgaaatccctgtgaggtaggggtggagctggctcgtgctcggttcgtttgagatcgttgtcttaactcggctcgttaatgttaatgagctaaaaagctagttcggctcggttcacgagctagctcgttaggctcgttaacgagatatatctcattaataccatattaataattttaaatttaacattttattatgtattaacataataataaacactaactaatataatactctctaaatatgaatagttttgatgtaattaaaagactaaacactagttcatgaagatatgatgatattttatactaacgagctaaacgagcagttcacgagttagcttgttaagctcacgagctaaaaggctagctcgacttgactcattaagactacgagttcgaatcaatccgagccacgagttttgagctttttatccacccctactgtgagcgcaagtgcaccaccatgcctccgagttgaagatcactggtgatcagtagtcacagttggtgggtaacttctcctggaacaagacgaaggttctgacttttgaccatcgcaaaccatcgcaatcttatttgacgtgagccagacgagagtgcgacgtgccagttcacataaagaacaggtaccaagacgcctcaaatctttgacttgtaccaagtgtttgcccgaaatttccttcgggctgagccgccacggaaggagaaaagaaaaaccataacccataaattcctgaaacctgacgccatgatctgtctcatgaattcttctcggccgtcctctcttgacctatatgaaaacaatcaatgagccgtgcagtgacttaatcgccgtcttaagtagtactagtacactcatctggtattgcatttctcgtccatacatctacccaggcaggcagctagctagtatcctcttcctctccccttttcttgttgctcttcatcaccagttcaccacacctttgagaagatgcatcccctatgttcgttgccattactcatcatcatcctactctcatcggtgccaccttctatgcaagaatccggtgcctacttccggtacacaaattgtaccccagcttcttaccagtgtggatcactcaagttcgatgtcgattaccccttctcagcgaatggcgtccaccgtccagactactgctcttacccaggatatcgcctcatctgcagcccagacaacaagctcatgatccacatgaattccaccgcgttccaggttacagatatcgactatggcaacaagtttcttgcggtcatcgatcaaactcaacctcaggaggcatgcctggatcgctatcacaacaccaccatcgacgagagcaagttcatgtacacagaccgtgatcagttcctgacggtctatgtcaactgcagtgccaacttttcctctctgcctcttatctatgatcttgtgtcgtgcgtttctgggggaagctcctactataggttgcacaagaacaaggatgactcgttggaatcagatattctgggatcatgcagctcaactatcgttgttccatgcaactcaaccatggcaggctcattggctgctggaaattctagccttgcggatgtgattagaggaggtttcacggcgagatggaaagttgggctaggttggtgtagtgattgtaaggcttctggagggcattgtgggtttaatggcagttttcctgatcagtatacatgttactgcccttatggtcaagctattggatcatgttcttcatcaggtacccctatgtatcttctaaccaaacttgagggcaagtcaaggttggtgttaaggttgtttttttagttcatttgtttcgattgggacaactatgtttgactcaagatgctctgtttctgctatgtttggtgtcctatagtttaatctggtgacctcatcttagacaagataggatagtgagtggcgattctctttgctttctttgattaatgtgccattttttttggtgatgttctagttttgacggagccttgatcaacctttgatttgtgtgcatttgaaatggcccaaatgacaagtatttgcttacgttctgcaagtctacaaaattcaaagttaccctgaattagtctcttcacttaaatttatagatttttctcttcttgatgtcgactgttacctataactctataagcattatcaaaattggcaactaggggatttggtagtatgaactgaattagtttcttttttaccaaaacgtttaaataattaagttcgtgttgtatggcaaaccaagttgaccattttcatgtattccttgttttctcatcccataagatgcagatgtcttagaagaggggcttttaactatttgccacttttagatttggcaaataattatttgccacccctatctcaataacatgtgggtccacatatgtctatgacatgtgggtccagtggccaaaagttaattgccacatctaaatgtggcaaatggttaaatatctccttagaagaaggaagaagatgaaaaataagaccggtatcatgatgcacttttagtgtgatactgtgacttttttttctaaaggagcatgcatgccttctatttttttatgacttgtaaaaaaaaaatttagtcaaaaagttagctaatgttgtcgcttgctgattgttgcgttgatacaattgtttcatgattttgcaggatcaaagaagtcgaagaaaaaggctattgcaataggtaaatatatgaaaactctgcctcctatatttttttttccggaaatctgaatctaagcaacagaaaatattactgacaggaacccgttattatgagtgtaattagtcaactaattggacatattgcgagtacaaaattgtaagcaacaaactctaataagtaggattgccactaacatatacggagtagtgcatctatttttttttctgtgaaaaatgttcttttctgaacaactttcatccccatttgctactttcagcaacctccatcgcctccggtgttctgttcctgcttctcctcgttgtgtccttcttgtacattcgcaagaggagacagtacaagatgacctcgtcgtcgaggctgctcaagtacaccacctccggcaggacgccgcggtcgaaaggcagcagcgacaagttcgtggagtccggcagcttccactacctgcagacccaccacttcgcctacgaggagctcgaggaggccaccgacggcttcagcgacgcccgcgagctcggcgacggcggcttcggcaccgtctacaaaggtattttcagttccctccgttttaggttacaagttgtcttgagtaaggcccagtttagattctaacttttttctcaaactttcaacttttccatcacatcgaactttcctacacacacaaattttcaacttttccatcacatcgttacaatttattcaaactttcaattttggcgtggaactaaacacaacctaagtttgtataaaaaaataataattttttaacctaacataaatatattataaaaatatattcaattatagatttattaactgaacaaatttggtgttgtaaatattattatatttatctataaaatatagttaaatttagagtagttaaaacgacttataacctggaacggaggatgtagttgatttcgttgggtttttggttgatctggaaatgtgttcaggtgagctccgagatggacgcgtggtggccgtgaagaggctgtacaacaacagctgccggcgagtggagcagttcgtgaacgaggcggcgatactgtcgcggctgcgccacccgaacctcgtgctgttctacgggtgcacgtccagccgcagccgggagctgctgctggtgtacgagttcgtgcccaacggcaccgtcgcggaccacctgcacggccaccgcgcgccggagcgcgccctgacatggccgctccgcctcaacgtcgccgtcgaggccgccgccgcgctggcgtacctccacgccgtcgagccggcgcccatcgtgcaccgcgacgtcaagaccaacaacatcctcctcgacgccaacttccacgtgaaggtcgccgacttcggcctctcccgcctcttcccgcgtgacgccacgcacgtctccaccgcgccgcagggcacgccagggtacgccatgactgacgctctgcctctgctccattgctgtctcgccattaccggtggagatttgctccgttccaataaaaaatatctcgaggtaccagtacctcatggtaccaacgatcgaaaatgatttggtaccttgatgtatcttttattggaccggagcaaatctcttgccggtgacatggtgccatgttcttgatggtgatgcgatcttgtgtttgacgcggcaggtatgtggatccggagtaccaccagtgctaccagctcacggacaagagcgatgtgtacagcttcggcgtggtgctcgtggagctcatctcgtcgaagccggcggtggacgtgacgcgggaccgcgacgagatcaacctggccggcatggcggtcaacaagatccagaggtgccaggtggaccagctggtggacgacgagctcgggtacagctccgacgaggcgacgaggaagacgatgaccatggtcgccgagctcgcgttccggtgcctgcagcacaacggcgagatgcggccgccgatcaaggaggtggccgacgtcctccggggaatccaggacgagtgcagggcggcggagaaaggcggcaagaggggctcgccgtgctcgcccaacaccgtgcacgcgccatgggacagcatgagcacgacgccgaacactagccagtaacctctctgtcgatcgagattcgcttgttttgtaccggacagcgtactgattttttttcctgccggtttgatgtaaattatgttattttatatatctttgaaacagcggaaatgacgaaatgtacatagaaacttctgaagttgtgatagcgtttggcatgagtattgagtaaccagttactgatgattctttttatcctgtaatttgccctgatacaacattgagaaagtatggaataagctcagacttctgacttctgagtggagggtggaccggtggagcttgcaagcttgttagtgtcaactgccaaagctcaaaacatgagcagaggcacgatctgaactaggcccatctcgcgtcgcgcgctggccagtctagccgggcccggggcccagcggctgcgtgaggccttgctgccttggtgagcgagagtggtgcgggccgcggctcgtggctggcccgagcaacgcatgcagcaagcgaggggcgcctccccagccttcaatttagctagagttagagctgtgccaaacggtacatattattcatttttcggagcggagttagtagatgtcagggttatagataccacatacctaacagtagttgactaaatctcggcaggatccaccacataccatgttctatacggaagcaaccttcggatataggaggagttccggataaggaaagacaaccagagttctacatggaaacgacaaggactactcggattgtatccatattggtttccctagttctacttggacaaggggacacctatggacataaatacaagcccccctaggaggacagggggacacccatgaccatgagacgatcaacacccaccatgaagggatcaacacccaacacaatcgacatagaagccataacataaaagcctatatccaccaggacacgccgccggatatcgacttcagggataagcacggctagtaccctacggtgtctccggatactgtcaggagagacgaaagtgctatctctgatctcgccgggcacggattcaaggagtaaggctaccctgttgtcgactacgagtcatatcgtcagaccgccatgtcgacaacagttagatgggctaccccaaatattgtactggtgtgattatcatgaataagagcaataccggcttcgcccaacaggatgtagggttattacctgacaactcaggggcccaaacctgtataaaaatctctgtatccatgtcttttacctcagtctcgcgtatatcctagcaccaataatccccataccatgcaaataccagaattacgacatcaaacgtcaacagtagagctacttcacaaatttgtactacaggggtatagctgggtttttctgctccacagctccactccaccttaaagacccactaccctttaattttttagtctatttacacaaaaatgccattgagctacccttcctatcttctttcctcccgttctctctcctcccccatcctcctcccgaggccggccatggaaggtttcatttgcgtcgttggcagcgagcggcggctgagtcacgtcggcggtggcggctgacggcggcacgcagtggcgacaggccgcgtccgcagcagcgggggcacgcggtggcgagggcagcacgggcgatggcggtggcagtggcgcgcgggcggcggtgtcgacaggctgcggtggtagctcacgggctaaccggcggcggcagctcgcgggctgcccggcggcggcggcggcgtcgacagctggtgggcgtgggctgaccggcggcggcggctcgcgggcggcgaccacgataggttgacgccaacaaggtgttcgatgaaatgctgacgaggaatatggtggcgtggagctgaatagtctagccaagcactttctgtccccacctcagcttctataggagtcagctctcactggagttagagtttagagttgggagttggagtttagatccctaccaaacggggccaaaatcttcattctagcccttgaatgatcgattgataggctcagctcgacccaacgacgcatacacttcattctaggcttctagcaatatatacagccacgcagcggggaggaagcgagagcaagcgagtgacgacgccatatgacatcaagggggttcggtgattaaaatttcgaacccccagagccggacttcattagcaagtgtttactgtagcacaatattgtcaaatcatggcgcaattatgtttaaaagatccgtctcgcaatttacacataatatatgtaattagcttttttctatatttaatactccatatatgtttccaaatatttgacgtgaaaagatgaaaatttttttgtttgagaactaaacatatccttcatatacaacctcaaaagggccgagttatttttttaacgagataggaggggctcggagtttaaaaccccgactctcctttgaccggttttttttttttttttgctttatcccctggtggcgcgcctgacagcgtgcgttcgcgttattgcggcaagttcgtggcgcaaaacctacgcctacgcgtgatacttggtgagtgcacgtacggcttcgctggctcgggagcaggcagcaccgcagcaggcgagcacgtgagcgcctcgtgcccgcacggcgtccgcgttccctcgcgcgcggcaagccacacccgcaccgcacggccgcacgccacgcgcgcgcgcgctgcgagtgcgatggcaatcggcgataagccggtctcgtcgcgttgttccatagattagttttctttccaggctcatccgaacagaagaagctaatcgctaattattggaatctctgaaccgaaacagctaatcatgcagctctctcggtcaatcactcgagcggagatcaacgatttggggggagtgctcacttggagctagcgtacgtgcaaacgtgtccgcgactgcatgcatgattcaggcaagcttcgacttggatcgatctcaagacaggtcatcactcatcaggttgttcaaaatgccggcaaaataaattaaggctgctgcaattctatcatgacaaggactcttcctttttttcccctgaaaagtactgaaacaaatgacgactcggccgaactaattagcatcgcaatcgctgcaaccatggcaatacatagtgcatctgtgtgcatatgggctggttgagtttgatcgatcgatcgactcagctcgatccaacgacgcatgcacttcattctagcttgcgtacatgcagccacctgtatgatctgtatctgtctatgtagctagtgactcaccacttggacagcatgaacctctgcctcccactaccatccgaatatccagtgtgatgaggtgattgttccactcaaatcatatccacgtatatgtccctgtcctttcctttcaccaaaaatcacttatatttgtgcattcgcgatcgatcctactagcttctgccacgatagcacatacacagtcttgcatatgaagagttagctagctactccccgtattttaatgtatgacgtcgttgactttttaaccaacgtttgactattcatcttattcaaattttttatgcaaatacaaaaatagttatgtcatgcttaaataacatttgataataaatcaagtcacaataaaataaataataattacataaattttttaaataagacgaaatgttaaacgtttgttaaaaagtcaacggtgtcatacattaaaatacggagggagtattttaaaagaacatggagaaaaagggctggttatcttaagcttatcttcgtttttctggtcaaggcagctgaggcacatgcttgcattcgtgcatgaatacagcatgcacatgcgtccaccccaatacctaacgaagattattaattaatctgcctctttttgtgtttgtttaaagttatctggtgactggatcccaagttccaactgaaagtcagtcacatttctttttttctaaaaaaaatacaaacgcatatacactcacttgatgaacacacgtgtctacgtcaccaatatattttgagattaatgaagtcataataaatatctcaccgtccgtcgatgtgtacgacgccaatcaattaatgaagtcataataaatatttcgctgtcgatgtgtatgacgccaatcactaaaagaataacgctacgtctaggacttaaatcctaatgaacatgtttattttttttaaaaaaactaactagctgagtattcacaaagtgagtctcgtttttatcagcttgcatgatgattgttgatatgttcatctctccaaattgcacctacatactccctccatactcataaaggaaatcgtttaagacagcgatatggtctacaaaatacaactttgacttcttatttctataaaaatatttattgaaaagtgatatatgtatacttttatgaaagtatttttcaagacaaatctatacatataatttttatattttcaaacttaataacttgagagttattcatgatttatattttcaaggtttggcttaaacattattctaaacgacttcctttataaatatggagggagtaatgcggatcgatgttgttcggatattaatatggtcatacatacatctatctgaaaaacagtatgtatatatgtgtaacttgcataaacagaatactccatgctatatacagtatatgttcaacttcagtcttcagataatgtgattgcgacgcaagggtaagcagactacagaatgcagattaacatatccaggcatgggtggagagcgcgcacgcctcacgccgcctgaatactcaatcattccatcccacaatctgggcgatacataattaaattagtagtatagcggaaagcagatggatacctcgacagcatcctttcggggcatggaagggtcaggcaaccagaaaccagtttgttgcgatctgatgcttcttccattctgggacttgttttatgtttatctctctgaatctgatcaagccctgaaatgtcattgactgcatggtacgtacgtacgcgtcgttggaggtgacagagacctgcaagatcagattatactactactactagattttagtatatattagattataatttgtctcgtctgattaacaatggttttaattaccggaccgatttgctcgatcggtgccacgcgccacacgatttgttttctatgtgcatgcatgaattcgtacggagcccaggcgtaatctcacagttatatatgttaacccaggtggatttcaattgaaagttgcttcaattcaaaagttcaaaacgtgactggaagttattctcgttcagttttaagtttgagctgtcaaacttttagttgcacattgtacacgaatttagggctagttacaagtgtattttgttccattccaaaattacgatttacaaacaagacaaattttgctactggacattaaaaaattgcataatttgctcatagacatcgaaaaaggtgtcatggctaaaagactttaaaaaactgataatttgttagagtacactttcggctcaattgtattgataaattcttaatgatgataagaatgtccctaaagaccacatgctttaaacatgatgttagagtaaaaatttagaaaccacgaaactctaaatttgccatcaccctaagtacatcactagcatacattatattcaatcttagctccagtctcagctcgaagcttttgaccttaggggcattcttgtctttttgaagaattcctctctccaattgagctaaaagtgtccccagcaaattactttttttaaagtgtctttcagccgtgacacgtttttatgatatttaccagtaaattgcacaaattttaagtgttatgtagtaaaatttgcctacaaacaatatatgcttaattttcaagttgggccggaagcgaaagtcattggtgtgtgactgatatacatggtgatgtgtataaatatactcttttgccataaaataaaccaatctaatactagatatgataaatctacaagcgaattataatttgtgccatcttttcatacctactggagtaagttttagtttggaccatatttatctaatatcttcgttttggactatataaatttattttatctttgttaccctttgaactaccctaacgtttttatctagccacatccaatctcttctctaacaaagatgttaactgcacgtcaacagaggatatcatcggtatgatggtgccaatgtgcttgatgctaatgctgtgcttgtgaagatactttgggtggtcaaaacacaaaaatggaaaaaaaaacctaatccaaaataaaaaagattggagaaaaatagataaaggatgatccaatctaaaacttgaggacaaaaacaacaaaaacacaaattcactctaagataatgagaggggctaaagtttaatccctctcgttaccaagcaccacctaaatctttcgtggcatcaagaaaagaattaagagagtgggggcccacaaggccacggtgtccactcgctgttccacctctcatctcattggctacaaatacaagcagcccacagaggcagagagaggagcgcacacagacaagcggaggcgaaaagtggcgcattattttatccgagcgagcgagtcagacgcgcacgcggagcagccgcctccgccgccgccgacgacgaggaggaggatggcgaccccgttggccgacgagggctcgatcgccgccgcggtgatgccgcgctcgccttctccaccggccgccgccgcggggtcggcggccgaggcgccgatgctgatattcgtctacttccacaaggcgatccgcgcggagctggagaggctgcacgccgcggccgtgcgcctcgccacggagcggtccggcgacgtgggggagctcgagaggcggtgccgcttcctcttctccgtctacaggcaccactgcgacgccgaggacgcggtacgtacggggtgaatgccgccgccgcggccgtagcccctctcttactctctcctctctcgcgcgggatcgctgttccggcgttgtttatggtagaattgcggggagtgacaccatgcggtgtgtgttatgcgtgcagaattgggtagtgtgaggctctgggttcggaaatcgtggcattggttggaggatttgggttggatttgtgttgaattgaggtgaaaccaacattatctcaaaatgaatgaagtttgcaggcatggttggttggttgtacaacttagttgtggacacactgttatgttcatgttgatcttctgagatgcatttgcatctacttagccatgtgattgcgaacagtatactgcattgttttttttttatccttttggtgatgtccccatcagtggcctatactgtcttagactgaatatgcaaaagtacatgttaaaatttctgagtcctgaacattatgcaattatgcatcaaagtcacagggtttcatctcggattacatcgttagcttatgttaaccggactagtgtagccaatatgaactgcctactcatgcaaagggtaaattctactctatttaagttccttcagattagtggctgagagtcaggaaccaatgaaggatcccatccattttttattgaagactattccgttccgaacatgaaaagttgaatattgttctgcactgaatgaaaatgaattttgctggagttcacgacagttgctgtggtatttcataggtaaggtagggtattttagttctctttgcatttatgttgtgccagtagtaagcttttcggttctgcactgcaaaactcttctatacataaaggactgcaccagcgtcgtgttgattgtttagaacataacacttactagtttgacttctagctaattctcccccaaacctatagattgatatatttgtgaaacagttccagacctttctcataattcatgatatataactatattgaacgtttggggggcataagatctgtttttttgattgcaggttatctttccagcacttgatattcgagtgaaaaatgtagcaggcacgtattcccttgaacataagggggaaaatgatctgtttgcacacctgttctctctgttaaagcttgatgtgcggaatgatgatggtcttcggagggaactcgcgtcctgtacaggtgcaattcaaacgtttataacccaacatatgtccaaggaagaagagcaggtttccttttcccctgtttactctgttaattcctttgtatgtcatttgtcgaaataagaccaacatgcctttctatttctcatgagcaacaatatgagaggcgctgacatgatgcaatagtctaattgggtgcactagagttctatattagtatattgaaatttatcatatcaagctggcaactgtttgataaaagtatttggaatgatgcttctggatctattttttatttgatatatttaatcttagagataaggggctacataagagaagaatatatagcatctgtagttatgaagagtacagtacaatacagaccatataaagagcaacttcatttctacatttgcttgaaggtgaggccctgtagaaagttatttcttaccaatgttatgcgcttctgcttattggaagtctgctatctatccacttcacaagtacttgcttgctacttggtactcaccatgcaagtagaacgaactatagtgctgactccaattatttatctactctgtgtgtgtgtgtgtgtgtgtgtgtgtgtgtgtgtgtgtgtgtgtgtgtgtgtgtgtgtgtttgtcaaggctttgtaatccagaagccaactgcagaatgcttgagcatatataggctggcatttttttatgctcaccaatttctgtgttctatatatgacacggagctatcttgttatgtgtcttcacttgcatttactgttcaaaactcggctttaagcagtataaggacattgagcttgcattgtatataagctttgattaaagtgtttttaagttttgatagcctagagaactaaatgataagctaaactataaagatcaacattggccgatgatagtttctcaaatgctgcagcaattaatttagaccatgtacttgatgacaattcctcatgcactttttaaaatcatacgtatattattaatcagtatattggtatattatgtgtcctctatcattatcagttcctctcagcatagggcatacagctatacactgttggtgtctaatcatttctgaatgtttcaggtcttcccactgctcattaagaagttttcacatgaagagcaagctgatttagtctggcaattcttatgcagcatccctgtcaatatgatggcagagttccttccatggcttgctacttctgtttcatctgatgagcaccaagatattcttaactgcttacataaaatagttccggacgagaaacttctccaacaggtctcgtgttgatgcatcgttttctatcaataatgttgccatgctttacttaactatagtttcgaaatttgtgaaggttgtatttgcgtggattggaggggaagcagtgaaaacaatatcacatgatttttgtagtccttgttcaaaaagcaatgttagatgcaaggatgctattgatcaaacagacaagtatggatgctcacatgagcactttaaaactggaaagagaaagcgtgcagaatctagttatagtcagcttgttatgcatccaatagatgagattttgtgttggcacaatgctatccgaaaagaattgagcgatatagtagaagaaacaagaaggatccaacaatctggggacttctcggatatatcagactttaatgtgaaacttcaatttattgcggatgtgtgcatcttccacaggtatgtggctctgaatctcaactcatgcgccactttgtttcaaaagcttgcatgtaaacactttcttattcaatgtgcaacataagaattgattagctcttgtttctatcatgttaaacacatttacttcttcagttgtacattacacagcttagaagaacatgagcaatcgagatactgggaagcacaataaatgtgtggtaccagttccctgctataacatattctttgttttatgtggctaatagtagagcttacatcttctttttcaaaagaactggaatttctagaattgtggcacaaatattgattttgccaagcatagtggcctagccgattttatatgttgatctgcagtattgcagaggatcaggttatatttccagcagtcaacgatcaagtgtcctttgagcaggagcacgctgaagaagaacggcggtttaataaatttagatgtttaattgaacaaatccaaataacaggagccagatcaacagcagtggatttttactctgagctatgttcacaagctgatcagataatggagaaaatcgagaggcacttcaaaaatgaggaaacaaaggttagtattttagacataaactctgtagttaaggaggaatgttgtctacttgggtcacgtgaccaatgtagtctaacatgtaattcatctaaatatccaggtacttcctcaagctaggattcatttttcatcagagaaacaaagggaacttttatataagagtctctgtgtcataccgttgaagttattggagcgtgttttaccgtggtttgtatcgaagctgaatgatcaggatgcagaagcttttcttcagaatatgtttttggcaggttattttccaagtttactattttcttctttaaaacaccagttttttttttccaaaaaaaaaaaattctcaacattttactgtttactaatatgttgaactgaacagcaccttcctctgaagctgcattggtcactcttctctctggttgggcatgcaaaggtcgctcaaagggcacctctaactctggaaaattcatatgcttgacaccaagggcactgagcagcccattggatgaaaatgggtttaaagactgccagttatgtccatgttctttacaatcagatatttgttctaggccagccaagaaatggaatgacacagaatctagtaacataagcaactgctcacaaacggctgatatagcattgacatgtaaaaacagaccttgtcacattcctgggttaagggtagaaattagcaatcttgctgtcaattcgtttgcttctgcagagtccttccgatcgctgtctctcaattattctgctccttcattgtattcaagtcttttttcatgggagacagatgcagccttttctggcccagataacatttcaaggccaattgacacaatattcaaatttcataaggcaattcgcaaagatttggagttcttagatgtggaatctagaaagctcatagatggggatgaatcttcccttcgccaattcatcggaaggtttcgtttactgtggggtctttatagagcacacagcaatgctgaagatgaaattgtatttcctgctcttgaatcgaaagagacactgcacaatgtcagccactcatatactcttgaccacaagcaggaagaagaattatttaaagatatatccactattctttttgagctttcacaattgcatgctgatttgaagcatcctcttggtggtgctgatgcagttggagcgaaccacattcatccatataataggatcgattggtccaaaaagaataatgaacttttgacaaagcttcaaggaatgtgcaagtctatccgggttactctgtctaatcatgtccatagagaagaacttgaattgtggccactatttgataaacatttttctgtagaggagcaggataagattgtaggccgtataattggaagtacaggagctgaggttctgcagtcaatgttaccctgggttacatcagcgcttagtctagatgaacagaacaatatgctggacacatggaggcaagtaactaagaatacaatgtttgatgaatggctaaatgaatggtggaagagatcacctacttcttctggcccttcaagcgatgcctcccatccagaaggtctgctcaattaatttccatcccatctcccctcttcaaccacttccaccatattttagtttgctatgttatgtaggcactcactgttttccatttcataaaattgtgtcaaagctatatccttttccccattgaagaaacttctatcgaggcccacttgttatatattgtgttagataaaggtgttatcccttacaatggttatcaacaaataagattggccttctaatgagcaacatataaacttcatacattggttagtttctgtgttatctgaataaaaattatcactaattggacaaatgtagttggccaaaaggaaattcgggaaatgttcaaaagcaaagaagctgtaaaattatatccatgtatttgttgatatgtgataagtgataacaccatgacaacgaggacttcccaattgatgactaatttcaactgtcctagctagcgatagtgcaaatctattatgatgtaaatttgtgataaaagagatttagtgaagttggacttagcataaaggaaggtagaatggtgttagaagagagaaaagtagtgggtctgggatgtatatttatgataaaagattaagcactacagttttcatgatcagattttgaattatcttaactcttgttctttgctttggcctgtagaagatcatttccaggaaaagttcgatcagagtgaacagatgtttaagcctggttggaaggacatcttccgaatgaaccagagtgagcttgaggctgagatacgaaaggtttctcgtgattctactcttgacccaaggaggaaggcttatctaatccaaaatctcatgaccaggtttcttatatgaaattttcagaaaacaattttaggatcttttcctactgttcctccactacaatataggaagttattttgaatgactattgttttgctaattatattttttcagccgctggatagctgctcagcagaaatcgccccaacctcagtcagaagatcgcaatggatgtacagtattacctggatgttgtccttcataccgagatccagagaatcagatttttggctgtgagcattacaaaaggaaatgcaaacttgttgctgcatgctgcaataaactgttcacatgcaggttttgtcatgataaagttagtgaccatacaatggaaaggtaaactcagtgcaaccatgttgtctatttttttgagatttactgccaatgatacttctgtattggtcgcagtagtaatgtgttcaatattcatttttaaacaccaaacaacagacatcaataagcatgcagtggttaaagatttaactacagttagagaaccttgtgataaatttatatctgtgcaaaacagtgaggcagaatgattattttaggcatgacttgtggcctttgtattgtccctttcgttcttctcttcatctgttgttttcctcccaagtaaatgtttggttgaaatgatgcgatggcccaaaaagttgtccaatatgaacttttccgtctttagttttttaatcgctgtatttgcatgataggtgtatacagagttttaagaacatgtgagagaggataggaggcagaaactctcctgttttctatcatattatgtgttggttgttatagctttgttataatataaaatgctaaatgatattgctaagtctggggagctgatatgtcaggaaagcaacggtggaaatgatgtgcatgcaatgcctgaaagttcaaccagttggtccaaattgccagaccccttcttgcaatgggctatccatggcaaagtattattgcagcgtatgcaagttttttgacgatgaaaggtaaaaaaaaaaaaaggacgtggttgctagttttgctaactcgggagattgatggggtccaactttgcaatgttttggtgaccacgctaatagtgaatcttttttcaggagtgtgtaccattgccccttttgcaatttgtgtcgtcttgggcaaggattgggtattgattttttccattgcatgaagtgcaactgttgcctgggcatgaaattgatagagcataaatgtcgagaaaagatgctagagatgaattgcccaatctgctgcgacttcctatttacatcgagtgcagcagttaaaggtctaccttgtggccatttcatgcattcagcttgctttcaggtacaataatctagtcgcattctgatgcatggtttcttgagcgatatctcttactgtgagtagtgctgttctgacaagtttgtaaatttcaggcgtacacctgtagtcactacacctgcccaatctgctctaaatccttgggagatatgacagtaagctacaccacttaaataacattttttttcattcaccatagattatattttctccaactccatatttttaccatacacagaacagcttgtaaaaaattccgttcttctgattcagtagtgcagttaatgtatgttctttaaatcgcgtttctctgcaggtatactttggcatgcttgatggcttgctggccgcagaagagcttcctgaggaataccgggaccggtgccaggtaaattattctcctattcctagttaaaaaaatttcagtggctggggtataccgtttgatatgattgattgttccaggatatactttgtaacgattgtgaaagaaaaggaaggtctcggttccattggctgtatcacaaatgcggcttctgcggttcatataacactagagttatcaagattgatagagctgattgttcaacatcagattaaccaggcgagattttccctctcatattcgaaattccttttgaatatatatattgttgtaaatatacatcaacttaaagaaatccatgcgtcatgcgtgctcttgtgtgttgctgcgattaacaagtcataggagatgctaatggtgggcgcttatgaaattgtgtcacagtctaaggtgcgcacaatctctagtttaatattcggggatgtttggtaaattggtagagctttcagcttccggggccaaattctttagagaatcaagagaagcccaaccaaatgggcacaaagggtgttagttcccaggggattggtggcatgtggggcaacaaaattgttggtacccaaatatggaagtgaccactgaggctcctttgaaatgcagggatggtaaaacatgaatagaaaaaaatagactgcaacaaatgaaaagtacatgaatgattatttggctagagcttgaaaaggaatgggataagagagatggatgcaaaggaaattttgtaagagatttaacttgtgctaactctcctctaaaatctctatgggcctcatcgtttggcatattcatatgcttatcagccaaaatttgaattttcaacgttaaatttagagctgattttagggttttttcatcgaagtttatttttcagcctttgcttttagatcgctaagaacacatatataaaagttttattcacaaattgattttcgtttgtaaatatgccatttggcatattcagaaaatatgccaaccgatgcggctgtatgcatctttgttatcaattctaaagaaatttcatgggtgtcaactgtcaatcctttgttccagagtaaaaaaaaacaacaacaaatcatttagaattcaatcgctgcataaacatgaacagctgggatagattccttgtgcgcaaaccttcccacttggttaaaactaaagtcgcgtacggcaacgagccgatccgcatcggcccagccggtcttggaccccccaccgccgtggcacgggcaatcagcacgcgatcaccgattggatgcattggcatcagccgccactggatcgcgttagcgcgcggtgggcacccactgcccagcccatcatgcatcatcgcatctggccgccaggcacggccgcacggtacgtacaggccgcctttgtcatcttcacgtgtaagcgtcgcgtcgcgtggcgcctagcctggcgcctcagtgatcgccccctcacggcctcactcggtcactcccggtcaacccccacggcaatctcatccctcgcctttgtcaccgcacgcaacgcacacggcaaaaatgaccaaacttgtaacatataatttcaccatattgctacgaaatcatcatcatcacgtcacaaacgcctcaacatatccatcccgatctcggccaccagctcttggagcagatcccgttcgatctgggcaccaatctcaaacgcctcgtgcaggacatccacgccgatctccacccccgagtgctggacgtcgctcgcgatcagctcatccacctccttcccggccatgccgctgcacctcgcgatctccctgtccacctgagcagccagcctctcctcggggcagatcaggggaaccctcgagaacgacctgtatcctgagtcgcagaactgggtgaacagcgagtccaagcactccatgacggaatcgaacgcgaggcttcccagcgggctcctgctcttctccccttctgtggccttgacgacgccggcgttgaagctgaacccgttcttcttcttcttcttcttcttcgtggagcttgtggtggtcacggtggtcagagcagactcgaatgtcttgacaaggaacgccttgaatggtgcctttgatgtccgtggaggagtagtagaagtagaccggcgaacgtttgttagtagcagctcaacagttgctgcaacctctccagggtgtatcaggttgctgctgtcttggccaaaattagtttcagagcacctggagtttcttttgttagttccatcttgttgcattgtgcaattctccgagcggcgtcggtctctgaatccagcttctgatgctggcagtggttggaaaagcatgaaagggtcagcatgcaactaaaaaaactgtgacttaactatacgatttttttgtgtttatagtgttttgtcacaagagatcgtagtaacaaactacttgtaaacaacctaaccaacaattagtcaatgcacttaaacaaaggtcccttacctgcagttttgagcaggctcccagaaaagcactcatcatctgcataataagatggatcgctagcatttgtagtaacctgcagatgatgacagccaaagatattcatcagagaagaatgacccttgcagttttgatgagaattaactcggtattgcaccatgatagagaacaggaaaaaccaaaattactgacctcatgctttttatgagtttcacgcaatttaccacttctaggaacctctctgaagccaaaagtcagactgtccagaaagttacactgccatagaaattcatcacttggagattcttccattacattgatagcactcgtctttcgaaacaatgaagacattactctgtcgtccagaatttctctgtttctcaactcatttcgattaaagcacactgattctgcactttccagacttgatatgccttgtaaagcttcactcaagaccaattccctttctgaagaaatattttggcagtccctacgatagtctctcttaggacaagaaccagttggagatcccagaacaacactatctgatcctttagtatgaccattcagcaaagcgaggacagcctttctcggtgaattagaagagatggaaatgatgcctgagttgttacccctagaagcaatgcgtgactctacctttctccgcgagtcattccttacagagtttggactggtagactttggcttctcactaactaaccctgcaccttttgcaattatcatgtctttctctgtagctttcagtgttgcagtctttgatatctgtttattagaacaatcaccatgcaggccactggttcggtgacattttgtgctcaagttcctgttctccgcactaccatgtggcatgccgattttatcctttacttttcctttggacctcaaagatgcactgttgttcatacctctgtttgaacagacaaagtcattggctgtgtttgccacattttgctccttagctctatgtttctgcctttggaccatatgccctgtatctgctgctctataagtttcaggcaatgcattctgcttcagattgttctgtttaagaggtctacaatcaacattctctcgggatatgtttttcggctgtattttttggacaccttgacttgaaacaaggacatcatctgatgttctctgaccactgtccttaaatccgttcctctgacccttatggtttccttcagattgtgcttgacatgatatgttctggtttggcctcctaacagaaacattcctcatagtatcctcttcggaccactgattggaagtagaattgtgcagagaggtggctcctacattttgagcacctgaccttgatgcatcaacatcacacatttctcttgcgaattgatcggagaaatcgtgcatggcttcagcagcactctgcacatcactgctgttgcatctatactcgaggcgcgcttgcctccgagcctgatggtggtgcctggattgtaaaccgggttccaggaccttgactgctgcttcaatcagcctaaccttgttcctgcttgaaactgatcttggactcttaataggtgaggctaacttgtgtgctgcatgcttccgtgaccacaccggctgcgcatctgcatcgagctgattgccattgtcatgccggccatctctgatatgccctggcttttgttgcttctgatgcgagttgtatatgcttccataggagcattcactccggtgaccaccaagctcggaggcatccatggtttttactgccttttgatggctggtggctggcattgcgctgagccccattagcctggctaccacacccggtgtgcacatttcactgcttttgttgtcttggccaggaggtggcaagcgagtggtaacttcatttggatagtatggagcatcaagctgaaggaaaatagtacaaggtgagccagcaacttagcattctaaaaataaataacaaaggtgaaaaggaggtaaaaagggatcaagaaatgttaatgtaaagctaaagctaaagtgttaaaaactccatttctgaaaaggcaccggaaaaactttcctaggtcaagaaagctaagaaatctgaatgtaaagctaattgtttaactgatttttttaacaagagaaaaaaaagaggcttcatagcacaaaatattggcttaaaggggaagaaaaaagagagcttttttgggcatattctttggaaaattcaactagatctcataaagaatcaacaaacaattgtagctttacaacgagatgctaaaagaaaaggagaaaagtaccataccagcagagtcctcatcttggccgccggcgtcttctcgccgccggcaggtggtctcccaggcgagaacttctgtgtgcgcactgaaacagaaatggcagtacaatccattcagaaaaaaaccagaaatggttcaaaagccaattgaacacatctgatttgcacaatccaggaagaagaataataagaagaagaagcctgaacagtgtactactaccatccttgcaatctcacctgggggaagcagcttggtcttcttggaggacgaggagaagagcttcttcttggcgagcatctggaacagcgacgccacgcacgacgtcgccggcttctgccgctcgacgatcgccaggctgttgccgccgccgccgctcgccgcggtggcggagctgccgcctttcatgcctccaccgctccacacgcacacgcccacaagaacaagaaattcaaactcaaaaatctttcaaagcctcttcttgcttcccctctctctatctctctctctctctcttgccgtttcttatgagcgaataaatgcaacaaatcctggaaaaccagtcgcttcaactctttctccggataggcattaattgccacatcaaattcttcatgactttgcgacaatgcctttgcagcaacaacagctcgagaaagaactatggcttatggccaaatgctagagaacaaaaaggagaagactactgtggcagcagcactccaactcttgctcaagacatgactaatgcatgccattattcctcttcctacacatagaaccggaatggatcaacactcatcctgaatgttcttgtatctactcctgtttgtgaactcttctaaaaaatgaaatgctataataaaccttgagaagaaaatatttggggatgaatctagagcaagtgggcgatgactggatgagccaaatggtggagttggagactggggaggagggggtccgggagaaaaagagaggggcttttgggtggcaatcggagaggaagagacatctcaagctgcttttgtttcttttttttttatgtgtatgtcatgggtagctggctggctggctgtgccaggttttctcggctttctttgctgatctctccttttttgtttgcttccttggccgtctagctgtacttttagggttcttcttggagtttgcactttggagtttggactggtctaatcggaagtgattagtattagtactcctgtaaaaaaaagataatgtaaattttagagacgaacctagataatttatctttagaagttactccctccattaaaaaaaaaagtaaatctagtactggatgtgacatattttgtataatggatttggacatatgtatgtccagatttgttgtattaggatgtgtcacatctagtacattggttttttataggattgagggagtagctttttctaatacagagggagtatcctcgataccgtttcatatgaatcttccaagtatttttttagaaatatgaaaaaaaaatccatatctcacaacggcccctaaaagtctaagatgaacgagtaaagaaactatacattttttgtggaaaaattctgcttggagtagttgcccactttcatttcctagctgtcattgttggtatgtttgattgtatacggctgaggctaagtagattctaagcaagaaaaagggaaataatgttgctgtcttgttggatggtaacagtagttgcacgaccagattgtaacattctacttaccaaaacaaggcaatctctgtatagtacttaattagaatcaccgtgtctattatctagcactcccagattcaggctttgtactgacagagctggtgtatctaccttttggttgatgtttagttgtggggtcaaagcaaagagaagcaaggttgttgcatacgggcagctcaagtaaactgaagtagaaagtctagtatactttgtactccctccattcaaaaaaccttaattcctgggtttccgtgtctaacatttgaccgtccgtcttatttaaaaaaattataaaaaaattaaaaagataagtcatacataaagtattatttatgttttatcatctaacaataataaaaatactaattataaaaaaatcatataagacggacggtcaaatgttggatatgaaaacccaagaattgagtctttttggacggagggagtactgctgattaggacaaggtgacatttggacagtttcacagtattgttttctccttctgtccgtcagtttgaaatggatggtactcctaatctacatatatgacccagacaagtgttacacttttcaaatgcgcctagtgtttcgtaatggcagatttagtacgatatcttgagactctagcgtcaaattgtacaagacaacaaagaagaagctgacattttttagttatgagacggctgaacttgagtgctgagcccactagtatacttgtaaatcaaatctgcaagtggacaaatacaaaagatttcaagaccagttagtcaaatgcaaccgtatcaataaatttttaagtcttatggaaggacattcttgggtatatcgttgactgctagagctattcttggacattcttggagtaagtagcaaagattagctcctaaattgccattcagttcatcaaagcgtaaaccgcactccggaaggaggaaacactatctcacgtgattcgagaaatttccactcggctataaaaaaaatcgtggcttattcaataaacctgataaaagttggcttattgtactgtgacacggtattaacaaattattattcaataaacctgataaaagattgcaagagcatatgatgatattcatgtcaattaccacctagttgttgatcgttggtaaatttagttcatgttctttcttatgttgttttcgacatcgatacaatctataatacatatgtttgattattattattttcctaattacatatttgcaaaaataataaaacatttataaccttgtggaagtggttttcatgataaatctattaacatcctttttacatattaaattttaatattttaaatgtataactccctcaattctataatataaggtataaccatttttttcaggtgttttgtaatataagacgtgcatgtatgccttcaattaattaacacatcttctccagttccactatattattattatttttaaatccttcaccctcaagatatctaattctattagatgcatgcattatatttattaggatgatccaaactagaagatgataataattgtttattgatttttaggttaagggtagttgtgtcttatattttaaaatgggggagtaatggtttattaagaatctaaggtttgacttcacgggttgcatcatcatctactccctccgtcctaaaaaaagacaaaccccggtttccgtgtccaacgtttgaccgtccgtcttatttgaaaaaaatatgaaaaaaattaaaaagataaatcacgcataaagtattaatcatgttttatcatataaaaacaatgaaaatactaattataaaaaaattcatattagacggatagtcaaacgttggcacgagaacccacggtttgtcttttttttttttggacggagggagtaactaataacacgtcatatttcagtttgactaatatgcctgctggaaaggctaagctctcccacggccccacccgtccagttccaggctctcagagatcactcatcctaacagcaaaattgaatcaactgtactatctcgggatatacctaccgggagatgtatatcccagcctctctcggatccttatcccagttgcagcaaagcgtacaaaaagagtaccacgtaccattaagtactccacagtggaatgaggcaaacaaacagcctggccaaacagaggacctccaacactcgccatggtcccagagcaccaacactcctcctttacaggcccaccttcagtctgacctgcagatacgagcaaactgttcctctgtgccatatccatggaccatccaaaggtacgcggtagttctgcaaaaagaaatgctactggagtagtagtaaaagtaaaaaccactaagactattttttctcaaatatatctcatattaatatttacctattcaaaaccacatcattacaagtacttttatactacgcgatgtgccattttctacacactggacactattggacccacgtgcaagcatgtacccctgaaaatcaatcatatctacgaaactggacacacgtgcgttcagattcatagctagaaattcttttttttttatagagtagtatttttctatcacccaaaataccccgctacgtatcttgtctctcacctcattgatatgtgagccttacatgtcatcccaactcaatcatctcctacagtaaggtagcggcatcctcattggatgacacactcatggcgagatacatgctcccttgcagatggaagacagacgggaatggacacaagacgggcgagaatggtgaggtccgccaccactagcgtaacatgtttcctcgggcaactaccgcacgacaagtgcgatggtgacttcgtcagcctgttccccgctacggctctcatcgctcggactcacttgatgttggctcgctcaccgtctacctcatgccatgatggtcatggatctatcgccgtggttgtctccctcgacgttggtttgtccatcgtcccgtttcccgttgctcttgctctgcctctccaacgtggatctatttgtaaaatatttttttttgaaaatggccaaaatataagtatttttttatataaatagatctttggtgccaaagtagttggcgtcgaggaactatttataaggaaaaaatatttatatgttggctcttttttaaaaaaaatatttacaaataggatctcgttgtcaatctttttttgcgctgacccctctatattttgtttgctggggatgtaagggtgttggtgctagtgtcgttgtgtcgttggtttagagacgttgaactttaacaacaacataaaaaaaagggtatattcttaaaataagtttatctatggatccatttataaaataagttttgaaaaggggccataatataaaaaatctaggccgttttggcgacgaggaaaaaagacgtgttttgagttgcgaattttgtatgtgatcaggaagcagaattattgcttttgtacttgcagaaattcattttttgcagaaaaaaaatggagttgtggccggtcagcttaaattggatgggcacttgtcttgaaggcgatagtacgcgatacggttggctttattgtccgcgctgcgttgaattgacactactgactcgcatgtttaggcattgaagtgactgaaaactagggatagttagagcatgtataataacagactattagcaagctataaacatattttaataatataagcgatgagagagaagagcagcggtctacagatctatagccaactgcagcacggactccaaaacacaatgtgtgtatgataggtgagaccatatattaatagtatagtaagtggctattgtatgaattagctattagattagttataaataaattaaaaccggtagtaagactatactattaaacttgctcttagtgcacattcctttaccgctgcaagagtttctctgtcacccttcgtactcctgtgcgtagattgtgctcaagtgtccattgtccgcaatctgcatgcaaagtcctgtccaaatttctccgataaacagaaagttcattttaacccctcaattattcgttctgtctgagacacaccctcaaactctaaactaggtagaccatactcttatcaaggaatgtgttcttttctcttgaagataaagataaatatgaagattaaggctgctttcgttctaccttcttcccaactccctctatcttgttttccgtgcgcacgtttcccaaattgctaaattgtgttttttttttgcaaaaagtttatatataaaagttattttaaaaaaattcatactaatctatttttttaaaaaatattaaatattaaattaatcatgagaaaatgtgtcgcttcgttttccgtgcggaggggaggggttcccccaataaacacaacctaagtattttatgtaaaatgaggcggattaacatataattaattgagttttaattattccaatacagttccgttgaccccactctcctctctctggtttttttcttaagttatgctgatgtggtgatttaatcaagcaaaaaataaataattggacccacatatgagctgctaacctgccatctatctcccaccctatctctctttcccttcatttttttcttcgtgagatgagcttgacgctagcaaagagtcgtggaaccatggtccccactgtaccaagagtgctcggcactaacgtgaagggttgagaccattattcacggtggtgcattggacatggtcggatggcttaaaatgtaatatgaaaatgtgatattataaaagttagtcaacatagcagaataacgattaaactttccgattgctttggtcattaatcattcaagacatgccaaatgatgacacagaggcacacgatatttcttaacgaagttcagtcgaaacctacaccttcgaagctttgattatgaacgtttctccccaaccaacatagcacctagccactacgagtacttagtatcgctaccatcttatctcagcgtgtctgcagtatattgtagtcgtcatggttgtattactctaacttcacttcctatcacttattataactttgaatttacttattatgtataactgccttgtactctcaaaaccggacggaaagaaagcactatttcactgaactagatacccttaacggcaacaagcaacagcatgtgcacacacgaaacgacctgcccgtgcgatggaaaaaaaataaacaaaagaaaacaagcaaagaaaattaaggatcgtacgaatgcagttgagtcagttgacacctgcccggacgaccggacgcctacgccacagggcagccacttgtgctttgcattgcttcgcaatatcgcatccatccaacggtgtcaggcagcagcagcagccgcaccggcgagaaattccgccagtgtcggtgggcgcttttggcccccggaccaacaccaactgatgatgatcaggtcaaagcttagccaagaatgagatgattggctctgctgccggcaccgccatggacaagagaaacgtaagagcaagtttaattaatagtacggcctactactagctccaaatcatttatagccaatataatagccaatttatacaatagttacttactacattattaatatctggtctcacctgtcatacacacataatgttttggagtccgtgctgcagctgactacagatttatagcccgctgctcttatctttcttcctttatctctttaaaactctaagtcgaagtagaccccggtcgccgttcccaaaaaatcaggctctgttttgaaagagggtctttttcataataattggcacacacacctgcaaagtgcgagtgatctgggcgtgcacccgtttcggaggtgtggatttggttgcgagatggtgaccggacaaccgagggagtgtggttgtggtccagtgaaatgaaaaactgacaaagtgacatggatggtaatggtatgcggctcaagtggcagaattgctaagggaagcttctggcccaaggtccaaaatgctgggctatagttttgggtgttctatggcccgttttctaacaaaaagaacactgatgttcaggacacatttagtggaatatgtccactctgactccctcaaatatagctccaatctgattcatacagttgaactgtaaaaccggatatctgactcatcatgaaagaaaaaggaaagaataaagaatgagagaagaagaaaatgtgacattgatatgtgggtcccacatgcttagttggactattttttctaattaagaaatcaattttaatccgattttcgttagcattatttttaaactgctagatggtttttttttgtgtgaaatctctttatatatgttactttataaatccagttttcaagtttaaaacaatcgtgcgctaatagcttttgttttttacgtgttccgactttatcttcatcttgagtgaacttaagctgggctcaatcacgagacgaatccctagccctaatcactatcatatatagtagtactccacttaagtaagtacatactccttcctcagattcacattttattccaaaatagttgttatattggagtactaattgtcttatcaatcactttcaattcaaatctctctcttttctactgtcaaccgcgctcatatatccaaccatacagtatttaatagatgatactatactattttccctcaaactttaatctatgccaattaacctagaacgataagtaatatgggagggagtactacagaattttgaaggcataaaagctctcacagcccccctggattcttggcagaatctgccacccctggaactctaccgaacagcaccatagcttgacattgatggttgatgcagctccactaaaaaatccacggactcgcgtgttttttttttattttgaacgaatcgaccaggccgtcaatctattatattattaaattaatagaaaaaggagcctccacgttcgctctcatggcctaaaaattctcacattaatcggagaaaaacaagcagagtccatataaaaatacaatttagaaatagctgaaattcggaattaaaaataaggaatattagaagaggagactagagtccatatagaaattttcggaattaaaaataagtaatattagaagaggagactagagtccatatagaaatataatttagaaatagctgaaatccggaattaaaaataagaaatattagaagaggagactagagtccatatagaaattttcggaattaaaaataaggaatattagaagaggagactagagtccatatagaaatacaattaggaaataactaaaattcggaattaaaaataaggaatactagaaaaaatgcccgtgcgttgcaacgggtgaaatctattttaattttattatttttatatggtttagttaagataaaattcattgttggagttcgcttggatatatatatttttagaaaatcatgagctgcagttaggagtccgaccgtctcaagttggcatgcgagtttttttaaacatacttcttatatgatttcttctgtattaccaaaagtgaacgatattaaaaaccgactcaggatatgtatttcgaaaagcaaatgaatttaaaaaacgactcatacacggatgacgtaacataataccggcaaaaacatatttaatttttataatagtagagatggaaaatttgggtgatacggatacgatcgatctgagaaaaattattggaagcgatctggagacggagtcggacaaaaaaaaagggctattggtgcgatctgagaaagaaaaaaaccgtgcgctattgggagtcagacaaaaaaattgtgcgctaaaaaaacaaaaaaaccgtgcgctattggggagtcagacaaaaaaattgtgcgctaaaaaaacaaaaaaaccgtgcgctattggggagtcagacaaaaaaattgtgcgctaaaaaaacaaaaaaaccgtgcgctatttccaattgggggcgacgcacgaatttttttttggggagacaagaaaaaaccgtgcgctaaaaaaaccgtgcgaaaaaaagaatacgctatttccaattggggacgatgtacgcaattttttttgacaaaaacaccttgaatttttataataggctagaaaaaagtacttgtacgttgcaaaaggttgaagcaattttaatcttaaatattactcacagtctacaagatatcctacttaaaaaaggaagctcgagattgatcaaggagctggccattatttgcctgatgaaaataggagctttgctatgattttgcatccatgtaaaacctatacacatcatgcgttgataacagccagttaggtagttcagtattgatgtttataatctcatcgttgtcccttgaaccagactgaaacggattacggattctatgtatgcatggtgcggtcgacataggaaggtccggcccgtcttagctcacgtcgtctaccgcagcagtaaagaccgtgcgagatacggaagaaggaaataaatcaggctatgcggattttcttcgcgcagagacgacgtccgattgacgacgtactaaaatttgagacaaaaacaccttaaatttttataatagtagagattagaagtagattatagggtccatatagaaatacaatcaggaaataataaaaattcagaattaaaaataaggaatattagaagtagagtatagagtccatataggaatttaaaactaactaaaattcggaataaacataataaaattaaaagtagagtttagagtccgtataaaaatataatttacaaataactaaaattcgaaattaagaaaaacatgggaataagagtttaaagtcaatatatgaatacaatttagaagtaactgaaattaaaaattaaaaattaaagaatattgaaagatgagtttagagtccacatagaactacaattagaaataataaaaaataatattggaagaagagcatagagtctatatagaaatacaatttacagaaaattcagaattaaaaaaagaaatattaaaagacgagtctagagtctatataggaatatatataatttacaaataactaaaatttgatattaaaaataattaataactaacacctatataaaatgcaatatgaatattacacattagtaatttcgtaaagttattgcaaaatttaaaattatgttgtcatacataatatatttgaataatataatgagaaaacatatatgttattatataagagaaaatacaatgatgttagcggcgcaatctgcgcgggccatcatgctagtttcattgaatagaggagacgaaaactgtaaaaaaggataaagtacagaaaacaaaaaaaacctagggccgtggccctaactataggcggcgagatttttttgcacccgctaacccccatgtttttgcttcctcctttatctttatcttggctagcaaagttagcaccagcaactccttgtgttggaaagtcctccggttcctttcgttccatatctcccagttgacaagcaaggctaacatgcgtagtgccttcttaggtgcttctcgtatgcttacggtggcctcccaccactcatgtaccgtcaaaaatatttgccagttagaaggtcttagatgttcatagtctgtccactgcgcgatttcattccagattctccttgtgtatctgcattccgcaagcaagtggagagctgtctcttgagtctggcgacataaagggcatgtggatccgttgggccagcctctggttgctagtctgtctgatgtccacactctgttttggagtatcagccaggcaaaggtcttgcacttgcatggtgcccaaggcctccatatcaatgtgtcaaaatttgacgatgttgtacccaacagctgcgccttataggctgaggtggctgtgtattcgccgtggttgttgagcttccaggtgatctggtcttcatgttccgtgaagtgtacattccgaacggcgctccaaatagtgatgagctcgtcaatcagatccgttgtccatccttcgtttgttggtagagcaaggtcgtgcagccattggtatgctaaagcggcatgtttgagggacctgctctttttcctagaggccgcgtggactagcggtgcgacatccttcaatcttctcccttggactcacgtgttggggatcagagaacttcgggtgtgtttagtttatatcaaaattggaagtttggttgaaattgaaacgatgtgatggaaaaattggaagtttgtgtgtagaaaagttttcatgtaatgaaaaagttgaaagttttaaaaaatattttggaactaaacacggcgtccatgttgagttgagctccgtttcgtttccttctcacagctcgggggcagccgcagcgcgtgtgatgctgatgccacgcaacggcgcgaacacagccaaagccaagccgcgtagccgcttgattaacagtgcagtgcaggcaaggggtaaaaatcgagaaaattgacatttagccattctcagggtggggtttcgccagaatgccatcgccaaatgtggcttcgttataatgccatcttcaaacgaccccatcttgccatactgccatttcaaccaattttgattatttgcaaatattttccactgttttgcttatttggtttgacccaaatgcccttgcctcagccgtggggcccacttgccaggagcgtcttccacctccgtccgccaccatccttccctctctccggtgaactcatgccccaaattgacctccctcctcggttgctctcgccccaaattaaatgcaaaaatcggttcctctcgtcctcctcatcaattcccccaacaaatcccactcaaatcggcttaactcagtggtggattttgaagtccctcttcaatggcgagctccaccatagccagcgtcgatctctctccccgacgaggttggagcgggcaagcggctggacgccgtggagtggagctggctacggctgcacgcgcgagcaggttgcctcgacgaggagctccgccgcgagtcgctgcccacgtcgaggagctcatcggagaaggaagtgacgccgtggcgcgcggtcaggtcgagcgcttggtgcgccacgccgccgagccgaaccgtcgtcctcgtccacgccgacgccttccccgttcccagtcgcgccgccgtgccgccttccccgttcccggtcaccatcgccaccgccggaaacctacgcgcgaacccggtgagctacgccgtcgagctggtgagggcgccgaagggcggcgtcggtgccatccccggcgtggccagctttctcatcccgtagcggttcagcgaaggtcctgagctgcgccggcgccgcccaccatctgcaacgaagagagcaagaggtaggagaagagagatgagataggatccaagggtattttggtcatctcaacaagaaaaaatcattaaactgagaagaaatggatgaaatgacattgtaacatgttgcccctgtttgagggtgacattttaacgaaaccacttttgggagtgtcattccagcgaaaccccgttttgacagtggcaaaatgtcaattttctcgtaaaaatcaccaaaattatcgatatttggttacgagcttggtggctcgacgacgtttgaaagcgaggcgatgcgatggcgtccgcgtctcgtttctttctttgggcccagcttggccacgtacgtcgtacgtatcgcgacgtacgacacagtgcagccgcaaaaaggcctccgcatcggcagggcccaagtgtaaaacgtgctttcggtgcgccatcatacggcacgcggtacggtacaaacagcgaattccatgtaccgaagtaatttgctgttgtatagcttggacaatttgttaggatttaccaggtactacctccatattttaatatatggcgccgttgacttttttccaacgtttgactattcgtcttatttaaaaaaattatgtaattatcatttttttactgtgactcatcatccaatattctttaagcatgacataaatattttcatatttgcaccaaaattttaaataaaacgaatggtcaaacgttagtcgaaaagtcaacggcgtcgtacattaaaatacggagagagtacgtaatttgttagaccggatagatttatatcattggaaaaaaaaaggagatgtgttaagatggcactccaagtggtgcttcaggtggcttaaaaaaagctactactcaccagcggctaaatcatattttcactggtggccaaaggtaagtgaaaatagagtattttcacaagcaaggattagccacttgcaaaaatatattttcggaaagtctaaaaaactgtcgacacatttttctttagaaatatgtcgatttctgatccattagatcaactgtaggattcgtgctattttggttgacgaaaataaaattgtactgtaaagaatcgaacctaggatctgacttgtccagcggccctgaccaactgatcgagcaaagattttggcttgaattgaaattacatactaattacacttaaattacatactatttacatatgtaatttagaaacttacattgtaaatacactaaaattacatatgtaatttagagacttacatatgtaattttaggacttacattataaatacactaaaattatatatgtaatttatggacttacaatataaatacatactgactattttttggtaaaaaatatagcgccataaatatagctactccctatattttttactgacaggtatctaaaaagcaacatttgccaaaatcaatattaacagacgaaatgcttaacccacctgcgacacaaaatatttttggcacgaaaaaaaatcagcaaatcctccaaaatcccctaccacccataatccattcaccaatcacaacttccatcacaaacctcataatccattcaacaaattcattaacaaactttataatccatttacaaattacaaattcatcacaaagagtgatcagagagaggatctcggaaaaattcattgccgaaaatcagtagaagagggaggaaggtgttcaaattttgctttttcacaattaagcacacgagcaggttttttttgacaactttattgactgcctgccaagagagtagtatacaaactgtctattctttttgaaggaatggaaatatggaatgatgtatgaatacgcacgcttcttaggctcttaaacgatgttttttataattttttttatataaatgaattcttatgaaaatgttttaaatctaattttcaactttgtaatatttaatttattcatcccactcaaatattccaaatcattcatcaatttaaccacattggaaaaaaatgaataggggccaatttggccaagaatcaaaaaacaaagtgaaggcatgcaaaaaagttgaccggcatatatcggccgtccgatctgcgatgaacggttgctaagccgacctcgagccgtcagacccacattagggcgctctctgcagtttgaatcgcatggacgctcctattattccggggtgggcctggatgcagcctcaaaagcctgcgttggtcgtgcaggccgagcaaactgccacttacaagcgggcccatctcccccttcccggccaggcctgcacgtatctcttcctcctgccattcacgtaccggcttaaccctgacacgtgggcccgacaacatcgtgccacaaagtacacatcctgattcccttttaatggggcataatgttgcgtttaaactcgatcgatcgatcgatcgaccatgtatataactatatgtgtacggactcgagtatacattcatgcatgtacatgtgcgtttttgtacgatgtgacagtgagcgaaaggccggtctgatcgttcggcctatagcagcaactaaaattaatttatatgtaaacattttatatctacgtacttaattgcttaattgcctatagtaccagtctgtattatattataagatgttttgattttctcctaagtaaaaaagacaataccaccaacattttgaacccaaaataaacatattatcaaaatatatttaatattagatttagtgaaactaatttgtattatagatgttattaatttttttataaacttaatcataactaaaatggtttgattagaaaagatgtcaaagcgtattataagtatgaaactgagggaataacgttgaaaatcaacaaataatgataacagatttaaagtaagtttaaaattaagttttaaaatttaatactattttttttgtggctgataagttaaaaggcaaaacatggaggcgtctcttgacctaggatgtcaacaaagacaaataatagcatcgctagatagcagtgctggaagtaggcaccaatagctcgatgattgcatcagaaagagcgatgctaaaggctttccctaatccctttcttttcgagcggcctatgctaactaataatgtacataacgcaaagctaatttcgctccacttgaaatgctacagtctgcaatgatagcgttgctcgcctttgatatttgatgatactactactactgctgctactgtgtgttgtgccgtgtcgaccccagtggaggagagtgaggggtccaaagaatccaaaaaatgcccggcccatcagcctaattctctcgttttatttttcttttctgaaaaaaaagagcctaaatacgtcacgtaatcccctctctctctctctccccggatatttttatccattgggtagcccccaagaaaaagcatggacccggaccagaacccgcaaaacccagccacgtaagcagccacagcagcacgggcacagccagagctgaagaagaactgatcgataacgagagcgacacagatcgatgagaagaagtacaggtactaggatgaattagcagatggattacaacaagcacaccgctgtacaaaaaaaaaacaaaaagaagagaaaagaaaacaacatatgctgaagcgaagaagaagaaggaagaagaaaaaaaaaactgaagttgagacatgacaaaagcacgagcacctaccggctcgacgcgacagagtagtcctagcagttataaatccgggcgcggctcgatcttgagccgcgatgtggtggtgaggtgaggtaggtggggtcttcaaagtttggaggatcttggcggcggcggcggccgccgccgtcgtgccggagcaagcggcggctactcgtccggcactcggtacgcgtcggcggtgacctccgtcagccacaacccagggaacagcgactgcacatgaaacagtagcaaccactgtgagtttgagtttggattgcaggagtgccattcttgcacacaacaatttaggtttaataaaatattaagtctaagcatacgcttaaagctgtattgtatcgagggaataaataagaggagggctaattgggtgattaattaaataatggtggtttgggagggggagggggaggggtagtgtggggaattcgccttacatcgagctgccgctgtacgacgcgcggccgcttcctcggccgccgccgcggccgtgagccggtcagcgcgtagatgtcctcctcgatctcctccggcgtgagcgccaccgagaacggcgcgcgcttccggcgccgcgacgacgacggcaccggcaccgccgccgccgccgcccacgacatggaggcggctgggcgccgccgcgtccgctgccgaaggttccacggcctcgctgcaccgtcggcttgcggctgcgccatggggagaagtggaggcggaggcggaggcggaggcggcgccttgagctcgggctccgagtccgcctccgcgggtaggctctcgggcttcgtcgtcgtcgtcggcggcggcggcggcggaggcggcgggggtggggggctaggctggggcacgcggagacggtcggcggcgtctcgtaggtggcccatgagcttaacccggagctcctcgat

SEQ ID NO: 48564 - DNA, 2657 bp, Oryza sativa
ccgcccctacggtgagacgacgagcgtcgacgatcgcgcgtggcggcgtccccacccgccggtaacgctaccaccgggagcaccgtcggcggcaagcggtgcgcgggagttggcggcggcggcggcggctgcccccacggctcgaggtggtgcgtcgacgtcgccgcgggcggcttcgcccgcggatctgccgtcgccgccatggccctgcttgtcttcaccagccgcggcggcgctgctcggagaggcggcggcggcggccgagtcgacgagcggcagagagagagagagagagaaaaggcagagaaggttttgaggccacaggaggtggggtcgcgctcgcgttttgttaccgtcgctcgcagcgccgaagtggcgtgtggtgcccgagtggcattctcgtcatttccatgccacggactcggggcgcccgaggtttacgccatccgaaacccgctttacccttttactcccaccgacgggtggggccccagatcaccagggtcccacaagtcatcgacgtggaggggcgatacgtgtggtccacgcgggcgaggaggccaatctccagcccaccaaacggggatggaaactggcgttagccatgtccgtgagggcgagagggggggtgggggtggggcccaccgcgtcagggaccgaccggaccgtccgtccatgcagcacggcacgggtcctcgtacgatcggattttcggtgtgggcccggcgtgtcagttttgatggtgtggtttcacgccgtccggccctgtgctcctggactcggtctactctttccccggcgcggcaaacggtgcgggaccccaccggccagtgacagcggcagcagccacaacactgcactgcgctagctgcactccgaccctcctggatgctctagtcctgttgcttgttgctgcccacaagtcacacaagctttttggcaccctttgcacgcttgtcatgtcactgctagtcacactgcaatgagattacaggcctatgattgtcaaccaaaatttaaattattaaccttaaatttgaattttttttcatcaaaatttattttccagcttttacttttagatcgctacgaatacgtatataaaagttttatttacaaattactattcttttgcaaatatgttgtttcgtttattaagcgaaatgttgtttcgtttattaagagaaacgatgggtctgtacactctcggcctcataaaaaataaatacaaaaccaaatatagactatgttcattttttttaataagaaaatatagattatgttcatattcataatcagaagcagtcttttttttcattttcttttaaaaaaaggaaagtgatgttttgatcattgaattgatcagttaaccaaccatactccctatactcgtacttgcccgattgaacagtagcacgagtaattttcgaagagtacgtggtgtactatcagtatcttaaattgaaccatgccagctagtagtagctcagtatgaagagaggattgttctaacctcaggtagatcgtactccggtcaaatgcgaattccttcagatgttttactactaccaatctgcaagcacagcacagccgcacggccggttgatcgatcgatcgatcgcctgaaacgaggagttgaagggaagaaaagcgtcgcgtacgagaggttttatgggatgggggtgcgagttgtcgtcgcgatggtggtgaattgtggaagcgtcaaccttccaaagctttggcttgtttgggcgatcggcgaattgcatgttcgttggtgaaatactaacacgtgcacgggaaggaggaacggtcaacggggatagtatatcccgggcaaggccaccgcgtcatctctggtcaaaatgttctcttttctctcattttctttttttttctcacattaaactgaacaagatttatcaaaaaattgagtttgtttttgaaaaaaaatgtttgaatttggtgagttaccacgtggttaccgttaccgtatcgtagcagtattgttgtcacgccccgaactagtcccgagcggaactagcccgtgacgctccaaattaacctgttaatcgataccagtcccaggaaacagtgctggtatcacaggaagacagaatatcacagcaacagaggtctctttattatagagtaggagtacagtcatgttggactgcggacagatcccgagctcacaactgcattacaaaagggaaacggaagccaagacttggaccacacatcacaggcgcgacttgggaactaggccgaaaccctaaaactcatcgtagccggcttgctcctggaagaactcctcgtcagcgggatccgcttcatcttcttcagcaactgggggggattatttatatagagcaagggtgagtacaggagtactcagcaagccatgggaaataagtgtttaatgcaggcttcaaagaaaggctgttgtttttgcgattgattttatttaaactcttttctgaaacaactaagggagtgcttctcaaacgacacggatgagacagtgcgtctcgtccggtcggagtatgtgcaatgtttcagtcttttgaattgatcaagattggcacccggccaacagctttcaaacggccacccgggcctggctgatcccatcagccgcagatttgggctgcagg

SEQ ID NO: 48565 - DNA, 19563 bp, Oryza sativa
aactacgctaggaatcacctcacatccgcccatgaccgtgggcacggctgttcgaacagttttaataacctctgcagagggggtacactttacccacacgacattactaacccggatcatccagtccatgcagaacggccacgactagagaccttaaggctttcatgacaaggcatttcgaaagccgacataggttcaccatatgccaacgagaggagtcccagaccaacaccagattaggtcccagaccatactgtgccaggaagcccaggggtcctccccgacatgtcacgcccagaaattcccgaatagaattccaaacagaatgtgcattaaaatccccgtccaggaccggccggggtacacaaacgacaatgttgacattcagatccacgtcttataaacatcataaaagtcttacataaatgcagcggaaaaaaagaaagacaacaggagctaagccttgactagaactgcagcgggaacaccactccacaggcatcctcgacggcacggacgaagcctactcctcggagaaacctccatctgacacatactcgtactctggggttgggaaaagtagagcaagaccgagtactacccactgtactcagcaaatcataccggaataggggtatgatgcagggaattatcaaagaagagctagagtggttcatttgcataaagcgagcatttaaaagcagaagttgaaagatttaaacagtggtaataattaattaatattaactatccactgtccaacgctatcccacgttgcaacaggcccaaccatccaactaaaccatccaaattcaaaagattacactagggtgagactaatcacggtgaatctggttgaccgcccataaccgcgggcacggctattcgaatagttttactctgatcagaggtgtacaactgtacccacaagacacagccccacgaaacgtttccgtgcgccgacatgccaccacgacataccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcatgcccacccttgcctggatgcgtcggctagaggaaagctacgctacaagcccagccgttgcccacgctggcttgtggtaagtacgataagttcttccagggcatcccgcgaaccggtccttaactgccattggtgcgaccagcaaaaccatgcacccacagcccaccatgtgatttattttaattaaccaacaccaaagcggtggcactaatccaacattaccattagaaccaacagtctaaacattaataggattctccccattgtgcactagttgaactaagcatggctaagcaatccctagtccaatctctagtcatgttataaccccaagctgacaaagagacatggtacaacaatagcatggctatgacaataggtaaacaccccatagaaacattataaaacaatgcaatatttgaaggaaaacaatagagcatttgcgatataggatcaacatgttcaagtgacaagcatgacttgccttgctctgctgctggaggaacctcggcgactatttcgaagtacaccggagcgtcggaggaaccggaatctagcgacatacaaggtaaacattacaaacaggctataagactactgaaacagggaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaataaatcccagggctgatgtcagcacgggggggagaaggcgcggcgccgacatgcggggcccaccggtcagcggctcgggagagggaggaaaggggcgccggcaagcgggcccactcggcagcgactcaaggggggaaacggttcaccgtggaccgggaccacgcgggtggtccaccgccggtccacgggaccgacggcccagatcaccctcggggttgatcggatgggcggcggcgacccggctcggcttggctcaaggccggcccaccggccacggcgatggcgacggcgcgcgcgcgcgaacgcgttgccggcgacagcaaccggcggcggaggcgacggcgcaaaggcgacgcgaaggcggcggcgctaagcggcggctaggaaggagagggaggggaatagatgggagaggaagcctcaccgagggtggccggcgcggaggaagacgacggcgaacggcgacggcaagccacgggaggacgacggcaaccggcggacgggcttcggggtgccctaaggaaggaagagagagagagattagagagagggagatgaaccacggcgaccggcattcatggccgaaggcggcggtagaggttgaacttaccggagcgcgaggggatgcgaattccggcgacgaaactcaacgggaaaggggcggccggggtggagcttaccctcgcgaaacccgacggcggcgacggcgcggtgcggcggcaaccctagcggccgccggagtaacggaaacggcggcggcgggtggttgcacggcgcgggagcgatggggagcacgagggagttcggcgaaatggggaaaaagcgagagggggcgacggggaagcctaaataggggaggggagccccggacgtggccggtaggggcgagatttcgccggccaacgtggggagtgggggaggagagagaggcgggattcgaaaatcgaatcccggccatcttgggcgcgggcgcgggcgcgagagagaggggagtgggcgcgggggacgcggcgcacgcgcgggcgtggctgacgtggcccggaggaggcggaggcgtgggcgcggcggcggtagcgggcgcggtggcgccggctggaggaaggagacgggcccgacaggtggggcccacctgtcggcgtcccggggagagagggaggggcggcttgggccggcccacaaggatgagggcgcgcgcggcggggtggactgggcccactgcccaagaagaggaaaagaaaggaaaaggaaaaaaaaagaaaaggaagaaaagaatttccctgggatttaaaatattgcatgctcgattttaaatggttaaaattatttcgagagctctgaaaattccactaaaaatcttgttagtgaatttcgacatgagaactcaagaaaaattccacatgccaattccgattattatttgcattgatttaatagggtttactcttgctttgcaccggtattttcttagggtctcttattaattcaattttaggcttaggaggagaacttcagggtgtgacaaacaccaccccggcgaatccacatgtctcttacatcatggctcccccgataagctagttactcagccaggggtgtcccattccacccatgtggtcgtacttgtcttatgttcggatgaaattccaaggaaacggtccttaagtgcaagagcgggaaatcgtacacccggtacgttccccggtccgcggttttggaaattcatttagttcgcaagcaccgacccaggtgtcgggttttccaattgtgaatattggtttctggtgtatgagaaacttaaccaaatggtctctagcgctactacatccgtttcatattataagggcaaggtcaatatttattgccacaacatagcattaaggtggaccctatagcaattgaccatcgttgttagtacatcaccaatatatatggaccaactagtcatataaaatagaactcacacaactggactcttgttatttcaattttcacaatgtataaagatagcacactataataaaagaactaatccaccaaggttatttcttgttgtggcctagactatattcaataccataattgttatggttcaccttaaagaccttaaggctacttttttgcaacagtatggttgctctaagtcactttgacttttttactattcaaatatttttaagtttcatcaagtttataaaaaattacaacaaaatttttaatacaaaacaaacatatcatattattgaaatgtatcaaatattggtttctataaaactaaactggtgttgtagatgttgctaaaattttctataaactttatctatcttaattaaagtcaaaataacatgtaatatgaaacaaagaattagtaaaattactttaatactgttactttggaagtttggatgaatgcagagcagcatgaggagaatcgttcattccgatctcatcggcagcaaaacagcaaaaaagtagaataaatgaagagaggaaaaagaactgtttggaagcaggatctcagcttaattatgatgggcaggcaataaattgtctaaatctttttctgaatgaggaccgttgaaatcaattaaaggagggatagcaagtgtctgcttgatttaattctgaataaatgaaatagatctgtttgtccaagataacgcaactctcccgcatattctcttggaaaaaatatgagaagaaatattcaggaaatgaggaggaggagcacatgtttcccagacatgaacagttgaagagctgtgtatcatgggtgcggttgtgcacttgtgctagtggaagcttcatccgctgtagcgagcatgtaatagaatattagcaagcagcatctcataaacaacatttaggaacagagtgaattgtgaatccattgtagataattcataagagcatatgcaacaattagggtatctgttgacgtaggaatatcatctatagaaagactacactagacagctataaaacacatttctagcatagaaaaaaaaaaggagagttacattcaaattgtttgaaggactatgcctaaactgcccctctttcactcccttaaaaaaccatccgaaagtccaaagtgaactaattagagtcgatcaaggattaaattttgtctgcactcataaattttagccaatctcttctgtactatcatgacttaggatcacgagtaccatcataagatatacacattcacaatattgcatacgcatgtcatatattggcccccacaactagcttatcaaggccatcgttgcaacaaaaaataaatgtccaagggacacgttgactccttttcagttgagctcatccaaacaagatcaatgtgctactatgacatcaagcacaaatgataaaagtgaactacagaaaagagttgacaaaggaaaagggttgtaaaacccaggatctgtaatgtcatagtttaaggggtcactttcagcaatcaataccaaaggtagcaaaacattcgagtacaccagaataatgattggcaaatcatgaggtttggacttactcatgtcatttcccctctccttggaactgtttacacattctgaaacctcagcgttttttttcctgattgggtaaatgtttcctctgaagtctcagcatgaatctggagtactgtttgaacagtcaaatggtcctgagttcgcatgaatccaacattcatttcaagtgattctgcttcagtttctgagcatgaatcctctgctttcttcaaaaacatagttcagtctgaagtgaatggtcaagtaaccaaatactgataaaaagcaggaagccaatccataaaaaaaaatcaagaaagacatgtacaatacctgaaaagacagggaagaccgacatggaagaaatcgatatgtgtttctggcaaaaactagagaactgataaataaacctggttaagttctactcctaagctactaggaactgcaactgcaattcgagatgcaacacagaattaccggattgaagccaatgccaaagatttcataccacccagaattaacgaagaacctatcatgtatccatgtctcacatccagaaatcaagagtttgaaattctttctgttaactgtttccgaactaggcataaaagaaagaagagtttgcagaggcttcacgaaagcgagaagcaaaaccccaacagtcaggtaaaaaactacacaagattcatcatcaacagcataagcatggatgcactgaaacaattctgactgacagtctgaatctctctctgtctataactacgataagccaatggttgatcttgcttctcggaaaatccatctcctccttcttggagcaactcagaatccccccttctgcagcagttcaggaatcagaatcgaattcaccaactcgaaatctcccagaaccagtggcgaaagagatgaaagatttggacttttgtgcgtacctcgttcaccttgtagcgatcgcggctcacctcccagagcgagttcccagggcaaatcgactgcggagaagagaaagcagggaagtgatcagcaatcgaaagaagaagtaagaagaaggagagaattcgtgggtggcggatgaagaaatcgtgctccatctatggctgcacacgcacgtcgacttgtcgctggacgctcctgggccgcttcgccggcttgcgcggcgccttccggccggtgatcgcgaagaagtcggcgtcgatctcctggcgcgtcagctccaccgagaacccgcggctcgccctggcgccgccgccgccgccgccgccggcggcttccatgttccagagcttcttgttctgcagcgcgtcctcgccgccgtcccgcccgcccttccgataccgcaggttccactgcttccgcggagcttcctgcgccgccgccgccgccacaggagcgtcgcctcctttgggcggcgatcgggaggcgttacgcttgggctccacggcgtctccagcagcagcggcggcggcggcggcgttgggttcggagccgaccaaggcggcggcgtcaaggtccctgcagaaagccatgggcctgcggcacccccaggcggcggggaggtcgaagcttccgaacaacccagggtccctcggcctcggcgccgccaccgccggcgcctccgacattgctgcggcagccggggtcaccgtcgccgccggcgaggactccattggcaagaaaaccacacgcgcagacaaagagaggggattaaccagaatgcgtgttgtgtgccgcggagcagagcagcttaggtttgcgattgcatgaggcggctatatatagcgcggattaaccctcttctcttcgcttctcttcttcgattggaatgaagaagaagaagagagagtagagaagggtgggggaagagaaaggaagaagagaagggagcgaggaaaatgccgtggtttccttttggttttggacgcgactccgactccctccgctccgccgtgctcctgcgccgcgccgcctccgtgcgggagttcggttcggttgcccccgcggattctggtcgccgatttgccccgtttctcgagccacatggcccgtgtggaccgtcggattgtgatccggtggccgaggaaggggttgcccacaccggtttattttgcctttttttttctctctctccttttgtttaccagtttttatgttcatctttgttaaagaaaaaagatcggagatatttgctcttgtagtatgtaagagacatgtgagtagtatgaacatgtatttacctttcttgtcataagattaaatcagacgaaatgtgtctacgtatgcatccgtatcaggtttatgatgttcgtaggcgtgtcacgtgcctcgtcggtcgcctgtatcgtcagcgtgatagccttttttaaaggctggaacgacaaacacttacgtttcgagttgagttctaaaagataagaaaaggaattaaaagaatggcatctccaggatatatttggatacatgacgtgtacttttatttgcttccaatttatctatggcgttaactgagctaaatccctacgagctttaattgacgtgtctggcttccatccttatcttctagacgtccgtaagagtaaaataagcaaatattaaagcactctttacgaaaccatgtaacacataattacaaaaagtgcgagtcaacattggggccaccaaaactgcccggtgccacatctttcatgcattgcattttaaagaaaaaacaatttaaattgtacaatcaaaacttaagatatgatgtcataggcacaatcatgtgttacacatagcaactcatagccagagaatggtgagtatgttatatcaacatccatatcttttcggttgtaactctattacaacatgaacaactttgatttagctactgcttgtataaaatggctaagaatattgctcttaacattgtgatgaagcatttggttcatggccacaaaccatgattgactacggtttcttaatcaacatagcctggttctcatgaacttatttctccacctcgaattaccatgttctaaagaaacatttgctagtatagaacgccacactttgcttaagactttatgggagttctaacctcacagaacaagccattagaacttgtaactatgaaatggagtatatatatagtgtaacaatgagtaccatctcgacaacagtagaaactggcatcactaaaacattacttcatttttcaaaaaaaaaagaggcaaaacttgtcaaaggttcacgttcttcatacatagtcatatgccccatcggtcatctgtgttgtccgcttggtaggcttttgtaaaggtcggaaatgatgaacacttacctttgaattcaacgagacaagaaaaagaacaaaaaaggatgacatctctaggatacatttagatacatgacgtgtgcttttatttgcttccaatatatctctagcgtggcgttacctaaactagcatccttacaagctttaatttatacgtctgacttctatccttatctttcaatcctccataaaagtaacataagcaaattaaagaattctttacaaaaacttatacaacacctaaattacaaaaggtgcttgttgatattgtcgtcaccaaaactgtgtggtgttgttaattttttgcatggcatattttttaattgacttgattttttttttcaaaaagcaatctagactatagaaccaaaaacttaagggcttgtttaatttgttgccacttttagccttcttactactttaaacatacttcaaccattactactttaccaatttttctgcagttctagaagcttcctctcttagaactatacaaaatttggcaaatacatcaaaccaaacaaagctagttctaccaaaaatttggtaatgccaaaatgtggtaaaatttggcattaccaaaatttgaaatggttaatttgggcaacaaagtgaaaaggccctatgtctcgtgatgccaatgacacgatcacgagtgttgcgcatagcgactcatagcatcgagacgatgagtgtattatagcaacacccacatcgatagtagtagctccattacaacaagaactacattcttttagctaataacataaaatggttgtaataacaccacaatgcaacatttgattcatagcccataaccattagggagcgaaaccaacatggactaaggctagggctggcccattatgtatgttgggctgcacatctgttttacacgataaaaatctataattgtccattatatgtttaccacaggtttggggccccagaccgtgacccaattgattgcccatggcctaagtctgccttgacaactatggtgcgctgtactttcttaatttgttagcttcttgccgtgaactcattttgatctccactttaaattgccatagttctcctcaactaatgtttagaacaccatattttgcttaagattttacgggaatggtgatctcacccaaataaaggcattatagctcgtaagttgtatttgtaatgtgaactaccctctccgtcccaaaataagtgcagccgtaggaatccgtgttcaacgtttgaccgtctgtcttatttaaaaattttatgagaaaattaaaataagttagtcacacataaagtaatattcgtgttttatcatctaataacaataaaaatattaatcgtagaaaaatttcaaataaaacgaatggtcaaacatgagacacaaatagtgcaaaactgcacttattttgggatgaaggtagtactttgttttgaaaaagaaaacgcgggaaaacctgttttaccatgatttattatttttttatacaatatagaaaacactataccaaactattaacagtaagtattttatagaagagaagaagaaacactaagcgctattcaaaagaaaaacatatacgtcacgtacagcaagccagccgaacgtccctaataaaaacaaagaagctagccacgtaagataatccgcgcaataagtcagataaccgtctgttgcaacgcaatcgtacctcgttgacagcaggagcaacccgaaaaccaccgaacctctgacgacgccgacggggccgcgcgccgtccgccccctgctcgcgccgccccaaggcgatcacacgacgcgctcccgcacacgcagcggctgcggcgcgcatcaccaccaaaatcgcggccccgccgctgcacccaaaaaccgcctccgccaccgcttacccatccacggatccatccgtcagaatcacacgaggcgccgagcgcggagacggggaaaaacccaaaaaaaaaacgcatacgccacacgcccacacgcccacggctcggctcgtctcgtctcgtctctccctctctcttttttaaaacctgacccgcaacatcaccctcgccttctctctttcttccggcttcctcttcctcttccctcctcgcacccacctcacctcacctccctcttctcatggtcctcatggccgcctccgcctccgccgccgcctccgaccaccacacggcgcaggcgaaatcctccccctcggcggctcccccggccggctccgccacccgcactcgcctccacagcttctccttcccgaccaccttcggttggggcacccatcgcctcctccgctgctccaagaacggggactccgctcccgcctccgcctcgcctccgaagcagccgcacaccccgtcgccggagaaggggcaggagacctccgctggcggcgcctctcggccgtcgcggccttggaacctccgcacacgccgctccgccaccgtggcgcccgacgcgtcgagatcggaggccgcggggaagaaggcggcggcggcggcgggaggagggcaggcgctgctgcacccgcctgcgccgttgccggtggtcgccaagaagaggggcttctccgttgcgctcaccagggaggagatcgtcgccgacttcatcgccatccgcggcacggcgccgccgcgccggcccaagaagcgcccgcgcgccgtgcggctcgagcttgatgtaaggattttggagcctccgcgtgcgcttcatgattcctaatttttgggtctcgatcggggggtgctcaatttttgttcggttttggttcgaattgcagcggctgtatcccggattatcgctggcggacgtgaacctggattcgtacaagatcgtcgaggaggtgagatatcgctcgatacgtttgatgtgttccttcgcccaaaaaatttggttcttttcttcatgtgtgttttcctcttgcagaggtgattggcgccagcgcggtgaagtctgcaaatgagagcaacttttcagatgttcccatgttttgcttttttttcttctgacggctaacatgtccatccaataattatgttggttcttctagatcagaggatggatatagattttatggttgattgtgaataggttttctaattagaagaaaggtggaatcgtatgcgatgtttgtgccctgtggcatatgtggtgtgatgtttggttagctgtcatgttatgtacatggtttcagtctgtgaaatatttctttcggtgcaaatcgcttcaactctgcaagttgttggctgtgatatcactatgtggttttgtagtgttagtgaggatgatatttccttgtattaagctctactttctgcattgcatagatagagggaaaaagatgcagctttggtttctctgcagggcatatatcatgtcttgagttggacattgataccgaagaaaatgaaagtgtacttggggtgcaacaaagtggtttgaaaagagaaaaagaaatctcagctagtgaaattcaggtaggaaatcaaactagttatcaagggtgcgctttgttataatctcctgcttgtaagtatagcttgcattaattttttttaacagaacggcaaaatcattgccaattttcaattaagaaaggtgttagctggcattaattacctcttccagaattagttgttcatttttacatatacctttgttcaatatatttgttcattttgcaatattctgttgtttgcaaaagctggtgcacatcattcttgcttctcgaatgctgatacttctgtttttcgtctgatctctgttttgcacttttggaggagacgaagtgttcactagtcatatcctgacactgcttattagaacgatttgctaagtgcattaataatttgaacttctgcttatcgttcttgacatttggaacaccagttgtgtacctgtgtgcactatgcaggagctgaaagactgcttgattgttgcattgcgtcctttttccatactcacttagcaatctaattatgcactaatttagtattctgatgacatccatggtgagtcggtaatcaggtttttaagttatgcacggttgtgttcggagctggtgttattggattatttgattgacagtatgccctggtgtttttaggctgcaggtgagtctgggacttcaattttgtctgtctgatcatttcctatgattgattttttattttgtaaatcaagagttaaaacttaatagtgcttcatgttcacgatttacaattttacatgttgcacataattggttgatttggttccagtggtttgcattatatgtctgatgcgggtctccatccagcctgtagtgtcaatgttttactcttgcagacgcagaatggtggtacaagtagtcattttacttctgctgtggtcctgtggacatcaaatttcagaaattccatgttaggtttatgagttatttttcaggtaaaatgcttatcttttttggctgaaccatcagtatctccaggctttgttcctgacaggtagtgccgtttggctagagctagatgatgttcttcactcttgagtggcttgatgcatgatcagtgcgcccttccagccgttccagttctccatagtccagatttgcttcttgtggctactgactaactgaaactagtaattattagcatacctatatactgatcatgtttaaaatatctgctggattaattcatatgaattttggcgaaagcaatattgttgagtgccttttggacgtgtccgttctcttctttttcatggacatgtcgctggtgttgtaatcgcacaagagagtgtgtttgttcaaactagtgcagaactgcgttgatgagatagtgtacatttgtgccaactccctacccaattatccttcgaacgtcttttgtcatcctcgagatgtgactttactgtactttctgaatgcctcatttggtgatgtgagaaccttcaaaaaatccaacatggggaatgtttctctgaacgtgtggcatgcagcacacgacatcaagatcacactccaaggggatagcctgaccaatctttcagacacattgtaatttttagaaatccattgactatcttaagcttccaaatatctaactcctgcaattggattgggaagaacagcacaaaacattccctcagatgtacaacaagtgttctgtaattacagttgatgttccacattgcagtacatgaaaggctggggatgagactgagaggccctttcgttagtctggcccataccttgactgtctcatccagtacagcaatcctgcaaaataggccggaggcaaagcctggaagtgatattgcacagtacgaaatttgatcatgtcaagaaacagtgacgagttctgatatctgaatccttcatgtggtaaagttagagcgtagcttgaacactcttgtgaacatcctttcctactattggatgagacgatcagaggatatgaaattgttggccaaggctgacgcggcccagcacacttaaactgtctgatactctgtcagtctattggctcaaataacggtgcatttgctcgtcagttcttttttctttttcaaactaaattggccaattatatttcaataagcagaagtaaaaatgcaaaaagctaatgatgacggagcccaaacgcaggtctatcattctgttgttaaccacaactagtagtccggttcaatcccttctgactagtaaggaagtactccttccgtccgtgaatataagggattctactatttgtttttacaaaaattaagataatagtaaaagaacaaatcacgatacaaatggttggaagaacaaagtagtaaaaaagtgattagacgggaaacccatcaatacaaaaggtgataagtgaaaaataaactatataaaagatgataagtgaggaataaagtactgtcttgggattacaaaattacttatattttcatataaatttaaagggtataattccttacttcctccgtttcacaatgtaagttattctagcatttttcatattcatattgatgttaatgaatctaacatcaatatgaatgtggaaaatgctagaataacttacattgtgaaacggagggagtatattttaggatgaaatgaaaggagtagtgaaatagccgtatgacagcttgactgcagttgctgggcttctgcagggttgcgatgctgcattctatttgggccgagccgtccccaagaatctacttacttgcgattatccaggagacttggcattcgtatactgcagcgatgatacaggcaaaagtactggactggagtatactgaaatagggagtacagtaccatagagcagtggtatagtactgcgacattatattacagtagaaccgcttcgagcaaaacacagtacttgcattgctgctaatcatggcgatttgagggcaggtgatcgatgactgtgtataaaaagcctggcttatgtcggacgtgtcgcctacaaggtatacatacgcataaaacaatgtacaactctgcatacaacgtacacatacgcgtaccaaccgaccatgtgaagtgcaattttttttgaaaaagaaaaagaaaaaaatgaccagaaacttctggaagcgagtatccaatgcctgaagtccgcgacagtataaaacgatgctgaaaatctgatgcggtagactgctgctgtagaatccaaacaagaaagaaaacaatccaaaagagagtgaaaatcgtaatgccactgaattccagctctttgaccgtacgggaaaactggagaggaggggtaaaagaaaaaaaacagaaagaaagaaagaaagaaagaaagaaagaaagaaaaaagagtaggagacggggacgaatttgtttgttcctagctggcaacagcaagaacaccaggcaccaacccacacgcccaacacaatccttctccccctcgatcagtaatcacacactaagcgtggcattacccatccaatcatcccaacaacaaccagctggaaaatggatggaacatgtcaagcatccaccatggcattagccacctcaaactactactactagcagcagcagcaggaggaggattaattaaacaaacaaaacaaacaaaaccaaaccaaaaaaaattcagctccggaaatagagcaggtcacccgttgcactgcaacaaacactgatgaaaaatcatatactagactgtactcattatctgtctcaaaattctgaacacggtggataattagatgattagtactactcactacatacatacagtgccgcggttaggaggagagcgatgtgatgaatcaccacctctccaagaaagagtacacaaattctgctgcaatgaagaagaacacttctcatcagttgcatagcttagcttctctctctctacgttaattacctttgtctcttctttctatgtcactggctactttttctgggcccaccgagcagtgtcagagaagggcgccgccgggacactggaaaattggcggcctaaaccctcgaacccccaaaagccttcaatgaagtgactgcggcgccgtgcggcggcggcggcggcggcgagctcaccccaccatgtcgcagtactgcatccgcggcaaccggagcagccgcggcggcaacgtcggcggcggcggcggctctggttccgtctccatggcgtacaggtagtcgttggtgccctcgctgcgcggtggcggtgactgatcggcgaggaagctgcggatggtggcgaggcctgggccgcgcacgtcgcgctcccaggaggcggactcggcggcggagcccgcccgcgtgagcctggcgcggactgtgtcggaggcgtcgaggcggtggatgggccagccccaggcgtcggacatgcggcggatcttggacacctgcgcggcggcgaggacgcgggtgttggctttgatgtcgtcgatcgcctcggagaaggtcttgcgcccggcgaagtagtcgccgagctcggggacgccgatggccttgcccagcccggagtgcgcggcgcgctccgcggcggttgtcgtggcgaagtactcccggagctcctcgaccatgccagcgtccaccatgtcgtccacgcggcggtcgaggtactcgtcgaggagcgcctcatcgacgtggacccagagcaggcagcacgggaaccggagcgccgggcggtagtggcggaaggcggcggcggggagaagggatcgccagcggaggcgtcgaagtggtcggcgaggagggcgtggatgagggagttcgacccaccggcgatgaccggcacgagccgcctcgccgcgatcgacgcggccgtggcggcggcgagggaccggaaggacgacggcgggagctcgccggcctcggggcggatggctccgaggaggtggtgcggcacgccacggcggtcggcgaggctcaccttgttggtggtcacgtcgaggccgtcatagagctgaatcttgtcggcgttgacaacctcgccgccgatcaccttggcggcgtcgatggacagcttggtcttcccggtgcccgtggcgccgacgatcaccaccatcctcgtatcctcgccgccgggccggcggtggagccgcaatggccggctcgccgccgccgcggcccgcacgagcgtggcaatcctggtggcaacgctggtcatgtaggggaaactagaaagggagactagacctctcctccaatcctgattaggccgccttatgaccttgttttgtccgttcctaatcacaaaacgctcatgtgcttgttgcttccgtctcacatctcccaaattctctctctctctcttacccccgggcttctctttgtttttttttttgcgcgaaactgggtctgatttttgtttctacccgcctaaaaattctctttggcttgtgcgtatacgcggcacacgcagacgcagggcagtagtgggtcgcttggcattgtgcgcacaacgcagtagtagtagcagccgaggagactagacatggccgcggcgtcgcgtgcttaaataataagccggaggcggagccaagcacccgtatcctggcgcgccgggacgtgacgcgatcacgcgacgcgacgaccgggtggaatgcaagtgggggacccggcatacggcgccgcggtggtgtgtgcaagcgttggattcggcaaagccacaaaccggcgcgcggctggctgggctgggttggtcgtccacctgaagggggagttcgcgcggggtcgtggtccctgtctcaccgtgcgcggggtcgcgggctctcgcgcccgcgggaaacgcagaattctcctgtattttcggggttttcccccgcctttcggcgacgcaggccgccgcttcgtgtggcgcctagactactggccggtgacggtgagtgcagccaccggtgcacgctcccatcccggcaagaaaaaaaaaaaaagaggagacaacccgagcggctggctggtcgcgagtccgcgtactactactactactactggtagtacgtggtagcgacctcggttcggtcggtggacggtgatacgtttttttgacttttggcgatcatcggcgacgcttggggtaatacgatcccatgtcgttctcttttccgggagacaaagcgattgatacgcccaggttcgggtgccgttgaaaatcccggacggtgctgcgtcgtcgtgccactgcgccgtgggaccctcgtaaatctagcgattgccgctgcccctccagcgtgcggcagccacacgacggacggcaatggaatggagagaatttgggggtttggagataagcctcccagattggtgctaacaacgtctgtacccatcacttgcactctcgcacggtcacatggctatactagcgcccatggcagatcggcagaggctagtacgtagtacgtggccagggctatatatatttcttccccttggcttgtttgcggcgatggattggctcggacactgtcgatcgactacagctactactacagctacagctgcagctgctgggatctgtgcagctgcaggattgggccagcctttctttctcgcgaggctctgaattctgatctgatgaaaagatgcctcgaggaatgactggctcatcaaagagcacgcaggttcttggcatgggtttcgtttcgtttcgatgagggtccatctgtactcgcctgcggcctgcaaagagctgctgcccacagtactgttccaagtagttttattgtgctggaaacatttgtgtactgtgacttgaatgtcctccaagtactgtactactgtgcgtttgaatgtggtcaggctggttagaagtactacgagtactcctaccctgcagtagttttggagatttcaccggtcatactccctctatccaaaaagtttaggtcacaatattacaattttctcattttctataatcaaaaccatgaaaaaatcaactcaatgcacatgtaacaaattaaaaaaagctacactaatatatacaacatataaatatatattaagataactacttgggttcggatcaataatttaatttagcactgcgacaatatgaaaagataatctctacatttaagtcttgaatataaatatgaccatctcatttattaaaaaatataaaaaatatgcttaagacttttaaatggagggagcagatcataacattaattttgcgctttaatttagcattgtgacattatgaaaagataatctctacatttcagtctcgaatataaatataaccatctcatttattaaaaaatataaaaaatatgcttaagacttttaaatggaaggagcagaccatatcattaattttaggcaaaattggttatatagcatcgaaagttcacgtttttggttt

SEQ ID NO: 48566 - DNA, 27288 bp, Oryza sativa
  unsure (1)..(27288): unsure at all n locations
acacgatatgacgtttctacccctcattaacatgcattctacttgtacttgtgaggggtagaaacattatattgtgtgtgtggctggatcaagacggacggaaaacgattgagaattgacggaagtgctaaaaatgggaacagggtgatctttgggtgctattaaagtgaaccggtatctttctgtgctataaaataaaaaacgtgaactttcgatgctatataaccaatttttccttaattttacgctcctctcaaaattttgtcaaatagcaacgtccaaaaaatgccattgctgttgtaggaaatattcccttatttgatatggtaattttatcttaaactatttttcctatattttttttatgttttgaactaatcagcatcaaatattaagggataaatgtagtgttataagagttcgtgggtataaaatggagatcttatatgagccatgaaattgactctagctaggtgaatggaaatgtcacattgcttggtcacatgactcggtcacttgaaaggtgactccatgaccaaacggaggaaggttcgaaatataagatgagaaacaatctttagaggaagagttagtaggagtacgtgattattttgtactccgtcgttgacatgcatatatattgttgcgttgctatcaagcgagaaaactgacaggtcagctcaccatggccgtaatatttggaacggcaacgaattgtttccctttcaagaacaacttgaactaattttgaattgtcacttacgtgtgtgagaaatttcgtcatcgtatcacatgaattccctctaaaatactactgctttctgaaggttggcttcaagcgagtgagagagacccctgctttattcttacatatacttgccaaatccttttgcattcttccacagagaaagggtggaagagatgcgcgaggacttggggcttgtttgacattttgattgtgacactagtaaattctgctgctaaggcccttgtttgtgataactgaaatcgatggattatttgatttttatggtaaccatttgaggatatatacagatgaataaattaactgctatagagttgaaaaagttgctttaaaaagtatcccatgaaaaatttgcatactctagtattttatatgaaacgtatcgtttagtagctttagaagcgtgcaaatgaaaatctagaatccagaatcagaaaagaacatggccgaattcatgcacttgcacctggagcatcaaagctagagtataaacaaagaacattgcaaaagtttttggttggcattttttatcaacttccaaaagcaaaggttggattgacaaatataatccgatacctcgtctgtgcacgcgcttataggtcagagcccataaccttgcgctgcacatatcctttgccattaggttggcatatttcggctgcagttggattctcatatcgaatcaacttgttctcactgtttttcatcacaaaaaaaattcttgattagaaccaaatgaggaaaatctgtggcagtatcgagatctatacgaaccccaattatttaggcgatcgaatccctcaaaagccatgcatggcgtcaaaagcgtccgttgattattaaggatcgatggatgcatgcagagacgactgcgtacgacacaagtgggttcacatcctctatcataatatcactgtcactacaactatcactacagacactaacgtgtagatcgaacaataagagagtatgactcacaaccagtgactataatagtagttatacattatagtagagaatcctcaccggacaaaaatgagctgcaccaaagcaccagatattatgcgatcgcggccacagtttggactctgggaggatgtggtgtacgttgttcatcagcaagagaattttgtgtgaaatggtactgatgcacatacatttcggtacctttcttttgctacggaaagatggagggtatattgatcgggatcttgtttcgccaaaaggaagtactccagtacgtacagaaatcgatacgtatttgttacggcccttttgatgtgcccggccacttactccagtggaatcgaatcaagatgtggcatgtcttctcgatcagggctgtccgtcctcgatcgcaagatggtcgtccatgtgcctgtcgttggcactctggttaattccatgtgcccaaacaaaaaaaaaacaaataaacggcttatataagagtaaaattatgtgggcggatgcatttcaataacaatttagtgagttcgcagatttatcattatcctcgaatatgtgttgtgcatttcataataccacacgtatattgtgtgcaagtgaatgttgttgtatgtatatgtgtatcttcaacaaggacaagaggttgttcggtattcttgccattgcttgggaaatctggagaaaaatgattgtgggaatctttagagggaaagaggcaacaatccatcaaataatcaatcgcatccaataggagttgggatggtgggactcaccggcataaagcacatcaggagaatgttgccatgaggtgtaaggagagttgacgtgcaagtttgtttgcactcgaatttgtactttttttttcttttggcctttagctgtgtgtacttaaactcccttctatcaatataagacaagtctaatcagactgaccgttcaaaaagaaaaaaaagttgttcggctatgatttttagagtagtaagccatgtctaccagggtttacgttaccgccggtaaccgcatggttaccgcgggggtacggtaatataaataccacggtaacctctttaaattcaaataaattttaaaaataatttgaatttttgataaattcggtatggttttgtacggtttttcacggttaccgcgattactgtgcttaccgccggggtacggtaaccccggccccggcggtttgggaaaccctggcgtctactactcacggctatacccgcaaccacaaaaataacggccaaacaagcacaatgttattagcaaaactttctataccgaaccaccaagtttttaggcaaaaactgtcacagaacagtactgttttgtccgactcacctcttcaacgacgtcgttgcatctcccatccacatcagacgagcgtatatcggatcggagcacgggaggccgccgcaatgcgcaggtaacagcgcgagtgcaaccggctttctccgcgtcggttctccgccaccggtggtgggctctgcaaaccgcgtcgcgtgatggatacagacacggcaaaatccggcgtggagcctgacccaacttggccaagcgaagcgcggagttggaacttggaagcgagcagttcgggcactgagatcgatcgtgagaccccgacgaggtgtgctctaattgatctgtgtaatttagagttcagctagctttgtccctactttatataattagatactccctcggtcccttcgttccataatataaaacacaactacttttttaaaaatgttccagcatgcatacatgcatacaattaactagcaccttttctccattaaattattacttttttaaatcattcacgctcaagatctctaattctattggatgcatgtattatacttcctccatctatttttgatagtcatatttctaaatttgaaaattttatttttgataggcatatttcacttcaacaacctatcatcttaattactttcttggatttaatgcatgactcttcattcttccacacaagattggctacataggcatcgagaaatgtaaatatcaatgaatcgcttgtttacgaggaatgactagtagtatgtttaaatggatgataattagaattacttatcctttgtctgtcaagatgaaatatgactatcaaaagtagatagaggtagtatttattagggtgatccaaactaagagatgataataattgtttttcttgatcttttggttaagggtggttgtgccttatactctcttcatctacttttgataggcatatttttaaatctgaaaaaaaatatttttataggcatattacaatccaaaacctattctcttagtgactttctcggatttaatgcgtgactctccattcttccacacaggattggctacatgggcatcgagaaatgtaaatattaatgaatcgcttgtttacgaggaataactagtagcatatttaaatggatgataagtagaattacttatccttagtctgtgtgctaaaatgaaatatgactatcaaaagtatatggagggagtattttggaacggagtgagtatctcgcaatttcagaatctccagttctccaaatagcttagaatcttatataggagtagttttttaaatcaataattctagaattcggcatatgaactttagcaggtagatattggaaaaatcaagttttctaaaattttcgtccgttgtttcttataattttgggcttctaaaacatagccgaagtatgattcggggtaaatgatctgaggcccctttttttttcaataattttgaacaggctaggatttgacacgaaatcatgccttttttccttggatgtgcactggattgggtggtcaatttctatgcaaatggaagccggtccatgcatggcggtgcattgatgcccattggaccatggcgtccatcatcctccatgtacatactacacaggaggattattccaacttccgaagttaacacccaacctgagattaatttcgacgtggaattaattaatgaagccttctcccctgcggcggtgcagccatccctgattaattttcaagtggagatcaatcgataaagacggacgacgacgacgacggcgacggcgacgtttgcatgctccatcgtcgctgctaattaagagcaagtttaatactatagctaactactaacttcaatttatctgtagccaatctaatagctcatttatataatatttacatactacactattaatatttggtcccacctattatacatacactgtgtcttaaagtccgtgctacaattggctacatatctgtagtccgctacttttctctcttcttatttatcttcttaaaatatgtttatagctggcttgtagcgtgtcactgtacatgctctaagcaggacgcggcaacgccacacgcgccgcgcccacatgggtcccgacgtcgacgtggccttgtgtgtgccgcggtggtgcaggaacgagttggacacaggacacagcccatgctgtcccttggaaagatttgccctcaatcatgtgttttaggcgaaaagttctacaaatccaggagttgtaaaatttacacataggatatgattctactttgcatttcctttttcctttttcttttgtcaaatgttgcattttaaagactattgatgcatttacctcactcgttgttttcttattggcttgtcagccataaccaaaacttttatttcgaaacttaaaatttgaagctggttttaaggttttctttatcgtactttatttttcaatattagttttcaaatcattgaaaacacatatataaaagtcatagatataaagcattttgattatttcattcatttttcacttgattatgggtcatagagcgaacgatgagttaggtaaaacaacagtaaccttttatgactgccctgaataatctcaatgcttcttttttttagataataatctcaatgcttcttgtatttaaaatataagcacttgaagaattaatttttttatcaaaatgtaaacacttataaagtattacttgtccaatcaataatcaccctcattcaatttacttccagtcttatcccctactaaactcctacccccaacaaatgccttatttaacaagaggcatataccttgttcttgggtaaaactcccagaagcacttatattttagaacatagggagtgtttgttactcgaaatttgagcactcggtcttttttccaaagaatttataaaaatttggaaagaaggcgtaccaagtatgttgcatcctaagcataagcttgagttttttaagttcatcattgtataaccatctaaaaaaaatattattggtggtcaaagtcaaaacaatgccgatcaaccgcgaaagtttttaggaatggatggagtactatacatggagagtgctattagagcaggtacaatagcagactattagtcagctataaacatattttaatgagataaaagatgtgagagaagagtagtgggctacagatctgtagctagctgtagcacggactccaagacgcaatgtgtgtatgacatgtgggaccatatattaataatatagtaagtaactattgtatgaattgactattagattggctataaataaattggagctagtagtgggctatactattaaacttgctcttacgccgctccacttaatttatttctacgtgccacgtctccttaaaaccatagtcatcaattaaagcacaaaatcctggataaaaaggcccagcctatatagctaggtacctagtagcagagaaaggagggaagggtgatattgatataccacttgcttccaataccttaattatttatcccttttgtggtgtggaaatcatcaacgtcgattactagcatcattttactctctgaatattatgggtatataactatatatatatgtatcgtgtatcgtcagaataaatcacacatttgtgatcatttgcgatctgattcaacgcaagccaatgttttattaaagtgcaactagccacagcaaaatgcaatgcacatagctaaaacgtatgtatgggatgggtatattccacgtagcgtgtgtcttccacttggcaaaagaccttgtcacatagatctatccgaagccgaccaatagaattaaagccttatggtcttctagaaattagtactattaactaaaattctcttgcagttaatgtctgtatcgattattaatgtagcatgcgtcagacagtttatcaacaacgttaaaacgataggttatgtaagaaatgttaagatatacaaagttggtattcttttgtgagttgttttggctgtgtgcttggatgatgagcttatcactggccataatgcctactgcagtttattccatttgcccatgttttatttgtttgttatttttgtcagtaccatcatggcgtcatgtgtctattgagttaatgaaaattttatctgccaagtgtctgtagttttgtgcatcgatgcatgaatgtgggagatgacgaacatccatgtaaggagtatatataatttttttacttaactcaattgacaggactcaaggatgacgatcaagtatcgatctggatatcaaaagtttagcactatgaagagctagtaatgacaaatttatattgtaaattgcagtgatgttaacatgtcctcaccacagctgccagccaacgttcccaatatactagtcttattcatcgtaagttatcctaattttggtgatgttaactaaccctccgctatttatctcagagatttcgtcgaaggaaatactacttttctcaatttgttaaattctatagtagtgaatttactcgtaaaaagctaggggttgttcagattgtagccaaaataaaccttactggcattttggcaatattaccaaaattttggtaggatttcttatatatttatcaaagtttggtaagaaacaaaatggatgcacatatttgacaactttaccgaaaaaatgatagggtttgaaatgaaatcaatctaaacaagcccctagtcaagaatgagggttttttttattggttctacataggcgcacttgcgctgacaggtctcccccagacggatattcgtacattttcatagtgattctatacaatcagaatagtctagcttctggaatagggtggtacagttttcctgagcaacatcgcgagttgatatgattacaatccatatgttctaatgcttcagagtttgattaatctttacattaatactacaaacaaagaagatttggataatggaaacaatttctatcctctgcaaactggttgcttagtggtggggaagtgcactatatatgatgcattatagagctaattaagaccatggtcaaagctatatagcatctcacaataatgatcctaccccccaaaaaaaacaatatccttaagctatgcaagtgtctaactaatctccattcaagagtcccattgaccttcaaaagaaaaggttcttggaaaaagaagaacaaactaaaaaaaaacattaagtgaagagttggagggaacaggtcaactattatcctggatagaaggtcctaatatactatattagtctcagcaaagagtggaggcagccgtcaccttcgatgtgttggcatgtctccggttttttaagggtttaaccctgcatatgtgcggctgaacataatacgtccaaagttggagggttgaatggttgatgatgaggagcagtccaagtgatctgagcagtagtttaagccaccactacaaccaaagcatgtcttttagcagagagacgttgctgagttgcttctacatgcttggaccattgtctttccatgtccttttgtgactgcttatcaacaactactatcttgttagcttctctccagaacaatactagtactagtatatcacattatattctaccatttggtcggtggtttactgggtgtgtgctcttgcagtcaatcagtcatgtggtttaccgtcctgctgccctatcatttggcttattcatggcatatttacaaataagaaaataatttataaattatatatatatatatatatatatatttggtgctccatggtgcccgggaaccattgttgaaattgagtatatacccaattcaaatgagtatgaaactttttcaattacttagttattaacattaactactttactaactagttcaaagtaagtttgaactgaatttgaacttgttttcgttagattttgattctagatatatagcatccatacatataattagttaggtatgtaatcatggattgtgaaataaagttaaatttgagttgttttgttgataggtataggtatggatcgaattattataactaggtatatactcacaatttaaaaaatttaagtgactttgtgcattagataccatggtgcccgggcaccatagtgccccatatgagtgtcacacacacacacacacacatatatatatatatatatatatatatgtgtgtgtgtgttcttagcagtttaaagtaaaaactgaaaaataaacttcgatgaagcaaccccaaaattaactccaaatttaaaattgaaaattcaaattttggcttatacataagcataagcgaaaatatgagacccctagagctaatgctgaacttttttttttaagataatggaatgtaacattccagcctttaataatgctaaaaacttgaaagtagaagagcacttgcagttttctttgaggagagaattaaagcatcgccaatggatgtttaatatggtttttaatcctaaaatttaatatttttttaataaaaaatttggctctaacaatttatctgattactttccaaaattaaaaatacccttctcgtcattcttgctctccactagtgggaaagcgcccaggttcctaatccgcctcccatgcacgggattgagtgacgcatgggggaggtatcatgcgctaggaggggagggatcgtgctcgctgaggaagggggtgagcaattttttttctatttctgttggtagtttggggttgattcactttttattattattatgagtcaacttatatatatatatatatatatatatatatatatatatatatatatatatatatatatatatatatatatatatatatatattgaaaagaggaatcttacacctcaagaatccgaaaacaaaattttggagataaatttttaggcatatattgctgatgtgcttactgagactcgtagaaaaaaaagggagaagtggttgatcatttatactccatctgttacgtaaaaaaaaaaatcaaattctgtgtaggtttttacagcacagagggagtatgcaggttttgcatgtaccctagtttggtcagtgactcagtgttatagttgtacttgtgtgtttgcatgtcttgtggcaatataaggtgcggtgtctctacgttttatttttaacagattttacattctcgttcttgtaacaataggactgtaatatgctcttattaacatatttggccatattttttttaaaaaaaagacttacagaagaagatgatgatctctttttatccccatcactgcatttaaagatgcaaaaagccatactgattatcgcatttttttttcacaccaaatatagtagaaaaatacaacaggctgcaaatatacttatgaagtactataaaattcaactcgtaccaatccaattgctaatgttaattagtaagtgccatgctgcgcctcagaaatgggaataggtgacgacgtccaaggcattactttgatcattttgctccctcattatgggcctccggtattttaactcccaaatcaagttgcccaaatgcccaattaataatgtggagttaaatgcatcgtgtcatctcctgctcgagtggcaagcagcaatacgagctgtactcccataaaacaatcattgctgatttcacatgaaaaccttcatctgaaacctaccaagttggatatatatgtattaggcaccaaaaaagggtcaagataatggggcagttgttgggaactaccacttgtgtattgataaaaaaaaaatgtttccaaccacaaatttcagtgcccagcaaaatgggaaaggaatgtgacaaattgccaaattgagtgtcacaaatttgtcataactccattgtagtaatactctccagatacaagtcgttttagacttgcatgtgtacaggagtaattaaacagttaacgtgacattgttgctctgtattcattgcacattgaaactgaaaatgagatcctattctttcacgaaaataatactcgctccgtcctctttaaaatatactccgcaaccaccttttcgatgtttcatagtaatataaagcgcgcattcatacgtgcaattaactagcatctccccctctcctttaattcttttctaaaactttcacccttaagatttttaattttattggatacatgtattatatttattgacgtgatccaaacaagaaagtgatagtaatttttcttggttttgtgttagtggtagttgcgcattatgtttcgggacaggggagtatcattcaattaacaacgagaatatagtgaataaatgtcttagaaactaaccaacttagattaaaaagaaagtgaaaaacaacagcaacatacatttaaaatcggagactaggctgagttttaagccacttctcggcttaggctactttcttgaattgctaaactgtgcgttccacgaaaaactttttatataattttttaataaataaattaattcatttttcatgtttagttatgctactcaaaatatcattcccaaacccacaaacaaacgcagcctaccaattagacttatatatcatatatcatgggggcacctggccaaacccaaaaagcccaagaaaataagctgacctgtttgtgtatttctattttgtttggaataataaaatgttatccgccttgtgggcgcgcccgagatgttcgaataacgaaagagaccgcgcgacggaaatgatcaagctaacaaataaacaaaacaagaaaaaggaacaaaagaaacaagccgataacatccagatcaacgggccaggcccaactagaaaattagcagccctgctggttggttgctctctcctccccacctcccgtccaccggcgccgacggccggcttgccgtcgaggcgtcgacagccgagccgccgcatctgttgcgctgtaagcggaatgtatggcggcgaggaactctaccacacgggagccgagaagacggtgttcgagccgctactaccctgcctgcgctggtgctctgctgcctcgtcaaaccaggaaaactggtggtcggggaagaaaactccgaacccctcctcctcactggagaaaaagtggaaaacagaacaagcaagccaataccttcagccaccgatcaatagtgtttttatgaaccgacatgctgcacgaatcgctcccgcgtctcctacatgaaacagattggtgaactagttgatatactactagtatgataggcagataaacactgacacagttgtggaacagtaaagaaggccacaggaccgaggacgatgtagaactgttggtacgaacaacaaaacagcgatttggagacaacaaagcaatggggatatatagagtacatacatcgaagttatacgttgtccacaaaaaaaaaagacacgtgtaaacagaagcagcagcaatacagttgtcaaggtctgccggcgatcctcttgcgaaaacaggggtcggagaagaaaactccgccacctcctcaaccgataaaactgaaaaggaaaaaaaaattacatcagattaacgggctcggcccaatgcaaactagacctcccttacatggcctctgccgtccaacggcgtccgacggcatggctcagcgtctacagtagagctgccgcatctctttatatagaagggtatgtttagtatttgttcaaaatatagaatgggttatttagtaatttgaagttgagatttatttgcaccggggggagttaatctggaaaggtttgcttagttggtatttgttttggatctcgtcgtccgttcgacgagcagcggcgcttcttcggaatatatcacgcggggcggcggatcgaaagattcccaaacaccggcacgccatcatccagccagtgtccggttgtgcgactacgatgcttgtatacatgattgatcgaaacgaatatcagcatttgctagcacatacgaagttacgaactctaaaagaccctatgaatcttcgactgctttcagaattaatttgctgacgtttcattgttttgctgcgcgtggcggcccttgatcgccgtggctgctgggggcgagccagggacgcgtgcagcggctgtcaccggcagcgcatgggactagcccctttctcacgatccgatctgactaaagaaggaatcatgaaaatacaaaaataaccttccgcaaaaatatagaaagacaaatataccctacataatttatactgtaaaagaaagatcagataaatccacaccgttagattgtttatactataagtatatattacaagtgtagtgtattagattgtttatactacaagtatatattacaagtgtagtgtaccgtaaaagttctcaaactctgaccacctcctcaacaagtaaaaatgaaggaaaataaaacaaacaagccaatagccaccgatcgatagcatttttgtgaatcgacatgctgcacgaatcgacaagccaaacgtgcagggtttatcttttcattttcgatgtgaaaactagtaaaaaccgatgagtttcggtcaacgcaccaatatctttttgttttgaagtggaaactagtaaaaagtgataactttctatcaacgtcatatgaaatccaataccggtcggctttcaccaacaaacagattgtatgaaaaccaaacagtcgaaaaccaataaatttggtgaaacttgttcacgtgtcttctgtgcgaagcatattgcacactcacttttatttttattgtttgacgtacacttcagtagttgatacgagtagtacttagacagacagataaacaatgacgttttacggtgaaaaaggccaacaggactgaggaagatataagaaccagatcagcattacaagaacaatcaccttaaaacttacaaagaacctaagtataaacatgtcatgaacaatgcgtgcaaccgtgcaagggagaaaaaccaagtatattcaacattcttcgtgtcctggaatatccggttatacagcagaagaattatacagtgctcgtgtgctagtacattttgggggtggaaacgtaccttctacctcgagcctgcttaaataattgttacaaaatgagaagtatgagaagacatcgacacaagattaccatttacacccaactcagcttttctaaggcagatcccagcagccaatttgcaaacaacaaagcaaatgggatatacagagtagagacatgcgaaagttatatgcccttcgtccaaaagaccatgcgtaaacagaagcagcagcaatacagttgtcaaggtctgccggcgatcctcttggctcctgcaatgtgccgatatttcaaagttgcatttaatgctgaataacagtaaggattcacaaaggagtacttgtgtaacaaaaagacctaagtgaatagtacgggagaaaatccattaatccatttatgctggtataaatatctctcaaataaaaaaatggaggtggtttcaaaatctcagaatctaagcccattactaacatcaaaatgttcttgagaaggacatcagaaaagataagccccttacaggctagtggttgattaattgatacagtaacagatgaggtgttgatataatacaaaccaactacaaattccccagtgttcttaataaaaaatctccctaaaatacaaaccgaaactgcatgattaattctttgtacctatatggttctgtatatgctatgcatgaacctattgaggtattggtagaactccaaaacaaaaatctttgctcttaccaagaatgtccaaaggattgcaatatcacctccagagataaacatcactctacatcgcaaagcccagttccatattactagctatcaacgccttcgtcatcgtcatcgtcatcatcttcatcataatcatcatattcatcttcatcacttgattcatcaaaatcatcttggtcctggacacgttaaagggaagaatggattttatggtggttctaaaacagacagcatcagtttcaaaagattggatacctcgtcgtatcttgcagaggaaactgcttcattattctcattttctgaatctgaaccgtcctcttcatattcctcatcaacctcaatgccctattttgttttgacataaaatcaggaaagcattcatcaatgaagacattaactaaaagacatatatgatcaatttatcactagcgcaccaacagatatatgcctcactgtcaaaaacatctctgctgaaaaaaaatgcagtctaagggaaagttgttgccttaataatgaaatgccaatgaataacaacatttgtttttttgctaaaacaataggtaaatattgtggaatttaaaggccatttagtgggcagaggatcaactaagatgcatgttaatatgtttttactctgatgcaaatggcaaaaattacaaaaggcatggcatcatattacattttaagcctacagaaattagttttagtgctgtataatgagaagaaaaaagggttcgttatgctaaatgtttgccttaattaaaacacaactacttttctgtaatatgagaaattacgtaccaaatccaacttcatctgccttatattgttttccagttcagctatatgctgactgagggcctgcataacaattcatgagtttaaacaatatcagaaggatgctaaagttgtgtacaatgattatcataaaaaaagaaggtactgctcttgcttttttcttttgtagcaaactaacctcatgacgctgcattgcaacagcacgcttcaatgcctttgcttttgttaaaagattcctaggccttatgttaataggcctcctataattctttccacggtaaaatataagtgcatagccctttgtaactctttcaatggcgactagtataccgccactctcatactctagaagccgtgccgtctcctcaacaaagggcagagtcttctgctttgttatcaatttgacaacttccctgtgcttccaatgcaagtgcatattttcaatgacgccatcaaagacaccacgaattcctaaaatggaagggggaataatcaatcaatagaaatagtatagaatgctctccaaggttattgttcaagaaactcaccaacaggcaagtatgccttaagacgcaaaccgattctacggaaaacagatctttcctcatctgtaatcatttctttatcatcagatggattagcaaggaccatagaagcttctatctttgatagtaaccgctctgctctatgtatttttgcctgtgcctgaacaattgaagaagaaataaagaacatgcataacaactgatggaaataaatatatgtcaaataagcacactggcatacctagatcaacggcataattaaaaaatggcaatacaaaataagacaagttttatcagagaacatgcagaaaatgcttacaatggaaagtttgtgctctagtctcttgaaaagcttttccttcactgatctagaagatgcttctttcatttcttcttgctccttagcagttacttcccttccccaacgagcttgagcctcctgaaattcagcaagagtacccgcaagagcatgcccatctaaactgtcatccattgagtgcacaaccggaatgcatcttttctgctcctctacattctggatatcttttgtcaactcctctctttcagccaaagcagctgcaacagatgttggaaggaagtcttttccacgatatattacaatgtagtacttatttcgaagaagcaaggtgccccctgttagattctgaaataatgttaaaaagataaggcttcactgattcagaaatcctatacaggttaaatcaaatatagtgcatgaacagttgaacacagttgattcatggaaacacacctttggaactctatgaaagttcgacaaggaatagaactaaactatatgaagctgtctccatcatgatcttggtaaagcatgattgtctatgatggtgtttagacaaataaaagcattacattaagcaagttatattcattagagcaagcagtgcagcacaattttgttattattttccgaaacccctggtgttgctttggatgatttaacaaatcatggattttgtaatattcacaggacaaatatggacttcatcaaaacctactgctgagtaagtgagtactgagtattccttatagttgccccttttttatcaggatttttagttgaatttcttcatgcctcaaatacgactagatatatcatatattcagcttagctatgacaagcaattgtatatttagatataatctggcaattaccatagttttcaatgttccttggcataaattctgtgaactgtgaagtaagtaggtatgccagtcaatgagtcaaaacagcaacagcatggtgtccaaacctttatttcttctgacattagcttgttgtttgtattctggattccacgtttcacagctattttcaccaccaaactcttctcccagagcttaacaatagctgctgcaaggccttgatgattccggtttctcccttaaatgaattttatcaagcagtagtcaggcgtttgccaccaacaaataaaagctataataggggataaacaatatgaacactgtcgaaataatcacctagagcaaaatggcatggaagatcccttgctaacttccgcaaattagtcagctctgcattggttagggtcaaacgcattccagttggaagaagtctaaatggtgttttataaccaggaattgtttgaggcaacaagtcggcatccacaggtaaaatgcctgttccccaccaatccacaaaacgagggcccaactcatcaagcatttgattgaactccagctcctcttcagtcatgtcctcagtattctgcatatttaatctggctgcaatctcacgttgggtgtttacatccttcccctggctatcatgctctgtggggcttgatgcatccgggatgaacaatgtaccgtctgcccctttcaccgctgatgagttaccatccaatgtttcagatttcaaaggccttttgtaattgctccctctgtaaaccaccataacactcccagacctccatatgatcaatcctcctgtccgtcgctgatcgataggcaaacgtcatgtaagtaatccatttatcatggcacaactaataactcatcgaaaacctcgaattcacagcaacaaacataataattcaagttcaattgccactagaaatcactaaactgaactgatatccaaaaaaaaacataatagattaaacagttacaacgagcaagctgccaatgctgatagaaagggctaatatagcacacacctcgactagctcatgagcagttttcatgtcgtgcgcgaggtcctcgtggaacttgagccggaccaactctgatttcctccaggcgtcgtggatcttctccgtgacggcttgcgtgacgcccgccttgggcacggtgatgcggtcccgaagagtcatccccagccgccggaggcgacgcagctcctcgtcctcgatcgtgagctcggccagcgagggcgccctaaccctcctcctcttcaccccgtcctcctcgttctctcttcctcgcgcgacctcatccctctcccaggggaggacggactcgtcgaagctggaggcggcgaactgctggtcggggcgcgcccagctgcggtcgagcaggtcgctgaggcgctcgttgccgtcgggaggcgcggtggccgtggcggcggcggcggtgggctcgtcgtcgtcgctggcgaggccgaggttgcggaggcggtggacgattcggtcgatggaggaggtcggggagggagccggaggtggtggcggcggcgcggcggggtcggtgggcccccacttctgcagccacggcgcgcctcgggttggatttggagccggaggggcgcggttgccgccggaggaggaggaggaggacgcggcggcggtggtggaggaggaggaggaggcgtggcgggaggagagaaggcggagcgggaggaggcggaggtgggggcgggaggagaggcggaaggagtggtggagcgggagctcggagagcgccatggatggagtgtggtggggggtttagcgcggtggcgccatggatgggaaggatgagatgtggaggtggggttttgggtttggtggtggcggataaggaggggaggacgaagggggttgggatatttcttcgcgggtttgggctttttggattcaaaccgttttaggcctagaatcagaaaatgaattaaaagacacaagctgacaaacctaaaattttcatattctcaaaatcttaaattctccaaacatgcccttaatcaatggtctggtttctcaaaccgagctactagtaattttaatgacagacgctactggtttaatattaagattgtgttcgaaactaattctgaaaacgtaatggtgagttagcacataattaattaagtattagtttaaaattttaaaacaataaatttatatgatttttaaagcaactttttccatagaacgttttaaaaaacacatcatttacggttagaaggtgtacacgtgaaaacaagagagtgaaggttaggaacataaataaacgaactacaatatggattgcagcctaggtaggggagtaaaccgtacacaatcaccaagggtgaagagaaaaaaccaaaaaagagaaggaaaacaaactacatcagaggacatggtaaggcgctattctcgttatatctttcgccccacatacaatttattttatttttttgtcactagttgtgatattgaaagttcgttgcttctgaaaatatgtctattcttttcgcaccaaatctcctaaatgagaagcatgtaaattgaatgtgtcccctttgtttggctactagtagtagtacagtaaattattagtagtaataacgagtagtactagtatcgtccagcctttttcgttatttttagttttttttttggaagttacagtagcttcagaaacttgtatactgaaaatgaaggaaagaacaaagctttatatttacaacgcgtgatcagctgcgaatgctagaactggatcagtaaatcaaaccaactgcttgcacttgcagtcgaattatcgccaaactgaacttattttattcacacacacacagacgagcagattcaaagtctcaaaccacttcacttgctatgtacgagtagtagtagtagtagtaaacgacggcgcggcttggtcggcgtaggaccggctttgccgcttgcgttgcgtcgcgtacatgtcggtgggtttttaagccaaagccggcgcctgcgcctgcgccggcgtccgggggttggagaagcgatgcttcagtttctccacggcgagattggcagtagttgcaaccgggaacaatggctgcgcggcgtacggggacagcagcagtgctatcatccccagcagccaaagcaggaagccggcgagtgcgtgcccggcgtgggcggcgggcggcttgccggcgacggaccacaccaccaccgacgcgccgagcagcgcgagtagtccgtagagagcgtgcgcaccgcgcggcatcggcgccgccgctggcaagcgaagtctctccgactgcgccggcatcgccgatgggttcccccgcgctctttagaagcacgaactacgtagtacagagttgtcaagtgtcgtgcgcctggatacgatcggtctcgatatatagacacgagacgtgccaataaataaataataaaaaaaaactatcaccgttctctccatcggaaaaatcaacaaacatagcatcacgaatggctagtcagctaatgtaaattttttagtactaccatattccacttgatcaccaaaggcagcagcaaatgtaaacatcacatccacatcaccaaactacttttgcagccaaaggaactactcctacgtgtataattgagcttttgcagctatccaaaggacaggttacgttgacgaacttttgtaaagctggagtcacattccttttgtctgcatatagcaactgtttagaattaataggtgatgtttggttggagggacaaatccatcccttcagtatattcatttgatgactgatgatggtttacgtacctacgtcatcgatagtcggaacaaaaggctctaaagcttggagcaattttatggtccttgaggatacaccatgagatatcaaaaatttagtgtaaaattcgttatttcatagtatctaagtaccaaaaagtgatacctcgtaccaaaaagtgatacctcatggtatcttctcaaagacagtaaaattgctcgtaaagctggagtcactttccttgtgtcttactaggagttaggccccatttaaattccaccttaatttttttttaccctatcacatcgaacatttgaacatctacataaagtattaaatataggcaaagaaaaactaattacacagattgcgattaatttgcgagtcaaatctttaaacctaattgcttcatgatttgataatatggtgctacaataaacatttgctgatgatggattaattagacttaataaatttgtctcacattttacaggcgaattatgtaatttgttttgttattagactacgtttaatactttaaatatctgtccgtatatccgacgtgacacgccaaaaccttacactactggatctaaacacccccttaatgtcatctcgtcgatctgcatatagcaaccgttaattagaatcagctactagattcatttgatgactgatgatggtttacgtacttactactcccttccacacaaccatttttttctcatgtataatataagacgtgtatgtattagggtgatccaaccaagcaggagattaaatattttccaatagaattgatttgttttaaatcctataccatcaaatattccaatcacattgcttgtatgtattagggtgatccaaccaagcaggagattaaatattttcttagtctttatgttatgagtagttaagccttatattttgggatggaatgagtatgtcatagtctcatagatagttggaacaaaaggcaaatcgtcctgtccattctgtcattagctctagtaaaagacgatccattaagttgcagtgctagatttatttactttactgctcccttttagtacataaaaaaaacaaacataatatatccgttaagctgtcatactaagtttttttttcttacaaaaagagtactccctctgtttttctaaatatttgacgctgttaactttttagcacatatttattgttcgtcctattcaaaaacttttctgaaatatataaaactatatgtatacataaaaatatatttaacaataaatcaaatgataggaaaagaattaataattatttaaattttttgaataagacgaacggtcaaacatgtttaaaaaagtcaacggcatcaaatatttagaaacggaggggtactaattttttaacattataaatgcagatgtttataacacgtagatccatttatttacaactatttattttagaaatgaaaaaagtacgaattactcccaaactatcacggtcaaccgaattaccctcataaacctgaaaaccagacatcgtttacactgaaccactgataaaaaagagcgcagagtcgaaatctctagagttgcattccttccatagatgccaagagattaagaggattagggagtccaagctggcacaaagatactttggtaaacataccctataagatagccaccggatctgaagccagctgccacgggaggagagagggcagcccagtctacattacacagaacaaaaaacaggaaaaaaaaacctgtacgtgatcaggatctctcctactacgccttccacaccatgaaggatcccctcctctcttcctgacacggccgaaccttgctcattgctcgtcccatcatcgccatcgccttgatgcttgggaactgaccttcaagtcctccggagtcaccggcggcaagatcaggctttgttacttccttcctctgatcatgatcatcttcatggtacacaggaacaccaccctggcaccatctcccaatccaccggtcatcactctttgccggaacaggagatgcttctcggccgccttgaatttccaccccttcatccaatccttgttcctccttatgatcacggtcaacaatgtcgtcgtcgtcgttgctcccgtcgcaacggggtgccatgctgcttgctcctccggtgactggacgaccggatccgtctccagcttttgacctcttggagcaaggaagatgatgagggtccttgctgtcaatctgtaggcgttttagccatctgtcgcctggttcggttcgcgcttgtgattcttggtttctcattctgctcaactggaattgcatgagatctaagtccatgcgtgctgttcttggattgtagcattgttgcttattggcgacaattgccttggaggaaacaccttgatgttcattcacattgcatcctgatgctcctttcatgtacagagtcgcgagctgctcggattttgcctgcaaccatataggaattagccgcggcatgttcatataaatgagatagcatgaagtaacttgtttgcgaggatataagaagagaaaaatgggctatgtccaagctaatatgattatatatgtgatcaaaatcttaaatatggaaaacaatgttgatggtgcagaaaaaaaatgcatatccgacaatattatatacatttttaaagtaaatttgcataaacttatatgataacgaccaaacatgagagtagtataggacactagtaccttttgtgccaacaatgaggcgatgcctgaaagaagagagaacaaaactgtgagtgataccaccaatggaataaagaaaattgttatattttattcaaggtttttattgccttctttcatacccaataaatcaatctcgactcaaacaacattggaaagagacaagtccttttaatcaatataagctaaaagaatgtcgcatgagtattatctgagcttcttctctcctacctgctgaggattttgaaacatgttgactgtcgccggataatatttcagtttcagttgatgatttgttatttgctccaaatagatgactgccaatatttgtgccgtacatgtgaactccaaaagcagtcgagtttcctgaaggcagtgaatcttcaggattcatattttgagctttggaaggtatggttagcatttcaaataaatatggagcttttcgtttagttgaatctccagatatgctcgatggctgggtcactgcctcccccctaccatttactgtagatatgtctgcagctggatcaggtatgcaggagccagtgacattcgctgcagatactattctctgtgtattcagatgtcgctgattaattttgtcggaacaattaatttcagcagcttcaaattctttaccaggtactgacgtacgaaacatgactcccgcagaacctttgtgtttatgatgtccaggtgctcttgacttctgattctgggagcaacttccaattttacagttcgtgtcattgttttctgaagatttcaaccttttttcacgagatctgcaggttggttcctgatctgaatctgcaatgtagcggcttgtatgctgctcatctaatagactatcagatgagttactgtcatccttgctacacgaacatgacgttgctggcaataattgaccttttaatttttgctctgcaggattcaacatgacaccagcatgatcttccaggcgagatacaatgcctcctgcatgtttgcagtgatccattgtctcgtcggttgttcgatgagaatgcagctcatattcctgagatgagaatgccatcagattagctgtagtcatgtttagcttcagagtttgttttggcacaaaaacgtcattgggtccagtactctttgcagacttcctcttagggttgagaatggagtcaatttttctgttgattgcaagcataggaaaatggttccactctgaactcaggtcatctgaacctgcaagtttctgacaatccactgataactctgaaagcttctgaatggaaagtgattttgatacaacagccttagcatataagacatctttttgcatcacagatttttgaattggcccgtctccctgatcaatttggttttgcacagcgtgtcggcgagcatcttttaccactactttcatgttagaatttaacttctgtccatgctccaacgaagctctttcttggctgattcctaccattagcctttcaaacaatctagatttcatgatctcaaagtttgaaggcccagaattgtcctcgcaaatgtcatatttcgcatcctccggagaatcattacttctgccaacttggggctctgcactgctgcttcctttggtccagtgtgacatccattgggaatgcttagaaggctctccagggtcactcatcctcaaaagaacttgaaagtcttttttctcgtaattttgcctttatctcaaagttgacagcacttcttcttctgtcaaaaatgtaagaagcgcattacaactttacagcctgtcaattaactgataagtttgtcctcatagtacaatatgtcgaggaaaaatatgaatatatgataatgcagtagaaacattttcatagataatcatatcatgacgaacgtttcgaaaaaatattagtatacacacacacacactactgagaactttgtcatttccaagatgaaggtatatactgtacttctttctaaaggaaaaatactccctccgtcccaaaataagtgtagccatggttttctgcgtccaactttgatcattcgtcttatttgaaatttttttgaaaaaaattaaaaacataagtcacgagtaaagtactatccatattttatcatctcataacaacaaaaatgctaattataaaaaaatttcaaataagacggacgattaaagttgagcgcggaaacttatggctgcacttattttgggacggaggtagtacaagtttgatctgttaccatggtaaatttttagacgagatcaagactaacagtgtatcaatgtgtccgcaaagtttagcggcctttcctactttggcgcttccttcccccgaaggatgttggagggcgttaaactagctactccctccgtcccaatatattgcaacccatcctaggactatgaatctggatatatggtatgtccagattcattgtcctagaatgggataaatttatcccatcctaggttgcaatatattaggacagagggagtagcaatttgttaaagactgattgaagatgacttgatgcggatggcctatggcctcaatctttcagtggccctccctcctttggggcttccttcccccaaaggacgccgacaggcattgatcccagcagcaacatgactaagtcattattctgattgcatgatgcgggtggtcttcgacaaccacagcctttcacactgccagggtaccgagccgcatgcgtatggcggagaggccctccgacactttcgattcctggtgtttccagactgcatgtgaagtggatgatgtcgaacaagggttctagcatttgcttgatttggaattttgttgggtgattttgcaggtggcaaacgtcaaagcttctgtcttctatctattgtgcctctttgtgttaggtgggggaggttgtgatacgtttgtattctcttctttgtatatcccgtgtattcttccatattatcctccagggccacctacgcttgcataagctaagcctgccctgtgtaagattgtttgaagtaacatattcaggtgggcatttcgcccccggtgaccattcttaaaagaaaagtgtctagaccgaaacagatattcatgatttcatccgactttactgcacctataacacgtgagctctggacattggttccttaaaactctatagtgaagcagcaaacattccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48567 - DNA, 5237 bp, Oryza sativa
  unsure (1)..(5237): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcttctctgagaagttctcagttgcctctttcagtgtagccaaatcaaagatcgtgcattttcctcttgccattttcttcaatactgttgttgtgttttttttttaatgcaatacatatcaataaatgtaaaataagaaaacagttcctgaacaaacatcaagctactcatcagttacttacagttgtctttctttgcagccttctttctcttgaaacgaatgaaagcataagctgacagtatcaacatcaagacaacgaagcaagcgacgcctgcagagatccctgcaactctccttctcctcgctgcatacaacaaacagacattcagagaagttgaattgatatgtgcagtgtcaaagtttgcgagaaaaaagtatcgtttcttcaatggaagaagaagaaaaagaaggcaattcttttacctgttctagtcggcggagcagcaagtgaaggcatggccggcggcggtggctccggcggcgcagaaatctgcagcattggctggccctgatagaacggcttcacgctgtacctcaggttgcaccaaatcccaagaactctccctccgggcttcccgttcaagaaccatgggatcgacgagacgaagccgccgaggcagctccggcactgcgccgccgtcatcaccggcgcgcactgcgccatcccgtaaatcttcgggtagtgcttcgggtcgaagtcctccaccgccgtggcgaagtacttcttggtgttgttgctgccgctgccggcggccacggccgtgtccaccgtcgcgttcatcagcgcgacgacggcggcgttgaaccaggccaccgggacggccgtgatgttgctgtcggcgtcggagtagagctcgctgaccggcgagttcacgccgacgaagtcgaggaaccgctggtcggagaagcggacgatgcagccgtcctggtaggtggtggcgtccttgctgctggggcagtcccgccgcgcgacgcggaacgacgccgcgacgcacgcgcggcacgccgtggcgttcgcgtcgccgcggcacagcgccagcgcggacacctggtcgggcaccgcgccgacggtggccgtggcgtagccggccgccgccgcggtggacgcgttgcccgggagcgccgccgcgaggacggcgaggttcgcctcgtacgtgctgttcgccgcgtaggcgccgctggcgcatgacgagaactgcatggtctgctgcgccgcggcgagcggcagcagcacggcaacgacgacgactacaactgcgagcattgccgcggccggcagaatgcaacgtacaattcctctttcccttctttgacggacgaaccttgcgcggcaactctgagcctgagcttaactaacaattttttttcttttgcaggaaaaaaacgcgcaattggcggtttttgaccgagacaatgatcagtagctctcgcccgccattacagttgcgctgtttgtcgtttgagaatattcatttcctctgcgttgccgctggtacttgtcaagttctcgtcatcagataaacgtacagcaacttgcattgccaattggctgaggtcggcatttccgtgtcggaaggtgaggcccattctccccggcgaactccggtctcgcgtcggtctccctacataagtcgcctgcctccacctcttgacagtgtcagctgtgtccatggcgcatcgcgctggctgcctctcgatgctgctcaccgccgccgtcgtgctgctggcgctggcgccgcgtggcgcggcgtacccgtggcaggtgtgcggcacgacgggcaacttcacggccaacagcacgtaccaggccaacctcgacgccgtcgcggcggcgctgccccggaacatctcgtcgtcgccggacctcttcgcgaccgccatggtgggcgccgtgccggagcaggtgtcggcgctggcgctgtgccgcggggacgccaacgccacggagtgctccggctgcctcgccacggcgttccaggacgtgcagaacatgtgcgcctacgacaaggacgccgccatctactacgacccttgcatcctctactactccaacgtccccttcctctcctccgtcgacaacgccgcctcgacgagccgcgtcaacctgcagaacgtcacgtcggacccgggcaggttcaacggcatggtggcggcgctggtgaacgccaccgccgactacgccgcgcacaactccacccgccggtacgcgtccggcgaggccgtcctcgacagggagtcggagttccccaaggtgtacagctgggcgcagtgcacgccggacctgacgccggcgcagtgcggcgactgcctcgccgccatcatagccaagctgccgaggttgttcacgaaccgcatcggcggcagggttcttggagtcaggtgcagctaccggtacgaggtaaaccccttcctcaatggcctggtgatggtgcatctgactgcgccaccgattccgacagcatcaccgcccgccgctgccgcggcggcggccggagaaggtgagtcaaagcatgcttcttttttttctttttgcttactctagattttgcacgtgcgtgatggctttcaaatgattgaaacattgtttagttcatccattggtgacaaaaatgattagcgaagtcccctgaagttggtttgatgtgattgatcttccgttgattaattcaactggtagttaaccttgtgagagtcgttaacgaacactgctagcattgtggagtactatacacatataggctgcgtttgtttcagggtgttcccaacccctgttcctcgttaatagactgctccatttttcgtgcggagtagatgggttcccaaccccatgtgtcgaacacagccataatcggtaggtgatctatctgtgttgtttatttgtgggggtggtgtatagggacagtgtcatttcattttcagtatgtcagcttcagtgtatctacaaaaaaataacaataaaattaaagaatggaattcgtaggccaagtgggattagagatgcagtgcaccaagtagataagatgtcacatttgttggcatttagcccttcacaatgttcctatcatcatacagcctgtggttttgttcttcagtcagcgcctgtaggtttgctccaatacagaggcacattctgaaggcaacacactgtattggctacggcattagcagttagaagcaatgtttgtttaaagagtaaatttcacaaaactatatgtgttttgcacaatctatctatctattatataataattatataattaaagtaatagaaaaaggagccttcacgttcgctctcacggcttaggaattctcacattaatcgaaagaaaataagagaaaaaaacaaaacaccaagtgtattaggattaggtcatgcaaacggacaagaaaaattaaaagttaaaatggacagaacaaatagaaaaaaaaacaaaggatattataatgatagtgtgtaaacagataatgattctttggaatccgtatgagagaatttctgcatgcccatatcacggtaattgacttatcccttttttaattgtacacaatacatgtcatctcaataaatacatgtcctagaaaaacataaataacaaaagtaatcgcatgattttctcgccgcaaattagcacatcagtaatctttttactacaatccacttcatcagcagattaacaaacataaatcttttcatgcaatccgcttcgtcaactagcagaccgaaaatatatataatttacaaataactaaaatttgatattaaaaataattaataaataaaacatatataaaataaaatatgaatattacacatcagtagtttcgtaaagttattgcaaaatttaaaattatgttgtcattttaatatatttaaataatataatgagaaaacatatatgctattatatgagagaaaatataatgatgctagccgcgcaatctgcgcgggccaccatgctagttaacttattaaaggaatagaaaaaggagcctccacgttcgctctcacggcatagaaattctcatattaatcggagaaaaagaaaaacaaagtccatatagaaatacaatttataaataactgaaattcggaattaaaaagtaaggaatattagaagtagagtatagagtccatatagaaatacaattatgaaataatagaaattcggaattaaaaataaggaatattagaagtagagtatagagtccatacagaaatacaattaggaaataatataaattcggaattaaaaataataaatattagaagtagagtatagagtccatataggaatttaaaactaactaaaattcggaataaacataataaaattaaaagtagagtttagagtccatataaaaatacaatttacaaataactaaaattcaaaattaaaaaaaaacatgggaagaagattctaaagtcaatatagggatataatttagaagtaactgaaattcgaaattaaaaattaaagaatattgaaagatgagtttagagtccacatagaaatgcaattagaaataacaaaaattcagaattaaaaataaaaaaatattggaagaagagcctagagtctacatagaaatacaatttacatataacgaaaattcagaatttaaaaaatattaagaataattaataactatacagaacaaatagaaaaaaaaacaaaggatattataatgatagtgtgtaaacagataatgattctttggaatccgtatgagagaatttctgcatgcccatatcacggtaattgacttatcccttttttaattgtacacaatacatgtcatctcaataaatacatgtcctagaaaaacataaataacaaaagtaatcgcatgattttctcgccgcaaattagcacatcagtaatctttttactacaatccacttcatcagcagattaacaaacataaatcttttcatgcaatccgcttcgtcaactagcagaccgaaaatatttttatttacaaatactaaaat

SEQ ID NO: 48568 - DNA, 5603 bp, Oryza sativa
tatctgtagttttacgaaagagtgaattgcattggcggtacacgaatttgtcaggtgggtgcaatctagtgcatgaacttataaaatgctcatgttggtgcatgaacttgtctagtgcgtccggaggaaggcgaaaaggacattatatatatagctaatcttattgatttaggggctaattaggatattatgtaaacatatatctgagaaggttgctattagacatacacctcttcaataaaaaaaatagaatatgatatagtgatagtagaaaaagatgaaaaaaaccaagcaaatgatattttggtcctcgttcgcacgaaatagacaagtttgtgtactgaaatgaggattttacaagtttatgtaataaattgtacccacctaacaagtttgtgtaccaccaatacaatttactctttacgaaatttactcttgtttaaatgatcttgacagaataaaaaaatattttttccttcagttttctgaatatacatgacaagaatatggcaaatgagattgaaaatgactgaaaggcgatgttggtacttgcctattagcttctggcagctcttgcacgttgcttgcgtaatgctattgattatgtgtttagttgcaacttactcatttgatctgaaattagtctacatctgtcaattcacagggaaagattacaatgttcctcgcttggttctagcaattttgctgcctactatagcagctttagtgctaatcaacattctagtttggctctgcttctggaggaggatggagaggctacgatcaggagcaactcagccatgtatgccctgcaaaatttttcaaggagaatttgaaacaaattaagttgttagcttacattggcatttatacttgaacagattccagcaactctgctgaatcggagaatatttcaagtgtggagtcgatgcttatcgacatttcgactttacgagctgctacagggtgttttgcagaacgcaacaagcttggcgaaggtggatttggtgcagtgtacaaggtgctgactctaacataactgaagaaagtatcactaaaaatatattcattactaagtgttactattgatttggtctgaacagggtactctgcctgatggcgatgaaatagcagtgaagagattatcgaagagttcagcacaaggagtgggagagctgaagaacgagctcgcattggttgcaaagctccagcacaagaatcttgtcaggcttgtcggtgtctgcctggagcaagaggagaggcttctcgtctatgagtttgttcccaaccgcagcctcgatcagatcctctttggtaccaccaaacttactaatccactcaattttagctaaatatcttcaccattttctctgcaaagttcaataacatcaagctgatcattcactctcaacatgtttttttatcaatatcagacgccgacaagcgtcaacagcttgattggggaaagaggtacaagatcatcaacggcattgctcgtggcctgcaatacctccacgaggactcgcagctcaaggtagtccaccgtgatctcaaagcgagcaacatcttgctcgacatgaacatgaacccgaagatctctgactttgggctcgcgaggctcttcgggcgagaccagacgcagggggtcaccaacctcgtcatcggcacatagtcagtggcagtaacccaaatacagagaacataacaatttgttgaaagctgttgcttggatggtcagttaatgaatagtactttacgctgttgtatttcagtgggtacatgtcaccggaatatgcgatgcgaggcaactactccctcaagtccgacgtgttcagcttcggcgtcatggtgctggagatcgtgacggggaagaagaacaacgactgctacaactccctgcaatccgaagacctcttaacccttgtgagcactaaccatatgatcctactcgtctgttcatggaaaaatgaggtgattgcttagctaaaattgactggattactcgtttttgtgcaggtgtgggagcagtggacggcgagggcggtgtcggaggcggtcgacccggtgatgggcggcggtttctcgtggagcgacgtgatgcggtgcatccacatcggtctgctctgcgtgcaggagaaccctgcggatcggccggtgatgtcgtcggtggtgatgatgctcggcagcgacacggtgtcgctcagggcgccgtccaagccggcgttctgtgccaggaggaacggcggcaccggcggtgccggtgccagctcggggggcacgtcgtctggtacgtcgacggcggcgtcggtgcaaggcaagtaactgtagaagtgtgcaacggtgaaactgtgctcgctgtgtgggatctgccattccgctgaagcattctttgccaggttaggttaggctttcataagtatataacgcaatgtaccagactgattaccaaaagaatcaaagacagcaaaatatactgaaaacttgtggttcagtggctccatggagcctgagttcctgtgctacaaaccagtgatttcaaaatatttgtaaacttttgtaatagagagtaattttacggtccttgaagagattacatgaggttttactttttctattgtaaatttgttacctaggtaatatgaggtaccaaattttacattaaatttttggtaactcatggaacctcctcaagcactgtaaaattgctctttttaatagaagcgcatggagaaaagggtaaagtttttgttgacaaggttttgctaaattttggttgcttgaagttttattatcttgtagtcaccaaaaattgcaaggctaattttagttaaacttcactgcaattttgtttatgtacttgggtttacgttacctcagtattctgtatttacatttttgtataggttcgtcattttgaaatttattgtatggttagattaatttgttcaacctgtataaaaagaaacaatgagaaaagttgtgggaatgatgagcatagttagatctcatccaaaggataagaaaagtgggaggcattgaaatttctgtcacttgatgaatagcccttttccaaatcgtaaacaaatgtgacgtgtactaacaattaacgaataaactaaaacataatatattgactcaatcaatggagaaatgcattcagaattcagtaatacaaattatcgaaggctttctccctgtaagtttgacagatagcaatctgattgtccttgcaattgattttcctatctttcattcagaaaattgatttatttatcttggttcaagctctgtaacagacacatcattaactgacatcatcccagacctatgggtcggttgggaagtttgtgggtatgattccgagtatatatttgagtctgtaccactcttgggaatgaaaaatgatggcttggatggggattgaagagacactgtgttgctgctaagcatgatattcactgttgacatcataggtcgatctgctgggttatcttgaacacacagtagcccaatgtgaatacacttgagcatctggtctcgaggagcatggcttgtaagagagggatccatcatctccaaaattgttcccatggtccagtgctcccatacctgcatcatattggcaaagatgattcagaatttttgtaacaagttaggagatcattctgattagctttgtagaatagtccaggaaaaaggacttacacggcttaggagatcatatgattgatcaaagctatatgaaccactgcttcttcttcctgtcacaatttctatcatcaatatgccaaagctaaagacgtctgattttacagaatagtggccacgcatcgcgtactctggtgccatatatccactgcagtaagagaataaagttactcatgccagcatactatttgtatctgattgggttagtttagacaatacttactatgttcctaccacacggcttgtgacttcccttgtttgatcaccctcaaatagtcttgccaagccaaagtctgaaatcttagggttataatcggagtctaataaaacattgcttgctttgaggtctcggtgaattattctcagttgagaatcttcatgaagatactgtaatgcgcgagcaattccatttattatcctaaatctttttccccagtctaactccttccttttctcaagatctgtcaattgaacaagaaatgtcttagtaaactacagttttaccactaatatatattcatgatgacaagggcatgtgaattccaagtgtttggcttgggttgaagacctgattcaagaaggttggggggggggggtgtaaagaaacacattttggaaaggaaatgtacagttcagatctagtagtgcttgtgcaattgttgaattctgagaatagtaccaaatagaatggtgtcgatacttctattgggcatgtattcatacacaagcaatttctcatgttcttgcaagcagacaccaacaagcctaacaagattcttctgctgaagtttagcaaccaaaacaagctcattttttagctcttctattccttgtcctgaactcatagagagcctctttacagctatctcttcaccactaggaaggacgccctgcataagtgcaagcactcgcttattgaagctgtacatagttatgcactatataaagtgaatgatatatatgattgcattggcaccttataaactgaaccaaatcctccttcaccaatcctattgctctcagaaaagttacccgttgcagcacgcagtgttgatagatcgataaaaagtgaatccgtgctttcaatgtcctccgccatttgaattgaatctatcaaaagagggcaacaacattatgatgcaatgtaactgaaatattaacttttcctgaaatataacgtcgacatttccaactatgaaacccttttttcatttctagggaataaaagaattcaaataatcaaagggaatcactgtttccctctcactataatcaaaattgttggtgaacttacatgaagattgctgttttgaccttgatctttttctccacctctgaacagaaagacaaatgacaaccgtagccaacaatataacaactaggggcaatgcaatggctagagctgtgccacttttatttttctttcttcctgcaggcaagtgatttcagcttcagacagataaaacttgtttttgttgcgaagacagacatatagaagtatagaacttaacaagactaattcataacctaaatatgatgacacatatccactataattaaggtttctgttcaaaaaggtacatgctacgaagtcacaccagaaacttatttagtgcaggtcaacactttgacctatacagcacaccgcaaagctagtaaagtcaagcaattttcaatatattataaacgactattttttactgttaaaaaaggtattttagaatatggtttcatcttctcgtgtcttttcctaattaaacgggaaaacatggaggaaaccaaaatcattgttgaactttacatgtaaagcacatacatacaagttgcataatggaagtgcagttaattaccaacactacattggaataaatgtgtgaactgaccgggctgcagga

SEQ ID NO: 48569 - DNA, 8157 bp, Oryza sativa
aagatgaaaccatattcacctagctctggcgctggagtgatcagatctacaattctttttattattactggtggtatccacaaatctcggcaaagtagacaaccaggataattgaatacaaataaaaatatgaaagattgtggggaaatttatggaaagtgacggagacgtgatcaagtgataaggaaaagtacttctaaaagtattcctgaaaacatcatactagtattatttattggtaaataaatgcattgcagttggaaatgttgagtaagacgtgcttttcgccgtttctggtcaagaatccgatagaaacaggactaaagaaatgtcaagatcaacccaaaaaaggaagaaaagtgtacagggttataatatgtgatagctaccagcgtaccaggctcctttgaccagtaatccccatgcaaccagttgccatgattgagatatttttatatttccccacatttttattttgttatttttgcaattcaacagtactgcaaagcaaaccacaattcttaacgcggtaacattttttacctaaacagcagaaacaatttgaagacatagtacaagtttgtttagagttttcttcttcaatagtcgtttggttgtcttcattttgtcaaaattgatggaaaattaattatgagcagatgttgtcgcgctaattaaataccaagataaattactgcaaaagaagtggatcccctttgtctgcaacacacctccggttggcgccgtcggcgtcgagttcgccggcgccgggagccgcagcatcgagcctccggcgaagaaaggacccacctcgtacctgaaattgcagcgcatcccgatagccctcccgcccttcctccggctgaggtaccgagggatcagcgcgattatgcgcccgaggcagctccggcagtcgtccggcgacatgtccggcgtgcactgggacagcccgtagatggtcggagtagcggcggcggcatcgaaggcctcctcccccgtggcgaaccgcctggacgagttctccgccgcgtagctgctggtggcgttgaggagggtggcgacggcggcgtcgaacacctccgccggcgcgctcgcgttctgcgtgttcatcaggaacctggggctcccgtcgtcgtcggcggcggcggcgaggatgttcctgttggagaaggcgaggtagcagaggtcgtagacgatgaacgcgtccttgtcgtaggggcacagctgctgcgcgtcctggaacgccgtggcgacgcaggactcgcaggcggtggcgttggcgacgtcgccgcggcagagcgcgagcgcgtagacgatgtccgggacggcgccgaggctgtccttggcgaagagcgtccgggacgcggaggcgttcttggggagggtggcggagagcccggcgaggttggactggtaggtgccgttcgccgagtagttgccgccctgcccgcagaactgccacggctgggccgccgccaccggagcgaggaggagcgccgcggcgaggcggcagaggaggacgcggtggcgcgcaaaggtggccatggctgcggactgcggagatgctctccgtcaagctaagtactgtcgcttcgtttgaccgggtgcgggctgtgactgacgtataggacccctactgctctcaaggtgatgaagctgcagagacaaaattgaagaagaaattgaagtgatgtgacttgtctcttgtttgacctcggacttcttcatcagctcagcaaacaaagaaaattcaggatctgtttagatccactaaaatagtaatttttttttgtcggtttggacaatattttagcaaaatagatctaaacactagtagtaaaaagtagacaaattgacatttatcatttgggagtccagagcagcaaatttggcaaaaaagcgttgggccccatgcgggacgcgcactgcccctcactcgctctctctctctcatccgctcccaaaaatttccctatccgctcgctctctcacccttgctccgctcgcgccgccgctcatgccggctctgcctccgctgatctcacccgtcgctgccaccactcatgcccgcatccgcctccacctccgccgaactcgtccgccgcaccagtccaagacctagccggagatggacggcgacggctccggcacgagggacttcatgtcgcaggccgattcactttcccccgccggcgggtaagaccctttcaccaacttcccgtaccactttattagatccgacaacggtagtgcttcaggataggcatggcccccctcgacgtcaactccgacgatgatgggtggccgggaatggaaagctacaagggcctccttcgctccggcacaaacactagcagcagcaagagagattgctagagtgcagagacaacagcaattaataaggtgccattaatatggacaaatcagtttttaatggtaaaatgaaaatactttaccatacatctaaacaccaacttgtaaaattgcaatgtcaaattttttgctatcaaaacttttgacaaaaaaaaattaccgcatcaaattgattttaagaggccctcagagaaaaatgttcttaggtgagggttaggaacccttacctcccatacggaaaacagagtgatggattagtgcacgattaattaagtattagctaaaaaaaatttaaaaatgggttattatgatttttttaaaccaactttcctatagaaattttttgcaaaaaatacactgtttagacatttaagaagcgtgcgcacggaaaacgagggaggagatgataggaaccagaagagccgaactctagtaacttgcgaccaaattcgtacaaaaagcggacggtgaaaaccaatcgattttatcatgtagggaaacgtgctccatctttttaatttttcccccgaacctgcaaaaaagttacgtatcattataggcttgtttaaattgatggtattttaaactatatcattatttgataaaattaataattatgtagctatatgtagtttgctatctaattttggtaatgtccatagaattttgataatattatggccttgtttagttcgtggtaggaaaagttttggtatgtcatatcggatatacggatacatattttaagtattaaatgtagactaataacaaaacagattacagattctgcctgtgaactacgagatgaatttattaagcctaattaatccgtcattagtaaatttactgtagcactacattgtcaaatcatgaaacaattaggcttaaaagattcgtctcgcaatttacacgcaatctgtataattagttttattttttttgtctatatttaatactctatgtatgtgtccaaatattcgatgtgataaaggtgaaaagtttttccctaggaactaaatagggcctatactgagcacatcctagtagaacttggcaatgttgccgatttaccaaaattttaacattatcaaattccgaaaaggttcattttattatcaaactgaacagacctatatttagaagaaaaaaaagtacttcctccgttttaggtcacaagacgttttgatttggtcaaagtcaaactgctttaagtttgaccaaatttctagtaacatttttaactcaagataaatttattatgaaaatttattcaattattgatttgatgaaactaatttagtattataaatattattatatttgtttataaacttagtcaaacttgaaacaatttgacgttgatcaaagtcaaaacgtcttataacctgaaacggagggagtacccgtacaagcccttaagagcaagtttaatagtatagcccactacgagctccaaatcatctatagctaatgtaatagtcaattcatacaatagttgcttactatactattaatatctggttcatctgtcatacacatattacgtcttagagtccgtgctgcagctggctacagatctgtagcccgcttcttttttctctctttctttatctttttataatatgtttatagctggtttatagcctgctatttacctactctaaggagagaaggatccaggaggctagcgcttcgtccctaatggctgcacatgggcactgtttggtatgtgtttgtgccatgcgggtagcatcttctgttttggtcagaaagattggttggtaattgctaaagtcggttctagtggatacaaccaattgtgttcattttattcggacatggcacataatactagtgattaattcagggtgaaaatcctgatgtagtttatctcgatttggcaaattcggtgctggtttgtcacttttttttttgttgacggtatcatctcagtctttttttcgatggcagatgtaagcaagcgttgggtccttcctcaaaacgttgttttggagtagatatataaaactttatggttttgtcttggcttgtcttgactgtatatattttggatgtgactaaccatatatttttgtaatgccattttcaatggaagatattatttttatatttccaaaagttccacataagcaaaaaggtatatagttgattaaaatagctcatacaatttattgttttgtttttcttgtttcatagacaatacatacaagatacaagttgtattaaaaacaatgtcgacatggttttatcatctgaccatttcattaatttcttgccacatcataaataatattgacatgacaccccgtttaatgagaatgaaactcatattgggattggcctaaattgttataagataacataatatatttatgtttgtcttaggtttttttttctaagttgtgtacatgcctggttgatgcagaggtcgtgtgtaatttcagtcttaccactatctgaagaaattgaaaagctagatttattcgcagtatgccaccttagcatcagtaaaaggtttgcaacaaatttttattttgtgtgtatagcttctacataaatttttgtcactggatgtgcaaccaaccaattttcaaactataaaataaacaagggtggcttgtacgaacaaacaaaaccaaccaaaatattgactcagccaatggagaaatgcactcagaattcaatgcttctcctacaagtttatggccttctccctgaagtttgtttcttaaaagtaacaattcaattaccgttgtcactgattttcttatcttaaattcgaaggatttggtttccttatcttggttcaagctctgtaattgacacatcattaactgacatccctcccgacctaccggtcgaggcagtcgattgggaagttagtgggtgtgattccgagtatatatttgagtctgtgtcacttttgggaatgaaaaatgatggcttggatggagattgaagagacactgtgctgctgctaagcatgacattcactgttgacatcataggtctatctgctgggttatcttgaacacacagtagcccaatgtgaatacacttgagcatctggtctcgaggagcatggcttgtaagagagggatccatcatctccaaaattgttcccatggtccagtgctcccatacctgcatcatatattcatattggcaaagatgattcagatttttgcaagaagaagtaagctacttaaatttgtagaagagtccaggaaatgagcaaggactcacaagacttaggagatcgtttgattgatcaaagctgagtgaaccactgcttctccttcctgtcacaatttctatcatcaatatgccaaagctaaagacatctgactttacagaatagtgcccacgcatcgcatattctggcgccatatatccgctgcagtaagagaataaaattactcatgctgacatactatatttgtatctgattgggttaatatggacaatacttactacgttccgacaacatggcgtgtgatctcccttgtttgatcacccccaaatagccttgccaaaccaaaatccgaaatcttaggagtatagtcggagtccaatagaacattgcttgctttgaggtcccggtgaattattctcagctgagaatcttcttgaagatattgtaatcctcgagcaattccgtttattatcctaaatctttttccccagtctagttccctccttttgtcaagatctgccagttgaacaagaaataccattagtaaaccacagttttaccagtaatttgttgaattctgagtagagaatagtaccaaatagaatggtgtcgatacttctattgggcatgtattcatacacaagcaatttctcatgttcttgcaagcaaacaccaacaagcctaacaagattcttgtgctgaagtttggcgaccaaaacaagctcattctttagctcttctattccttgtcctgaactcatagagagcctctttacagctatctcttcaccattaggaaggacaccctgcatataagtgtaggcactcacttattgaagcagaacgcgaacataattacatgaagtgagagatatatatgattgtaccttataaaccgaaccaaatcctccttcaccaagcctatttgtctcggaaaagttacctgtcgcagcacgcagcgttgatagatcgataaaaagtgaatctacgctttcaatgtcctcccccatttgcattgaatctatcaaaagagggcaacaaaattttgatgcgatgtaactgaaataaatgtgacgtcatttccaactaaaaattgtagggaagaataaaattcgaattgtcaaagggaatcactatttccctataataataatcaaaattgttactgaacttacatgaatgttgctgttttgaccttgatctttttctccgcctctgaacagaaaaacaaatggcaaccatagccagcaatacaacaactaggggcagtgcaatggctagagctgttccacttttatttttctttctttctgcaagcaagtgatttcaatttcagacagatatgaacttaacgagactaattcataacctaaatatgatgatacatttccactataattaagtttctgttcaaaaaggtacatgctacagttcaacacttttcagtttttgacctgtacagcacatcgcaaacttttcaatatattatacagggctttcttcactgtaaaaaaatggcattttagaatatggtttcatcttctcatgttttttcctacttaaatggcaatacatggaggaaaccaaaatcgttgttgaactttacatgtttaaggcacatatatattgcataatggaaatgcagttattaccaattctacatggaataaatgtgtgaagaaacaggacaacagaaatgtcagatctatccaaaaaagggcaaaaagagcacagggttatctatattaatatgtcatagcaaccagatttctctgaccaatgttcagtaatccccatgcaaccaatttccctgataaagacatttttgtctttacctaaaaaatttgcaattcagccctactgcagagcagccacaattcttaacgcagtagcatttctaacctagacagcacaaaacaatttaaagacatgcaaattagtttaggggttctttcttcctttttcttcgaactgattgtaagtttctctctttctctactcaaaactactactatattggtatcttcggtaaattttttttcctagttttctcaaaattgatggaaaactaattatgaggagttgttattgtgctaaataccaacaccccatctgttttaaattactcatcgttctagctttattttaagttaaacatttatctttcaccattaacttttagaaattcatataatttaacatgtgaattatatatattatgaaagtatttctcatggtaaatcttaaaaacataaatagtgtgatgttaaactatatgattttctacacatcgatgcttaaatatacaaatttttgactaacaacaaaggtaaaacgacaagtaatttgaaaaatggagggagtgctataaatttactccaaacgaaactgatttttgaccgcaaatctgcaactcacctccggtgtgcgccggtggggtcatgtttgctggtccaggtgcaggcggaggcgccgccggcgccgccggcgccgggagccgcagcatcgagcctccggcgaagaaaggatacacctcgtacctgtagttgcagcgcgtcccgataacc
